United States Patent 11,560,567 (GENETIC ELEMENTS DRIVING CIRCULAR RNA TRANSLATION AND METHODS OF USE) - sequence listing, part 2

SEQ ID NO: 10050 - DNA, 203 bp, Homo sapiens
ggcgcgccagtcctcaaagcacccgaacagggacttgaaagcgaaagttaatagggactcgaaagcgaaagttccagagaagttctctcgacgcaggactcggcttgctgaggtgcacacagcaagaggcgagagcggcggctggtgagtacgccaaattttgactagcggaggctagaaggagagagcgactcggaccgatg

SEQ ID NO: 10051 - DNA, 203 bp, Homo sapiens
ggcgcgccagtcctcgcgtggaccgaacagggacttgaaagcgaaagttaatagggactcgaaagcgaaagttccagagaagttctctcgacgcaggactcggcttgctgaggtgcgcaacagcaagaggcgagagcggctactggtgagtacgccaatttttgactagcggaggctagaaggagaggcgactcggaccgatg

SEQ ID NO: 10052 - DNA, 203 bp, Homo sapiens
ggcgcgccagtcctcaccctctccgaacagggacttgaaagcgaaagttaatagggactcgaaagcgaaagttccagagaagttctctcgacgcaggactcggcttgctgcggtgcacacagcaagcggcgagagcggcgactggtgagtacgccaagttttgactagcggaggctagaaggagagagcgactcggaccgatg

SEQ ID NO: 10053 - DNA, 203 bp, Homo sapiens
ggcgcgccagtcctcggttaatccgaacagggactttaaaagcgaaagtaacagggactcgaaagcggaagttccagagaagatctctcgacgcaggactcggcttgctgaggtgcacacagcaagaggcgagagcggcgactggtgagtacgccaatttttaactagcggaggctagaaggagagagcgactcggaccgatg

SEQ ID NO: 10054 - DNA, 203 bp, Homo sapiens
ggcgcgccagtcctctccaaccccgtctgttgtgtgactctggtaactagagatccctcagaccctttagtcagtgtggaaaatctctagcagtggcgcccgaacagggacttgaaagcgaaagagaaaccagaggagctctctcgacgcaggactcggcttgctgagcgcgcacagcaagaggcgagcgactcggaccgatg

SEQ ID NO: 10055 - DNA, 203 bp, Homo sapiens
ggcgcgccagtcctttatgtgaccgtctgttgtttgactctggtaactagagatccctcagaccactctagactgtgtaaaaatctctagcagtggcgcccgaacagggactcgaaagcgaaagtgttccagagaagttctctcgacgcaggactcggcttgctgaggtgcacacagcaagaggcgagcgactcggaccgatg

SEQ ID NO: 10056 - DNA, 203 bp, Homo sapiens
ggcgcgccagtcctccgctgcccgaacagggacttgaaagtgaaagttaatagggactcgaaagcgaaagttccagagaagttctctcgacgcaggactcggcttgctgaggtgcacacagcaagaggcgagagcggcgactggtgagtacgccaattttttgcctagcggaggctagaaggagagagcgactcggaccgatg

SEQ ID NO: 10057 - DNA, 203 bp, Homo sapiens
ggcgcgccagtcctgtggaccacgaacagggacttgaaagtgaaagttaatagggactcgaaagcgaaagttccagagaagttctctcgacgcaggactcggcttgctgaggtgcacacagcaagaggcgaggagcggcgactggtgagtacgccaaattttgactagcggaggctagaaggagagagcgactcggaccgatg

SEQ ID NO: 10058 - DNA, 203 bp, Homo sapiens
ggcgcgccagtcctctatagcccgagaaactcgtcttgtcagggaagaaagtagatgaattagaaaaagttaggttacggcccaacggaaagaaaaaatacatgttaaaacatgttgtgtgggcagcgaacgaattggacagatttggattagcagaaagcctgttggaggccaaagaaggatgtcaacgactcggaccgatg

SEQ ID NO: 10059 - DNA, 203 bp, Homo sapiens
ggcgcgccagtcctagtttggccgtctgttgtatgactctggtaactagagatccctcagactactctagacagtgtaaaaatctctagcagtggcgcccgaacagggactcgaaagcgaaagtgttccagagaagctctctcgacgcgaggactcggcttgctgaggtgcacacagcaaggggcgagcgactcggaccgatg

SEQ ID NO: 10060 - DNA, 203 bp, Homo sapiens
ggcgcgccagtcctcctggcgtcgtctgttgtgtgactctggtaactagagatccctcagaccaatttggtagtgtggaaaatctctagcagtggcgcccgaacagggacgcgaaagcgaaagtagaaccagaggagatctctcgacgcaggactcggcttgctgaagtgcactcggcaagaggcgagcgactcggaccgatg

SEQ ID NO: 10061 - DNA, 203 bp, Homo sapiens
ggcgcgccagtcctaccagttacgtctgttgtgtgactctggtaactagagatccctcagacctctgtagtcagtgtgaaaatctctagcagtggcgcccgaacagggacttgaaagcgaaagtagaaccagaggagctctctcgacgcaggactcggcttgctgaagcgcgcacagcaagaggcgagcgactcggaccgatg

SEQ ID NO: 10062 - DNA, 203 bp, Homo sapiens
ggcgcgccagtcctcgctgacacgtctgttgtgtgactctggtaactagagatccctcagacctttttggcagtatggaaaatctctagcagtggcgcccgaacagggacttgaaagcgaaagtaagaccagagaagaactctcgacgcaggactcggcttgctgaagtgcactcggcaagaggcgagcgactcggaccgatg

SEQ ID NO: 10063 - DNA, 203 bp, Homo sapiens
ggcgcgccagtcctgcccgcttcgtctgttgtgtgactctggtaactagagatccctcagacctttttggtagtgtggaaaatctctagcagtggcgcccgaacagggacttgaaaacgaaagtaagaccagagaagaactctcgacgcaggactcggcttgctgaagtgcactcggcaagaggcgagcgactcggaccgatg

SEQ ID NO: 10064 - DNA, 203 bp, Homo sapiens
ggcgcgccagtcctcttcagatcgtctgttgtgtgctctggtaactatagatccctcagacaattctagtcagtgtggaaaatctatagcagtggcgcccgaacagggaccagaaagcgaaagtagaaccagaggagctctctcgacgcaggactcggcttgctgaagcgcgcacggcaagaggcgagcgactcggaccgatg

SEQ ID NO: 10065 - DNA, 203 bp, Homo sapiens
ggcgcgccagtcctcggcctcccgtctgttgtgtggctctggtaactagagatccctcagaccattttggtagtgtggaaaatctttagcagtggcgcccgaacagggacttgaaagcgaaagtaagaccagaggagatctctcgacgcaagactcggcttgctgaagcgcactcggcaagaggcgagcgactcggaccgatg

SEQ ID NO: 10066 - DNA, 203 bp, Homo sapiens
ggcgcgccagtcctgcgtaattcgtctgttgtgtggctctggtaactagagatccctcagacctttttggtagtgtggaaaatctctagcagtggcgcccgaacagggacttgaaagcgaaagtaagaccagaggagatctctcgacgcaagactcggcttgctgaagtgcactcggcaagaggcgagcgactcggaccgatg

SEQ ID NO: 10067 - DNA, 203 bp, Homo sapiens
ggcgcgccagtcctcttccctgctagagatccctcagaccactctagttgttgtaaaaatctctagcagtggcgcccgaacagggacttgaaagcgaaagttaacagggactcgaaagcgaaagttccagagaagttctctcgacgcaggactcggcttgctgaaaggtgcacacggcaagaggcgagcgactcggaccgatg

SEQ ID NO: 10068 - DNA, 203 bp, Homo sapiens
ggcgcgccagtcctctttaagcctagagatccctcaggaccactctagacagtgtaaaaatctctagcagtggcgcccgaacagggacttgaaagcgaaagttaatatgggaatggaaagggaaagttcccgagaagttctctcgagccaggactcggcttgctgaagtgcaccagcaagaggcgagacgactcggaccgatg

SEQ ID NO: 10069 - DNA, 203 bp, Homo sapiens
ggcgcgccagtcctccgggcccctagcagtggcgcccgaacagggacgcgaaagcgaaagtagaaccagagacgatctctcgacgcaggactcggcttgctgaagtgcgcacggcaagaggcaaggggcggcgactggtgagtacgccaaaaataaagttttgactagcggaggctagaaggaaagagcgactcggaccgatg

SEQ ID NO: 10070 - DNA, 203 bp, Homo sapiens
ggcgcgccagtcctgacggcggctatctattcagacactctggtaactagagatccctcagattaaattatagtcaaggaaaatctctagcagtggcgcccgaacagggacctgaagtgaaagtaaccggaggctgaatctcccgacgcacggactcggcttgctgagtgcacacagcaagaggcgagcgactcggaccgatg

SEQ ID NO: 10071 - DNA, 203 bp, Homo sapiens
ggcgcgccagtccttatcatagctccggtacttagactctggtaactagagatccctcagaccttttagtcagtgtggaaaatctctagcagtggcgcccgaacagggacttgaaagcgaaagtggtaccggagaagatctctcgacgcaggactcggcttgctgaagcgcgcacggcaagaggcgagcgactcggaccgatg

SEQ ID NO: 10072 - DNA, 203 bp, Homo sapiens
ggcgcgccagtcctgacgtgccctctagcagtggcgcccgaacagggacttgaaagcgaaaggaaaaccagaggagctctctcgacgcaggactcggcttgctgaagcgcgcacagcaagaggcgaggggcggcgactggtgagtacgcctaaaaattttttgactagcggaggctagaaggagagagcgactcggaccgatg

SEQ ID NO: 10073 - DNA, 203 bp, Homo sapiens
ggcgcgccagtccttgtcccagctctggtaactagagatccctcagaccactctagactgtgtaaaaatctctagcagtggcgcccgaacaggacttgacggtaatagggactcgaaagcgaaagttccagagaagatctctcgacgcaaggactcggcttgctgaggtgcgcacagcaagaggcgagcgactcggaccgatg

SEQ ID NO: 10074 - DNA, 203 bp, Homo sapiens
ggcgcgccagtcctgcccttagctggtaactagagatccctcagaccactttcagtttgtgtaaaaatctctagcagtggcgcccgaacagggaccggaagttaatagggactcgaaagcgaaagttccagagaagctctctcgacgcagggactcggcttgctgaggtgcacacagcaagaggcgagcgactcggaccgatg

SEQ ID NO: 10075 - DNA, 203 bp, Homo sapiens
ggcgcgccagtcctgtctgcccctggtatctagagatccctcagaccactctagacttagtgaaaaatctctagcagtggcgcccgaacagggaccggaagttaatagggactcgaaagcgaaagttccagagaagctctctcgacgcagggactcggcttgctgaggtgcacacagcaagaggcgagcgactcggaccgatg

SEQ ID NO: 10076 - DNA, 203 bp, Homo sapiens
ggcgcgccagtcctaactcctactggtatctagagatccctcagaccactgtagactgtgtaaaaaatctctagcagtggcgcccgaacagggacctgaaattaatagggactcgaaagcgaaagttccagagaagttctctcgacgcaaggactcggcttgctgaggtgcacgcagcaagaggcgagcgactcggaccgatg

SEQ ID NO: 10077 - DNA, 203 bp, Homo sapiens
ggcgcgccagtccttattaagtctgttcaaccctggtgtctagagatccctcagatcacttagactgaagcagaaaaatctctagcagtggcgcccgaacagggacgcgaaagcgaaagtgaagccagggaagaaaacctccgacgcaacgggctcggcttagcggagtgcacctgctaagaggcgagcgactcggaccgatg

SEQ ID NO: 10078 - DNA, 203 bp, Homo sapiens
ggcgcgccagtcctgccgccacctgttgtgtgactctggtaactagagatccctcagaccaccttagcagagtgaaaaatctctagcagtggcgcccgaacagggactcgaaagcgaaagtaaaagttccagagaagttctctcgacgcaggactcggcttgctgaggtgcacacagcaagaggcgagcgactcggaccgatg

SEQ ID NO: 10079 - DNA, 203 bp, Homo sapiens
ggcgcgccagtcctctagttagctgttgtttgactctggtaactagagatccctcagactctcgtagtcagtgtgaaaaatctctagcagtggcgcccgaacagggaccttaaaagcgaaagagaaaccagaggagctctctcgacgcaggactcggcttgctgaaagcgcgcacggcaagaggcgagcgactcggaccgatg

SEQ ID NO: 10080 - DNA, 203 bp, Homo sapiens
ggcgcgccagtcctattggaccctttgatgtgtgactctggtaactagagatccctcagaccaattgtggtagtgtggaaaatctctagcagcggcgcccgaacagggacttgaaagcgaaagtaagaccagaggagatctctcgacgcaggactcggcttgctgaagtgcactcggcaagaggcgagcgactcggaccgatg

SEQ ID NO: 10081 - DNA, 203 bp, Homo sapiens
ggcgcgccagtcctccaacggcgaaaaactccgtcttgagagggaaaaaggcagatgaattagaaaaaattaggttacggcccggcgggaagaaaaaatacagattaaaacatattgtgtgggcagcgaatgaattggacagattcggattaacagagagcctgttggagtcaaaagaaggttgccaacgactcggaccgatg

SEQ ID NO: 10082 - DNA, 203 bp, Homo sapiens
ggcgcgccagtcctaacattgggaaaatctctaccattggcgcccaaccagggactcgaaagcgaaagttacagagaagttctctcgacgcaggactcggcttgctgaggtgcacacagcaagaggcgagagcggcgactggtgagtacgcctaaaatttttgactagcagaggctagaaggagagagcgactcggaccgatg

SEQ ID NO: 10083 - DNA, 203 bp, Homo sapiens
ggcgcgccagtccttgttcgcagaaaatctctagcagtggcgcccgaacagggacgcgaaagcgaaagtagaaccagaggagatctctcgacgcaggactcggcttgctgaagtgcactcggcaggaggcgagagcggcggctggtgagtacgccaatttttgactagtggaggctagaaggagagagcgactcggaccgatg

SEQ ID NO: 10084 - DNA, 203 bp, Homo sapiens
ggcgcgccagtccttagtaatggaaaatctctagcagtggcgcccgaacagggacttgaaagcgaaagtagaaccagagaagatctctcgacgcaggactcggcttgctgaagtgcacacggcaagaggcgagagcggcgactggtgagtacgccaaattttgactagcagaggctagaaggagagagcgactcggaccgatg

SEQ ID NO: 10085 - DNA, 203 bp, Homo sapiens
ggcgcgccagtccttcattcctgaacagggaccggaagagaaagtgaaaccagggaagaaaacctccgacgcgacgggctcggcttagcggagtgcacccgctaagaggcgagaggactcacagaggtgagtagttttgctggcggtggccagacctaggggaagggcgaagtctctaggggaggaggcgactcggaccgatg

SEQ ID NO: 10086 - DNA, 203 bp, Homo sapiens
ggcgcgccagtcctgtaaaccggaacagggacctgaaaagcgaaagtaaaagggactcgaaagcggcggttccagagaagttctctcgacgcaagactcggcttgctgagtgcacacggcaagaggcgagaagcggcgactggtgagtacgccaaattttttgactagcggaggctagaaggagagagcgactcggaccgatg

SEQ ID NO: 10087 - DNA, 203 bp, Homo sapiens
ggcgcgccagtccttctcagtcgaacagggacttgaaaagcgaaagtaaaagggactcgaaagcggaagttccagagaagttctctcgacgcaggactcggcttgctgagtgcacacagcaagaggcgaggagcggcgactggtgagtacgccaaaatttttgactagcggaggctagaaggagagagcgactcggaccgatg

SEQ ID NO: 10088 - DNA, 203 bp, Homo sapiens
ggcgcgccagtcctcgaagatggaacagggacttgaaaagcgaaagtaatagggactcgaaagcggaagttccagagaagttctctcgacgcaggactcggcttgctgaggtgcacaaagcaagaggcgagagcggcgactggtgagtacgccaaaatttttgactagcggaggctagaaggagagagcgactcggaccgatg

SEQ ID NO: 10089 - DNA, 203 bp, Homo sapiens
ggcgcgccagtccttcctcttagaacagggacttgaaagcgaaagtaatagggactcgaaaacgaaagttccagagaagaagctctcttgacgcaggactcggcttgctgaggtgcacacagcaagaggcgagagcggcgactggtgagtacgccattttttgactagcggaggctagaaggagagagcgactcggaccgatg

SEQ ID NO: 10090 - DNA, 203 bp, Homo sapiens
ggcgcgccagtccttgatggcggaacagggacttgaaagcgaaagttaaaagggactcgaaagcgaaagttccagagaagttctctcgacgcaggactcggcttgctgaggtgcacacagcaagaggcgagagcggcgactggtgagtacgccaaactttttgactagcggaggctagaaggagagagcgactcggaccgatg

SEQ ID NO: 10091 - DNA, 203 bp, Homo sapiens
ggcgcgccagtccttttgatgagaacagggacttgaaagtgaaagttaaaagggactcgaaagcggaagttccagagaagttctctcgacgcaggactcggcttgctgaggtgcacacagcaagaggcgagagcggcgactggtgagtacgccaaactttttgactagcggaggctagaaggagagagcgactcggaccgatg

SEQ ID NO: 10092 - DNA, 203 bp, Homo sapiens
ggcgcgccagtcctcacgtcaggaacagggacttgaaagtgaaagttaatagggactcgaaagcgaaagttccagagaagttctctcgacgcaggactcggcttgctgaggtgcacacagcaagaggcgagagcggcgactggtgagtacgccaaactttttgactagcggaggctagaaggagagagcgactcggaccgatg

SEQ ID NO: 10093 - DNA, 203 bp, Homo sapiens
ggcgcgccagtcctgctaagtagaagaactccgtcctgagagggaaaaaagctgatgaattagaaagaattaggttacggcccggcggaaagaaaaaatacagagtaaaacatgttgtgtgggcagcgaacgaattggacagattcggattaacagaaagcctgttggaatcaaaagagggttgccaacgactcggaccgatg

SEQ ID NO: 10094 - DNA, 203 bp, Homo sapiens
ggcgcgccagtcctagtcatctgactctggtaatactctggtaactagagatccctcagacccttgttggttgcgtggaaaatctctagcagtggcgcccgaacagggacttgaaagcgaaagtaaaaccagaggagatctctcgacgcaggactcggcttgctgaagtgcactcggcaagaggcgagcgactcggaccgatg

SEQ ID NO: 10095 - DNA, 203 bp, Homo sapiens
ggcgcgccagtcctaaatcgacgagaaactccgtcttgtcagggaagaaagcagatgaattagaaaaaattaggttacggcccaacggaaagaaaaagtacatgttgaagcatgtagtatgggcagcaaacgaattggacagatttggattagcagaaagcctgttggagaccaaagaaggttgtcaacgactcggaccgatg

SEQ ID NO: 10096 - DNA, 203 bp, Homo sapiens
ggcgcgccagtccttccgtaatgagaaactccgtcttgtcagggaagaaagcagatgaattagaaaaaattaggttacggcccaacggaaagaaaaagtatatgttgaagcatgtagtatgggcagcaaatgaattggatagatttggattagcagaaagcctgttggataacaaagaaggttgtcaacgactcggaccgatg

SEQ ID NO: 10097 - DNA, 203 bp, Homo sapiens
ggcgcgccagtcctgaggcaccgagaaactccgtcttgtcagggaagaaagcagatgaattagaaaaaattaggttacggcccggcggaaagaaaaggtacaagctgaagcatatagtatgggcagcaaatgaattggacagatttggattagcagaaagcctgttggagaacaaagaaggttgtcaacgactcggaccgatg

SEQ ID NO: 10098 - DNA, 203 bp, Homo sapiens
ggcgcgccagtccttcgagtctgagaaactccgtcttgtcagggaaggaagcagatgaattagaaaaagttaggttacggcccaacggaaagaaaaagtatatgttgaagcatgtagtatgggcagcaaatgaattggacagatttggattagcagaaagcctgttggataacaaagaaggttgtcaacgactcggaccgatg

SEQ ID NO: 10099 - DNA, 203 bp, Homo sapiens
ggcgcgccagtcctattagcgggagaggctccgtcttgtcagggaagaaaacagatgaattagaaaaagttaggttacggcccggcggaaagaaaaaatattgtctaaagcatatagtatgggcagtgaacgaattggacagatatggattagcagagagcctgttggagtcaaaagaaggatgtcaccgactcggaccgatg

SEQ ID NO: 10100 - DNA, 203 bp, Homo sapiens
ggcgcgccagtcctagatatcagagaggctccgtcttgtcagggaagaagacagatgaattagaaaaggttaggttacggcccggcggaaagaaaagatacatgctaaaacatatagtatgggcagtgaatgaattagagagatttggattggcagagagccggttgggatcaaaagaaggatgccggcgactcggaccgatg

SEQ ID NO: 10101 - DNA, 203 bp, Homo sapiens
ggcgcgccagtcctctccataggcagtggcgcccgaacagggaccggaaatatagggactcgaaagcgaaagttccagagaagatctctcgacgcaggactcggcttgctgaggtgcacgcagcaagaggcgagagcggcgactggtgagtacgccaattttgactagcggaggctagaaggagagagcgactcggaccgatg

SEQ ID NO: 10102 - DNA, 203 bp, Homo sapiens
ggcgcgccagtcctttggttgcgcccgaacagggacgttcggactgagagacagggagcgtggcccctggacgcaggactcggcttgtgacagcgcaatcacaagaggcgaggcggactccggtggtgagtactaatttgttgtcggtgggcaaccctagaggaaggacgaagtctctaggtcaggggcgactcggaccgatg

SEQ ID NO: 10103 - DNA, 203 bp, Homo sapiens
ggcgcgccagtcctcgaacttagcccgtctgttatttgactctggtaactagagatccctcagaccactatagactgtgtaaaaatctctagcagtggcgcccgaacagggactcgaaagcgaaagttccagagaagttctctcgacgcaggactcggcttgctgaggtgcacacagcaagaggcgagcgactcggaccgatg

SEQ ID NO: 10104 - DNA, 203 bp, Homo sapiens
ggcgcgccagtcctgatacttggcccgtctgttgtgtgactctggtaactagagatccctcagaccactctagaaggtgtaaaaatctctagcagtggcgcccgaacagggactcgaaagcgaaagttccagaggagttctctcgacgcaggactcggcttgctgaggtgcacacagcaagaggcgagcgactcggaccgatg

SEQ ID NO: 10105 - DNA, 203 bp, Homo sapiens
ggcgcgccagtccttttctgcagcccgtctgttgtgtgactctggtaactagagatccctcagaccactctaggcggtgtaaaaatctctagcagtggcgcccgaacagggacttgaaagcgaaagttccagagaagttctctcgacgcagggctcggcttgctgaggtgcacacagcaagaggcgagcgactcggaccgatg

SEQ ID NO: 10106 - DNA, 203 bp, Homo sapiens
ggcgcgccagtcctattagaaaggaaaatctctagcagtggcgcccgaacagggacttgaaagcgaaagtagaaccagagaagatctctcgacgcaggactcggcttgctgaagtgcacacggcaagaggcgagagcggcgactggtgagtacgccaatttttgactagcggaggctagaaggagaggcgactcggaccgatg

SEQ ID NO: 10107 - DNA, 203 bp, Homo sapiens
ggcgcgccagtcctaaactaggggacagattcggattaacagagagcctgttggagtcaaaagaaggttgccaaaaaattatttcagttttagaaccattagtaccaacagggtcagaaaatttaaaaagcctttataatactacctgcgtcatttggtgcttgcacgcagaagagaaagtgaaagatcgactcggaccgatg

SEQ ID NO: 10108 - DNA, 203 bp, Homo sapiens
ggcgcgccagtcctgacccaacggacagatttggattagcagaaagcctgttggagaccaaagacggttgtcaaagaattctttcagttttagctccattagttccgacaggttcagaaaatttaaagagcctttataatactgtctgcgtcatttggtgcttgcacgcagaagagaaagtgagacatcgactcggaccgatg

SEQ ID NO: 10109 - DNA, 203 bp, Homo sapiens
ggcgcgccagtcctatctcaatggacagatttggattggcagaaagcctgttggagtcaaaagaagggtgtcaaaaaattataacggtcttagaaccattagtgccaacaggttcagaaaatttaaagagtctttttaatactgtctgcgtcatttggtgtatccacgcagaagagaaagtgaaacatcgactcggaccgatg

SEQ ID NO: 10110 - DNA, 203 bp, Homo sapiens
ggcgcgccagtcctgacgataaggatagatttggattggcagaaagcctgttggaaagtaaagaaggctgtcaaaaaatactttcggttttagctccattagtgccaacaggttcagaaaatttaaagagcctttataatactgtctgcgtcatttggtgcttgcacgcagaagagaaagtgaaacatcgactcggaccgatg

SEQ ID NO: 10111 - DNA, 203 bp, Homo sapiens
ggcgcgccagtcctcgttacccggcgcccgaacagggacttggagttaatagggactcgaaagcgaaagtgccagagaagatctctcgacgcagggactcggcttgctgaagtgcacacagcaagaggcgagagcggcgactggtgagtacgccaaaattttgactagcggaggctagaaggagagagcgactcggaccgatg

SEQ ID NO: 10112 - DNA, 203 bp, Homo sapiens
ggcgcgccagtccttgtattccgggacttgaaagtgaaagtaaaaccggaggctgaatctctcgacgcacggactcggcttgctgagtgcacgcagcaagaggcgaggcggcgactcaagtggtgagtacgcaattttgctagcggtggctagacctagaggaagggcgaagtctctagggggagaagcgactcggaccgatg

SEQ ID NO: 10113 - DNA, 203 bp, Homo sapiens
ggcgcgccagtcctgtcgggagggtaactagagatccctcagaccactctaaatagtgtaaaatctctagcagtggcgcccgaacagggacttgaaagcgaaagtaacagggactcgaaagcgaaagttccagagaagttctctcgacgcaggactcggcttgctgggtgcacacagcaagaggcgagcgactcggaccgatg

SEQ ID NO: 10114 - DNA, 203 bp, Homo sapiens
ggcgcgccagtcctcgaaaggagtaaaaatctctagcagtggcgcccgaacagggactcgaaagcgaaagtgttccagagaagttctctcgacgcaggactcggcttgctgaggtgcacacagcaagaggcgagagcggcgactggtgagtacgccttttttgactagcggaggctagaaggagagagcgactcggaccgatg

SEQ ID NO: 10115 - DNA, 203 bp, Homo sapiens
ggcgcgccagtcctagaggtccgtaactagagatccctcagaccactctaggtagtgtaaaaatctctagcagtggcgcccgaacagggacttgaaagcgaaagtaaaagggactcgaaagcggaagttccagagaagttctcttgacgcaggactcggcttgctgagtgcacacagcaagaggcgagcgactcggaccgatg

SEQ ID NO: 10116 - DNA, 203 bp, Homo sapiens
ggcgcgccagtcctggcgcattgtaactagagatccctcagaccattttggtagtgtggaaaatctctagcagtggcgcccgaacagggacttgaaagcgaaagtaatagggactcgaaagcgaaagttccagagaagttctctcgacgcaggactcggcttgctgaagtgcactcggcagaggcgagcgactcggaccgatg

SEQ ID NO: 10117 - DNA, 203 bp, Homo sapiens
ggcgcgccagtcctcgttgtgtgtctggtatttgactctggtaactagagatccctcagacccctttagtcagtgtggaaaatctctagcagtggcgcccgaacagggacccgaaagcgaaagtagaaccagaggagatctctcgacgcaggactcggcttgctgaagcgcgcacagcaagaggcgagcgactcggaccgatg

SEQ ID NO: 10118 - DNA, 203 bp, Homo sapiens
ggcgcgccagtcctgaattaatgtctgttgtgtgactctggtaactagagacccctcagacccttttagccagtgtggaaaatctctagcagtggcgcccgaacagggactagaaagcgaaagtagaaccagaggagctctctcgacgcaggactcggcttgctgaagcgcgcacggcaagaggcgagcgactcggaccgatg

SEQ ID NO: 10119 - DNA, 203 bp, Homo sapiens
ggcgcgccagtcctccgtccgcgtctgttgtgtgactctggtaactagagatccctcagaacattttagtccgggtggaaaatctctagcagtggcgcccgaacagggacgcgaaagcgaaagtagaaccagagaagatctctcgacgcaggactcggcttgctgaagtgcacacggcaagaggcgagcgactcggaccgatg

SEQ ID NO: 10120 - DNA, 203 bp, Homo sapiens
ggcgcgccagtcctcgacggcagtctgttgtgtgactctggtaactagagatccctcagaacctattagtcagtgtggaaaatctctagcagtggcgcccgaacagggacctgaaagcgaaagtgagaccagaggagctctctcgacgcaggactcggcttgctgaagcgcgcacagcaagaggcgagcgactcggaccgatg

SEQ ID NO: 10121 - DNA, 203 bp, Homo sapiens
ggcgcgccagtcctgggttgcggtctgttgtgtgactctggtaactagagatccctcagacacattttgtccgtgtggaaaatctctagcagtggcgcccgaacagggacttgaaagcgaaagtaagaccagaggagatctctcgacgcaggactcggcttgctgaagtgcactcggcaagaggcgagcgactcggaccgatg

SEQ ID NO: 10122 - DNA, 203 bp, Homo sapiens
ggcgcgccagtcctgctagtatgtctgttgtgtgactctggtaactagagatccctcagacacttgtagtcagtgtggaaaatctctagcagtggcgcccgaacagggacttgaaagcgacagtagaaccagaggagctctctcgacacaggactcggcttgctgaagcgcgcacggcaagaggcgagcgactcggaccgatg

SEQ ID NO: 10123 - DNA, 203 bp, Homo sapiens
ggcgcgccagtcctaagcctcggtctgttgtgtgactctggtaactagagatccctcagacatttgtagtcagtgtggaaaatctctagcagtggcgcccgaacagggacttgaaaacgaaagtagaaccagaggagatctctcgacgcaggactcggcttgctgaagcgcgcacagcaagaggcgagcgactcggaccgatg

SEQ ID NO: 10124 - DNA, 203 bp, Homo sapiens
ggcgcgccagtcctagggagtcgtctgttgtgtgactctggtaactagagatccctcagaccaactttggtagtgtggaaaatctctagcagtggcgcccgaacagggacttgaaagcgaaagtaagaccagagaagatctctcgacgcaggactcggcttgctgaagtgcactcggcaagaggcgagcgactcggaccgatg

SEQ ID NO: 10125 - DNA, 203 bp, Homo sapiens
ggcgcgccagtcctgttggcatgtctgttgtgtgactctggtaactagagatccctcagaccaatttagtcagggtggaaaatctctagcagtggcgcccgaacagggaccggaaagcgaaagtaaaaccagaggagatctctcgacgcaggactcggcttgctgaagtgcgcacagcaagaggcgagcgactcggaccgatg

SEQ ID NO: 10126 - DNA, 203 bp, Homo sapiens
ggcgcgccagtcctacacgaccgtctgttgtgtgactctggtaactagagatccctcagaccaatttagtccgtgtggaaaatctctagcagtggcgcccgaacagggacttgaaagcgaaagtagaaccagaggagctctctcgacgcaggactcggcttgctgaagtgcgcacggcaagaggcgagcgactcggaccgatg

SEQ ID NO: 10127 - DNA, 203 bp, Homo sapiens
ggcgcgccagtcctcttaccgtgtctgttgtgtgactctggtaactagagatccctcagaccatcttagtcagtgtggaaaatctctagcagtggcgcccgaacagggacctgaaagcgaaagtagaaccagagcagatctctcgacgcaggactcggcttgctgaagtgcacacggcaagaggcgagcgactcggaccgatg

SEQ ID NO: 10128 - DNA, 203 bp, Homo sapiens
ggcgcgccagtccttgagataagtctgttgtgtgactctggtaactagagatccctcagaccattcgtggtagtgtggaaaatctctagcagtggcgcccgaacagggacttgaaagtgaaagtaagaccagaggaaatctctcgacgcaggactcggcttgctgaagtgcactcggcaagaggcgagcgactcggaccgatg

SEQ ID NO: 10129 - DNA, 203 bp, Homo sapiens
ggcgcgccagtcctaccatcaagtctgttgtgtgactctggtaactagagatccctcagaccatttagtcagtgtggaaaatctctagcagtggcgcccgaacagggacttgaaagcgaaagcagaaccagaggagatctctcgacgcaggactcggcttgctgaaagtgcacgcggcaagaggcgagcgactcggaccgatg

SEQ ID NO: 10130 - DNA, 203 bp, Homo sapiens
ggcgcgccagtcctggagactagtctgttgtgtgactctggtaactagagatccctcagaccattttagtcagtgtggaaaatctctagcagtggcgcccgaacagggaccagaaagcgaaagtagaaccagaggagatctctcgacgcaggactcggcttgctgaagcgcgcacagcaagaggcgagcgactcggaccgatg

SEQ ID NO: 10131 - DNA, 203 bp, Homo sapiens
ggcgcgccagtcctagcccagagtctgttgtgtgactctggtaactagagatccctcagaccattttagtcagtgtggaaaatctctagcagtggcgcccgaacagggacgcgaaagcgaaagtagaaccagaggagatctctcgacgcaggactcggcttgctgaggtgcacacagcaagaggcgagcgactcggaccgatg

SEQ ID NO: 10132 - DNA, 203 bp, Homo sapiens
ggcgcgccagtcctgaaaccctgtctgttgtgtgactctggtaactagagatccctcagacccctttagtcagtgtggaaaatctctagcagtggcgcccgaacagggacttgaaagtgaaagtgagaccagaggagctctctcgacgcaggactcggcttgctgaagcgcgcacagcaagaggcgagcgactcggaccgatg

SEQ ID NO: 10133 - DNA, 203 bp, Homo sapiens
ggcgcgccagtcctaagtgctcgtctgttgtgtgactctggtaactagagatccctcagacccttaaagtcaatgtggaaaatctctagcagtggcgcccgaacagggacttgaaagtgaaagtaaaaccagagaagctctcttgacgcaggactcggcttgctgaagcgcgcacggcaagaggcgagcgactcggaccgatg

SEQ ID NO: 10134 - DNA, 203 bp, Homo sapiens
ggcgcgccagtcctacggattagtctgttgtgtgactctggtaactagagatccctcagacccttgtagtcagtgtggaaaatctctagcagtggcgcccgaacagggacctgaaagcgaaagagaaaccagaggagctctctcgacgcaggactcggcttgctgaagcgcgcacagcaagaggcgagcgactcggaccgatg

SEQ ID NO: 10135 - DNA, 203 bp, Homo sapiens
ggcgcgccagtcctcgatgcgcgtctgttgtgtgactctggtaactagagatccctcagacccttttagtcagtgtggaaaatctctagcagtggcgcccgaacagggacccgaaagcgaaagtagaaccaggggagctctctcgacgcaggactcggcttgctgaaacgcgcgcggcaagaggcgagcgactcggaccgatg

SEQ ID NO: 10136 - DNA, 203 bp, Homo sapiens
ggcgcgccagtcctccttatctgtctgttgtgtgactctggtaactagagatccctcagacccttttagtcagtgtggaaaatctctagcagtggcgcccgaacagggacttgaaagcgaaagagaaaccggagaagatctctcgacgcaggactcggcttgctgaagcgcgcacggcaagaggcgagcgactcggaccgatg

SEQ ID NO: 10137 - DNA, 203 bp, Homo sapiens
ggcgcgccagtcctatccgcgtgtctgttgtgtgactctggtaactagagatccctcagacccttttagtcagtgtggaaaatctctagcagtggcgcccgaacagggacttgaaagcgaaaggaaaaccagaggagctctctcgacgcaggactcggcttgctgaagcgcgcacggcaagaggcgagcgactcggaccgatg

SEQ ID NO: 10138 - DNA, 203 bp, Homo sapiens
ggcgcgccagtcctcacgctgggtctgttgtgtgactctggtaactagagatccctcagacccttttagtcagtgtggaaaatctctagcagtggcgcccgaacagggacttgaaagcgaaagtgagaccagaggagctctctcgacgcagggctcggcttgctgaagcgtgcgcagcaagaggcgagcgactcggaccgatg

SEQ ID NO: 10139 - DNA, 203 bp, Homo sapiens
ggcgcgccagtcctcgtcagtagtctgttgtgtgactctggtaactagagatccctcagacccttttagtcagtgtggaaaatctctagcagtggcgcccgaacagggacttgaaagtgaaagtaagaccagaggagctctctcgacgcaggactcggcttgctgaagcgcgcacagcaagaggcgagcgactcggaccgatg

SEQ ID NO: 10140 - DNA, 203 bp, Homo sapiens
ggcgcgccagtcctcatcccacgtctgttgtgtgactctggtaactagagatccctcagacccttttagtcagtgtggagaatctctagcagtggcgcccgaacagggacttgaaagcgaaagagaaaccagaggagctctctcgacgcaggactcggcttgctgaaacgcgcgcggcaagaggcgagcgactcggaccgatg

SEQ ID NO: 10141 - DNA, 203 bp, Homo sapiens
ggcgcgccagtcctgtattcacgtctgttgtgtgactctggtaactagagatccctcagacccttttagtccgtgtggaaaatctctagcagtggcgcccgaacagggacccgaaagcgaaagtagaaccagaggagctctctcgacgcaggactcggcttgctgaagcgcgcgcggcaagaggcgagcgactcggaccgatg

SEQ ID NO: 10142 - DNA, 203 bp, Homo sapiens
ggcgcgccagtcctagaccctggtctgttgtgtgactctggtaactagagatccctcagaccctttttggtagtgtggaaaatctctagcagtggcgcccgaacagggacttgaaagcgaaagtaagaccagagcagatctctcgacgcaggactcggcttgctgaagtgcactcggcaagaggcgagcgactcggaccgatg

SEQ ID NO: 10143 - DNA, 203 bp, Homo sapiens
ggcgcgccagtcctagtcgagggtctgttgtgtgactctggtaactagagatccctcagacctcggtagtcagtgtagaaaatctctagcagtggcgcccgaacagggacctgaaagcgaaagtagaaccagaggagctctctcgacgcaggactcggcttgctgaagcgtgcacggcaagaggcgagcgactcggaccgatg

SEQ ID NO: 10144 - DNA, 203 bp, Homo sapiens
ggcgcgccagtcctgcaattccgtctgttgtgtgactctggtaactagagatccctcagacctctttagtcagtgtggaaaatctctagcagtggcgcccgaacagggacctgaaaagcgaaagtaaaaccagagaagctctctcgacgcaggactcggcttgctgagcgcgcacggcaagaggcgagcgactcggaccgatg

SEQ ID NO: 10145 - DNA, 203 bp, Homo sapiens
ggcgcgccagtccttgaccattgtctgttgtgtgactctggtaactagagatccctcagacctctttagtcagtgtggaaaatctctagcagtggcgcccgaacagggacttgaaagcgaaagtaaaaccagagaagatctctcgacgcaggactcggcttgctgaagcgcgcacagcaagaggcgagcgactcggaccgatg

SEQ ID NO: 10146 - DNA, 203 bp, Homo sapiens
ggcgcgccagtcctgcttgagggtctgttgtgtgactctggtaactagagatccctcagactcttttagtcagtgtggaaaatctctagcagtggcgcccgaacagggacttgaaagcgaaagggaaaccagaggagctctctcgacgcaggactcggcttgctgaagcgcgcacggcaagaggcgagcgactcggaccgatg

SEQ ID NO: 10147 - DNA, 203 bp, Homo sapiens
ggcgcgccagtcctgttcgcgagtctgttgtgtgactctggtagctagagatccctcagaccatcctagttagtgtagaaaatctctagcagtggcgcccgaacagggaccggaaagcgaaagagaaaccagaggagatctctcgacgcaggactcggcttgctgaagcgcgcacagcaagaggcgagcgactcggaccgatg

SEQ ID NO: 10148 - DNA, 203 bp, Homo sapiens
ggcgcgccagtcctccaaccaggtctgttgtgtgactctggtagctagagatccctcagatccttttagttagcgtagaaaatctctagcagtggcgcccgaacagggacgcgaaagcgaaagtagaaccagagaagatctctcgacgcaggactcggcttgctgaagcgcgcacggcaagaggcgagcgactcggaccgatg

SEQ ID NO: 10149 - DNA, 203 bp, Homo sapiens
ggcgcgccagtcctaggccaaggtctgttgtgtgactctggtagctagagatccctcatacccttttagtcagtgtggaaaatctctagcagtggcgcccgaacagggaccggaaagcgaaagagaaaccagaggagctctctcgacgcaggactcggcttgctgaagcgcgcacggcaagaggcgagcgactcggaccgatg

SEQ ID NO: 10150 - DNA, 203 bp, Homo sapiens
ggcgcgccagtcctctgtcagtgtctgttgtgtgactctggtatctagagatccctcagaccctattagtcagtgtggaaaatctctagcagtggcgcccgaacagggacctaaaagcgaaagtaaaaccagaggagatctctcgacgcaggactcggcttgctgaagcgcgcacggcaagaggcgagcgactcggaccgatg

SEQ ID NO: 10151 - DNA, 203 bp, Homo sapiens
ggcgcgccagtcctgtctacttgtctgttgtgtggctctggtaactagagatccctcagacccttgttggtagtgcggaaaatctctagcagtggcgcccgaacagggacctgaaagcgaaagtaagaccagaggagatctctcgacgcagggctcggcttgctgaagtgcactcggcaagaggcgagcgactcggaccgatg

SEQ ID NO: 10152 - DNA, 203 bp, Homo sapiens
ggcgcgccagtcctaagaggatgtctgttgtgtggctctggtaactagagatccctcagacccttgttggtattgtggcaaatctctagcagtggcgcccgaacagggacttgaaaacgaaagtagaaccagaggagatctcccgacgcaggactcggcttgctgaagtgcactcggcaagaggcgagcgactcggaccgatg

SEQ ID NO: 10153 - DNA, 203 bp, Homo sapiens
ggcgcgccagtcctgagtacctgtctgttgtttgactctggtaactagagatccctcagaccattttagtcagtgtggaaaatctctagcagtggcgcccgaacagggacctgaaagcgaaagtgagaccagagaagctctcttgacgcagtactcggcttgctgaagcgcgcacagcaagaggcgagcgactcggaccgatg

SEQ ID NO: 10154 - DNA, 203 bp, Homo sapiens
ggcgcgccagtcctggtagattgtctgttgtttgactctggtaactagagatccctcagaccattttagtcagtgtggaaaatctctagcagtggcgcccgaacagggacttgaaagcgaaagtagaaccagagaagatctctcgacgcaggactcggcttgctgaagtgcacacggcaagaggcgagcgactcggaccgatg

SEQ ID NO: 10155 - DNA, 203 bp, Homo sapiens
ggcgcgccagtcctcggccgttgtctgttttgtgactctggtaactagagatccctcagacaccttttgtcagtgtggaaaatctctagcagtggcgcccgaacagggacttgaaagcgaaagtagaaccagagaagatctctcgacgcagggctcggcttgctgaagtgcactcggcaagaggcgagcgactcggaccgatg

SEQ ID NO: 10156 - DNA, 203 bp, Homo sapiens
ggcgcgccagtcctgttatccagtgactctggtaactctggtaactagagatccctcagaccctttgtggtagtgtggaaaatctctagcagtggcgcccgaacagggacttgaaagcgaaagtgagaccagagaagatctctcgacgcaggactcggcttgctgaagtgcactcggcaagaggcgagcgactcggaccgatg

SEQ ID NO: 10157 - DNA, 203 bp, Homo sapiens
ggcgcgccagtcctccaggctagtggcgcccgaacagggaccggaagttaatagggacgcgaaagcgaaagttccagagaagtatctcgacgcacggactcggcttgctgaggtgcacacagcaagaggcgagagcggcgactggtgagtacgccaatttttgactagcggaggctagaaggagagagcgactcggaccgatg

SEQ ID NO: 10158 - DNA, 203 bp, Homo sapiens
ggcgcgccagtcctcgtggaaggtggcgcccgaacagggacttgaaagtaatagggactcgaaagcgaaagttccagagaagttctctcgacgcagggactcggcttgctgagtgcacacggcaagaggcgagcgcggcgactggtgagtacgccaaattttgactagcggaggctagaaggagagagcgactcggaccgatg

SEQ ID NO: 10159 - DNA, 203 bp, Homo sapiens
ggcgcgccagtcctctcagctggtgtgcccatctcattccgcgccggccctggggtagagatccctcagatctctgaaggctaagcaaaaatctctaccagtggcgcccgaacagggacttgagaagcaggggacgcggaacccttgacgccaggactcggcttgtgctgcgcaacacaagaggcgagcgactcggaccgatg

SEQ ID NO: 10160 - DNA, 203 bp, Homo sapiens
ggcgcgccagtcctgagtaaacgtgtgcccatttcataccgcgtctgccctggggtagagatccctcagatttgtagtggctaagtaaaaatctctaccagtggcgcccgaacagggacttgagaagcagggaacgcggcccctggacgcaggactcggcttgtgacagcgcaatcacaagaggcgagcgactcggaccgatg

SEQ ID NO: 10161 - DNA, 203 bp, Homo sapiens
ggcgcgccagtcctctgatattgtgtgcccatttcatatcgcgtttgccctggggtagagatccctcagatttgtagtggctaagtaaaaatctctaccagtggcgcccgaacagggacttgaggagcagggaacgcgacccctggacgcaggactcggcttgtgacagcgcaatcacaagaggcgagcgactcggaccgatg

SEQ ID NO: 10162 - DNA, 203 bp, Homo sapiens
ggcgcgccagtcctggcggctctaacagggacttgtaagcggaagttaacggggactcgaaagcgaaagttccagagaagttctctcgacgcaggactcggcttgctgaagtgcacacagcaagaggcgagagcggcgactggtgagtacgccaaactttttgactagcggaggctagaaggagagagcgactcggaccgatg

SEQ ID NO: 10163 - DNA, 203 bp, Homo sapiens
ggcgcgccagtcctgtagaggctaactagagatccctcagaccattctaggcagagtaaaaatctctagcagtggcgcccgaacagggacctgaaaagcgaaagtaaaagggactcgaaagcggcggttccagagaagttctctcgacgcaagactcggcttgctgagtgcacacggcaagaggcgagcgactcggaccgatg

SEQ ID NO: 10164 - DNA, 203 bp, Homo sapiens
ggcgcgccagtcctctaaatgttactagagatccctcagaccactctagactgtgtaaaaatctctagcagtggcgcccgaacagggactcgaaagcgaaagttaatagggactcgaaagcggaagttccagagaagttctctcgacgcaggactcggcttgctgaggtgcacacagcaagaggcgagcgactcggaccgatg

SEQ ID NO: 10165 - DNA, 203 bp, Homo sapiens
ggcgcgccagtcctctgctccttagacagaataaaaatctctagcagtggcgcccgaacagggacttgaaaacgaaagttaacagggacttgtaagcggaagttaacggggactcgaaagcgaaagttccagagaagttctctcgacgcaggactcggcttgctgaagtgcacacagcaagaggcgagcgactcggaccgatg

SEQ ID NO: 10166 - DNA, 203 bp, Homo sapiens
ggcgcgccagtccttagctctgtagcagtggcgcccgaacagggacccgaaagcgaaagtagaaccagaggagatctctcgacgcaggactcggcttgctgaagcgcgcacggcaagaggcgaggggcggcgactggtgagtacgccaaaagaaaaatttttgactagcggaggctagaaggagagagcgactcggaccgatg

SEQ ID NO: 10167 - DNA, 203 bp, Homo sapiens
ggcgcgccagtcctccagtggttagcagtggcgcccgaacagggacctgaaagcgaaagtagaaccagagaagatctctcgacgcaggactcggcttgctgaaagcgcgctcggcaagaggcgaggggcggcggactggtgagtacgccaaaaataaattttgactagcggaggctagaaggagagagcgactcggaccgatg

SEQ ID NO: 10168 - DNA, 203 bp, Homo sapiens
ggcgcgccagtccttatccatgtagcagtggcgcccgaacagggacttgaaaacgaaagtagaaccagaggagatctctcgacgcaggactcggcttgctgaagcgcgcacagcaagaggcgaggggaggcgactggtgagtacgccaaaaataaaatttttgactagcggaggctagaaggagagagcgactcggaccgatg

SEQ ID NO: 10169 - DNA, 203 bp, Homo sapiens
ggcgcgccagtcctggaacgcctatccttcagtgactctggtaactagagatccctcagaactcttaaaagtaggtgaaaatctctagcagtggcgcccgaacagggacttgaaaacgaaagtacaaccagaggctgaaacttccgacgcgggactcggctcgctgagtgcacacagcgagaggcgagcgactcggaccgatg

SEQ ID NO: 10170 - DNA, 203 bp, Homo sapiens
ggcgcgccagtccttacaggcatccattcggtaactctggtacctagagatccctcagaccacttgggctgagtagaaaatctctagcagtggcgcccgaacagggacttgaaaacgaaagtagaaccggaggctgaaatctctcgacgcaggactcggctcgttgggtgcacacagcgagaggcgagcgactcggaccgatg

SEQ ID NO: 10171 - DNA, 203 bp, Homo sapiens
ggcgcgccagtccttggttcaatctagcagtggcgcccgaacagggacttgaagaaagtaaaaccagaggagatctctcgacgcaggactcggcttgctgaagaagaagcgcgcgcggcaagaggcgaggggcggcgactggtgagtacgcctaaaaattttgactagcggaggctagaaggagagagcgactcggaccgatg

SEQ ID NO: 10172 - DNA, 203 bp, Homo sapiens
ggcgcgccagtcctaccttacgtctctagcagtggcgcccgaacagggacccgaaagcgaaagtaagaccagagaagatctctcgacgcaggactcggcttgctgaagtgcactcggcaagaggcgaggggcggcggctggtgagtacgccaaattttatttgactagcggaggctagaaggagagagcgactcggaccgatg

SEQ ID NO: 10173 - DNA, 203 bp, Homo sapiens
ggcgcgccagtcctgcgaggagtctctagcagtggcgcccgaacagggacccgaaagcgaaagtagaaccagagaagatctctcgacgcaggactcggcttgctgaagtgcactcggcaagaggcgagagcggcggctggtgagtacgccaaatttttatttgactagcggaggctagaaggagagagcgactcggaccgatg

SEQ ID NO: 10174 - DNA, 203 bp, Homo sapiens
ggcgcgccagtcctgcacaggatctctagcagtggcgcccgaacagggacctgaaagcgaaagtaagaccggaggagatctctcgacgcaggactcggcttgctgaagtgcactcggcaagaggcgaaaggggcggctggtgagtacgccaaatttttatttgactagcggaggctaaaaggagagagcgactcggaccgatg

SEQ ID NO: 10175 - DNA, 203 bp, Homo sapiens
ggcgcgccagtcctgggtccgatctctagcagtggcgcccgaacagggacctgaaagcgaaagtgagaccagaggagctctctcgacgcaggactcggcttgctgaagcgcgcacagcaagaggcgagagcggcgactggtgagtacgccaaaaaattttgtgactagcggaggctagaaggagagagcgactcggaccgatg

SEQ ID NO: 10176 - DNA, 203 bp, Homo sapiens
ggcgcgccagtcctatcggtattctctagcagtggcgcccgaacagggacttgaaaacgaaagtaagaccagagaagaactctcgacgcaggactcggcttgctgaagtgcactcggcaagaggcgaggggaggcgactggtgagtacgccaaattttatttgactagcggaggctagaaggagagagcgactcggaccgatg

SEQ ID NO: 10177 - DNA, 203 bp, Homo sapiens
ggcgcgccagtcctgtaactgctctctagcagtggcgcccgaacagggacttgaaagcgaaagtaaaaccagaggagatctctcgacgcaggactcggcttgctgaagtgcactcggcgagaggcgagagcggcggctggtgagtacgccaaattttattttgactagcggaggctagaaggagagagcgactcggaccgatg

SEQ ID NO: 10178 - DNA, 203 bp, Homo sapiens
ggcgcgccagtcctgatcgccgtctctagcagtggcgcccgaacagggacttgaaagtgaaagtagaaccagaggagctctctcgacgcaggactcggcttgctgaagcgcgcacggcaagaggcgaggggcggcgaccggtgagtacgccaaaaaatttttgactagcggaggctagaaggagagagcgactcggaccgatg

SEQ ID NO: 10179 - DNA, 203 bp, Homo sapiens
ggcgcgccagtcctccacaccatctctcgcagtggcgcccgaacagggacttgaaagcgaaagtagaaccagaggagctctcccgacgcaggacttggcttgctgaagcgcgcacagcaagaggcgaggggtagcgactggtgagtacgctaaaaattttttgactagcagaggctagaaggggaaagcgactcggaccgatg

SEQ ID NO: 10180 - DNA, 203 bp, Homo sapiens
ggcgcgccagtcctggtatagctctggtaactagagatccctcagaccactttagactgtgtaaaaatctctagcagtggcgcccgaacagggacttgaagttaatagggactcgaaagcgaaagttccagagaagatctctcgacgcacggactcggcttgctgaggtgcacacagcaagaggcgagcgactcggaccgatg

SEQ ID NO: 10181 - DNA, 203 bp, Homo sapiens
ggcgcgccagtcctgatcttattctggtaactagagatccctcagaccactttagattgagtaaaaatctctagcagtggcgcccgaacagggacctgaagttaatagggactcgaaagcgaaagttccagagaagatctctcgacgcgaggactcggcttgctgaggtgcacacagcaagaggcgagcgactcggaccgatg

SEQ ID NO: 10182 - DNA, 203 bp, Homo sapiens
ggcgcgccagtccttaatccagtctggtaactagagatccctcagaccattctagacggtgtaaaaatctctagcagtggcgcccgaacagggaccggaagttaatagggactcgaaaacgaaagttccagagaagatctctcgacgcacggactcggcttgctgaggtgcacacagcaagaggcgagcgactcggaccgatg

SEQ ID NO: 10183 - DNA, 203 bp, Homo sapiens
ggcgcgccagtcctgactaatatctggtaactagagatccctcagaccattttagcttgagtagaaatctctagcagtggcgcccgaacagggacttgaagttaatagggactcgaaagcgaaagttccagagaagctctcttgacgcagagactcggcttgctgaggtgcacacagcaagaggcgagcgactcggaccgatg

SEQ ID NO: 10184 - DNA, 203 bp, Homo sapiens
ggcgcgccagtccttttcgtcctctggtaactagagatccctcagacctttgtagtcactgtagaaaatctctagcagtggcgcccgaacagggacttgaaagtaatagggactcgaaagcgaaagttccagagaagttctctcgacgcagggactcggcttgctgagtgcacacggcaagaggcgagcgactcggaccgatg

SEQ ID NO: 10185 - DNA, 203 bp, Homo sapiens
ggcgcgccagtcctacgccgactctggtaactagagatccctcagactactttagtcagtgtaaaaatctctagcagtggcgcccgaacagggaccggaagttaatagggactcgaaagcgaaagttccagagaagatctctcgacgcacggactcggcttgctgaggtgcacacagcaagaggcgagcgactcggaccgatg

SEQ ID NO: 10186 - DNA, 203 bp, Homo sapiens
ggcgcgccagtcctctcaattatctgttcaaccctggtatctagagatccctcagatcacgtagactgaggcagaaaatctctagcagtggcgcccgaacagggacttgaaaaggaaagtgaaaccagggaagaaaacctccgacgcaacgggctcggcttagcggagtgcacccgctaagaggcgagcgactcggaccgatg

SEQ ID NO: 10187 - DNA, 203 bp, Homo sapiens
ggcgcgccagtccttagtttcttctgttcaaccctggtatctagagatccctcagatcacttagactgaagcagaaaatctctagcagtggcgcccgaacagggacttgaaagcgaaagtggaaccagggaagaaaacctccgacgcaacgggctcggcttagcagagtgcacctgctaagaggcgagcgactcggaccgatg

SEQ ID NO: 10188 - DNA, 203 bp, Homo sapiens
ggcgcgccagtcctggccaaattctgttcaaccctggtgtctagagatccctcagatcacatagactgaagcagaaaatctctagcagtggcgcccgaacagggacttgaaagagaaagtgaaaccagggaagaaaacctccgacgcaacgggctcggcttagcggagtgcacccgctgagaggcgagcgactcggaccgatg

SEQ ID NO: 10189 - DNA, 203 bp, Homo sapiens
ggcgcgccagtcctgtgtcgtctctgttgtgtgactctggtaaactagagatccctcagacctctttagtcagtgtggaaaatctctagcagtggcgcccgaacagggacttgaaagcgaaagtagaaccagaggagctctctcgacgcaggactcggcttgctgaagcgcgcacagcaagaggcgagcgactcggaccgatg

SEQ ID NO: 10190 - DNA, 203 bp, Homo sapiens
ggcgcgccagtcctcttgacagtctgttgtgtgactctggtaactagagatccctcagaccattttagtcagagtgtaaaatctctagcagtggcgcccgaacagggacgcgaaaagcgaaaataaaaccagagaagatctctcgacgcaggactcggcttgctgaagtgcacacggcaagaggcgagcgactcggaccgatg

SEQ ID NO: 10191 - DNA, 203 bp, Homo sapiens
ggcgcgccagtcctcgagtaactctgttgtgtgactctggtaactagagatccctcagaccattttagtcagtgtggaaaatctctagcagtggcgcccgaacagggacctgaaagcgaaagtagaaccagaggagctctctcgacgcaggactcggcttgctgaaagcgcgcgcagcaagaggcgagcgactcggaccgatg

SEQ ID NO: 10192 - DNA, 203 bp, Homo sapiens
ggcgcgccagtcctgtcaaatgtctgttgtgtgactctggtaactagagatccctcagaccattttagtcagtgtggaaaatctctagcagtggcgcccgaacagggacgcgaaagcgaaagtagaaccagaggagatctctcgacgcaggactcggcttgctgaaagcgcgctcggcaagaggcgagcgactcggaccgatg

SEQ ID NO: 10193 - DNA, 203 bp, Homo sapiens
ggcgcgccagtccttacgcccttctgttgtgtgactctggtaactagagatccctcagaccattttagtcagtgtggaaaatctctagcagtggcgcccgaacagggacgctgaaagcgaaagtagaaccagaggagatctctcgacgcaggactcggcttgctgaagtgcacacggcaagaggcgagcgactcggaccgatg

SEQ ID NO: 10194 - DNA, 203 bp, Homo sapiens
ggcgcgccagtcctgcgcaacgtctgttgtgtgactctggtaactagagatccctcagacccttttagtcagtgtggaaaaatctctagcagtggcgcccgaacagggacgcgaaagcgaaagtagaaccagaggagctctctcgacgcaggactcggcttgctgaagcgcgcacagcaagaggcgagcgactcggaccgatg

SEQ ID NO: 10195 - DNA, 203 bp, Homo sapiens
ggcgcgccagtccttacggagttctgttttgtgactctggtaactagagatccctcagacagctttagtccgggtggaaaatctctagcagtggcgcccgaacagggacctgaaagcgaaagtagaaccagaggagatctctcgacgcaggactcggcttgctgaaagcgcgctcggcaagaggcgagcgactcggaccgatg

SEQ ID NO: 10196 - DNA, 203 bp, Homo sapiens
ggcgcgccagtcctgtgcagagtgctcatctgttcaaccctggtatctagagatccctcagatcacgtagactgaagcagaaaatctctagcagtggcgcccgaacagggacttgaaagtgaaaccagggaagaaaacctccgacgcaacgggctcggcttagcggagtgcacccgctaagaggcgagcgactcggaccgatg

SEQ ID NO: 10197 - DNA, 203 bp, Homo sapiens
ggcgcgccagtcctatacatgatggcgcccgaacagggaccggaagttaatagggactcgaaagcgaaagttccagagaagatctctcgacgcacggactcggcttgctgaggtgcacacagcaagaggcgagagcggcgactggtgagtacgccaatttttgactagcggaggctagaaggagagagcgactcggaccgatg

SEQ ID NO: 10198 - DNA, 203 bp, Homo sapiens
ggcgcgccagtccttattgtgctggcgcccgaacagggacctgaaattaatagggactcgaaagcgaaagttccagagaagttctctcgacgcaaggactcggcttgctgaggtgcacgcagcaagaggcgagagcggcgactggtgagtacgccaatttttgactagcggaggctagaaggagagagcgactcggaccgatg

SEQ ID NO: 10199 - DNA, 203 bp, Homo sapiens
ggcgcgccagtccttagggcaatggcgcccgaacagggacttgaagttaatagggactcgaaagcgaaagttccagagaagctctcttgacgcagagactcggcttgctgaggtgcacacagcaagaggcgagagcggcgactggtgagtacgccaaattttgactagcggaggctagaaggagagagcgactcggaccgatg

SEQ ID NO: 10200 - DNA, 203 bp, Homo sapiens
ggcgcgccagtccttccaattttggcgcccgaacagggacttgagaagcagggaacgcggcccctggacgcaggactcggcttgtgacagcgcaatcacaagaggcgaggcggactccggtggtgagtacaaattttgttgtcggtgggcaaccctagaggaagggcgaagtctctaggtaacaggggcgactcggaccgatg

SEQ ID NO: 10201 - DNA, 203 bp, Homo sapiens
ggcgcgccagtcctcattgacttggtaactagagatccctcagacctttttggttgtgtggaaaatctctagcagtggaaaatctctagcagtggcgcccgaacagggacttgaaagcgaaagtaagaccagaggagatctctcgacgcaggactcggcttgctgaagtgcactcggcaaggggcgagcgactcggaccgatg

SEQ ID NO: 10202 - DNA, 203 bp, Homo sapiens
ggcgcgccagtccttgaggccttgttatgtgactctggtaactagagatccctcagacccttttagtcagtgtggaaaatctctagcagtggcgcccgaacagggacttgaagaaagtaaaaccagaggagatctctcgacgcaggactcggcttgctgaagaagaagcgcgcgcggcaagaggcgagcgactcggaccgatg

SEQ ID NO: 10203 - DNA, 203 bp, Homo sapiens
ggcgcgccagtcctgaccatgtttgagtgctttaagtagtgtgtgcccgtctgttgtgtgactctggtaactagagatccctcagaccttcttagtcagtgtggaaaatctctagcagtggcgcccgaacaggggagctctctcgacgcaggactcggcttgctgaagcgcgcacagcaagaggcgagcgactcggaccgatg

SEQ ID NO: 10204 - DNA, 203 bp, Homo sapiens
ggcgcgccagtcctgagcgtaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagccgactcggaccgatg

SEQ ID NO: 10205 - DNA, 203 bp, Homo sapiens
ggcgcgccagtcctgtgaataacttctcctcctgcagccgggagcggcctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaacgactcggaccgatg

SEQ ID NO: 10206 - DNA, 203 bp, Homo sapiens
ggcgcgccagtcctcagaagaagggagcaggagagagaggacaagcggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcgactcggaccgatg

SEQ ID NO: 10207 - DNA, 203 bp, Homo sapiens
ggcgcgccagtccttggtataagggagcaggagagagaggacaagtggatccaacagccttcgctccaggggaatcagggcatcacctccttttctgggaggacactcccttctgatggtgaatgggaactcccttcctcctgcagcagcctgcctgcagctgtcctggtagaacagtgtggacattgcgactcggaccgatg

SEQ ID NO: 10208 - DNA, 203 bp, Homo sapiens
ggcgcgccagtcctggtcagaagggagcaggagagagaggacaagtggatccaacagccttcgctctaggggaatcagggcatcgcctccttttctgggaggacactcccttctgatggtgaatgggaactcccttcctcctgcagcagcctgcctgcagctgtcctggtagaacagtgtggacattgcgactcggaccgatg

SEQ ID NO: 10209 - DNA, 203 bp, Homo sapiens
ggcgcgccagtcctgccgtcaagtgacaaccatagctcttaggggactcccctaaagccttcatccttctgggtgtgtctgacaggccgtggctggaactccctctctttgtggtcctcctgctgtcctatgtgctggccatgttggggaacgtcgccatcatcctggcatcccgggtggatcctcaacgactcggaccgatg

SEQ ID NO: 10210 - DNA, 203 bp, Homo sapiens
ggcgcgccagtcctgtcgctaagtgacaaccatagctcttaggggattcccctaaagccttcatccttctgggtgtgtctgacaggccgtggctggaactccctctctttgtggtcctcctgctgtcctatgtgctggccatgttggggaacgtcgccatcatcctggcatcccgggtggatcctcaacgactcggaccgatg

SEQ ID NO: 10211 - DNA, 203 bp, Homo sapiens
ggcgcgccagtcctccgaccaatcggcttactccgcggagttggcctcatttctgcacagagtcggcgctccctgtagtttctcctctcgaacgccaggtggagcaaccggccggataccgccacagccctggcaggcggcgctgtgatgcctgagctgatcctgtatgttgcaatcactctatccgtcgactcggaccgatg

SEQ ID NO: 10212 - DNA, 203 bp, Homo sapiens
ggcgcgccagtcctgcacccacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgacccgactcggaccgatg

SEQ ID NO: 10213 - DNA, 203 bp, Homo sapiens
ggcgcgccagtcctacctcgacagccacacgccccaaggcctccaagatgagctacacattggactcgctgggcaacccgtccgcctaccggcgggtaaccgagacccgctcgagcttcagccgcgtcagcggctccccgtccagtggcttccgctcgcagtcgtggtcccgcggctcgcccagcacccgactcggaccgatg

SEQ ID NO: 10214 - DNA, 203 bp, Homo sapiens
ggcgcgccagtccttgcgttacagccacacgccccaaggcctccaagatgagctacacgttggactggctgggcaacccgtccgcctaccggcgggtaaccgagacccgctcgagcttcagccgcgtcagcggctccccgtccagtggcttccgctcgcagtcgtggtcccgcggctcgcccagcacccgactcggaccgatg

SEQ ID NO: 10215 - DNA, 203 bp, Homo sapiens
ggcgcgccagtcctcgcccgacagccacacgccccaaggcctccaagatgagctacacgttggattcgctgggcaacccgtccgcctaccggcgggtaaccgagacccgctcgagcttcagccgcgtcagcggctccccgtccagtggcttccgctcgcagtcgtggtcccgcggctcgcccagcacccgactcggaccgatg

SEQ ID NO: 10216 - DNA, 203 bp, Homo sapiens
ggcgcgccagtcctaaggaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagactgtttcaatgcatcaaagctactgacatctcatggccgactcggaccgatg

SEQ ID NO: 10217 - DNA, 203 bp, Homo sapiens
ggcgcgccagtccttccttaacccagccagggcaccacgctgcccggccctgcgccgccaggcacttctttccggggctcctagggacgccagaaggaagccaacctctgctgcttctccttggcctgcgttggaccttcctttttttgttgtttttttttgtttttcccctttcttccttttgaattcgactcggaccgatg

SEQ ID NO: 10218 - DNA, 203 bp, Homo sapiens
ggcgcgccagtcctgactacacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattcgactcggaccgatg

SEQ ID NO: 10219 - DNA, 203 bp, Homo sapiens
ggcgcgccagtcctccgcatacccctaccccatccccttattcagcacatgaaataaacaaggggcatccaaatcttgcagcaacgcccccgggacatgcatcgtcccctggactctctcaaaccccttatccctctggacagaatgcaggtccaaccacgctggtataccctcaaacccctcagacacgactcggaccgatg

SEQ ID NO: 10220 - DNA, 203 bp, Homo sapiens
ggcgcgccagtcctctcagtacctcaatacaagcccactctttcacatatttgaacttttttcacatatcaactttttttgttcactgcgcagggattgttcattgctgctggaggaagatcatggactgtcgcgggaaactgaagtggttgagtatccactagtcgtggatgagggcagtgacttcgcgactcggaccgatg

SEQ ID NO: 10221 - DNA, 203 bp, Homo sapiens
ggcgcgccagtccttactgtacctcaatacaagcccactctttcacatgtttgaacttttttcacatatcaactttttttgttcactgtgcagggattgttcattgctgctggaggaagatcatggactgtcgcgggaaactgaagtggttgagtatccactagtcgtggatgagggcagtgacttcgcgactcggaccgatg

SEQ ID NO: 10222 - DNA, 203 bp, Homo sapiens
ggcgcgccagtccttgggcaacgccggccaagacagcccagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgcgactcggaccgatg

SEQ ID NO: 10223 - DNA, 203 bp, Homo sapiens
ggcgcgccagtcctactgagagacagaacttaacctctgcaagcaagattcgtggaagatagtctccactttttaatgcactaagcaatcggttgctaggagcccatcctgggtcagaggccgatccgcagaaccagaacgttttcccctcctgaactgttagtaacttagtctccctcctcccctaacgactcggaccgatg

SEQ ID NO: 10224 - DNA, 203 bp, Homo sapiens
ggcgcgccagtcctcacttgagataactggacaattttttaagtcggaggctgttcttactggtgtgaggatttacacacgtcttcagtttttcagcacagaccagcagaccatcatttttagaggaaatactccctctgccctcctttttggtttccttggtgggctcaactaaaaaactgaatgggcgactcggaccgatg

SEQ ID NO: 10225 - DNA, 203 bp, Homo sapiens
ggcgcgccagtccttcagctagcaccgcgtgttcgcgcctggtagagatttctcgaagacaccagtgggcccgttccgagccctctggaccgcccgtgtggaaccaaacctgcgcgcgtggccgggccgtgggacaacgaggccgcggagactgtttcaatgcatcaaagctactgacatctcatggccgactcggaccgatg

SEQ ID NO: 10226 - DNA, 203 bp, Homo sapiens
ggcgcgccagtcctatcctaagcgcgggcagcggagcgggcgccaggccggccgggcaggatgcgctaccgggcgtcggccctgggcagtgacggggttcgagtgaccatggagagtgcgctcaccgcccgtgaccgggtgggggtgcaggatttcgtgctgctggagaacttcaccagcgaggccgccgactcggaccgatg

SEQ ID NO: 10227 - DNA, 203 bp, Homo sapiens
ggcgcgccagtcctgacacaagcgcgggcagcggagcgggcgccaggccggccgggcaggatgcgctaccgggcgtcggccctgggcagtgacggggttcgggtgaccatggagagtgcgctcaccgcccgtgaccgagtgggggtgcaggatttcgtgctgctggagaacttcaccagcgaggccgccgactcggaccgatg

SEQ ID NO: 10228 - DNA, 203 bp, Homo sapiens
ggcgcgccagtccttaacaaagcgcgggcagcggagcgggcgccaggccggccgggcaggatgcgctaccgggcgtcggccctgggcagtgacggggttcgggtgaccatggagagtgcgctcaccgcccgtgaccgggtggggatgcaggatttcgtgctgctggagaacttcaccagcgaggccgccgactcggaccgatg

SEQ ID NO: 10229 - DNA, 203 bp, Homo sapiens
ggcgcgccagtcctaattggagctcagtgccagaggaggggattcccggcgccgggggacagagcccctttttttttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 10230 - DNA, 203 bp, Homo sapiens
ggcgcgccagtcctcatgcgagctcagtgccagaggaggggattcccggcgccgggggacagagcccctttttttttttgccgaaagaccctttctgctggggagcctcttgtgtccagcctaggcccgcgtgcagcgccgacggatgatcgtcttcttggcaagaaagtgaataaacttaattgagacgactcggaccgatg

SEQ ID NO: 10231 - DNA, 203 bp, Homo sapiens
ggcgcgccagtcctgttatgagctcagtgccagaggaggggattcctggcgccgggggacagagcccctttttttttttgccgaaagaccctttctgctggggagcctcttgtgtccagcctaggcccgcgtgcagcgccgacggatgatcgtcttcttggcaagaaagtgaataaacttaattgagacgactcggaccgatg

SEQ ID NO: 10232 - DNA, 203 bp, Homo sapiens
ggcgcgccagtccttaaacgaggaagaccagctcggccgagtcctcgtcagcggaatcaggctcaggttctgaggaagaagaggaggaggaggaagaggaggaggaggaagggagcaccagtgaagaatcagaggaggaagaggaagaggaggaggaggagaccggcagcaactctgaggaggcatcacgactcggaccgatg

SEQ ID NO: 10233 - DNA, 203 bp, Homo sapiens
ggcgcgccagtcctaataccagtccatttgacacaacacctttgatctttgacagtttccttggttttaggtgctagatgatttctcaggctcaccttagacatttcctgccacagacttagaatcagccatttctctaaggaccctgattccatttcatgagaaatgatagagaccacaatcaaaaccgactcggaccgatg

SEQ ID NO: 10234 - DNA, 203 bp, Homo sapiens
ggcgcgccagtcctccgaccagtgacaaccatagcttcttaggggacccccctaaagccttcatccttctgggtgtgtctgacaggccgtggctggaactccctctctttgtggtcctcctgctgtcctatgtgctggccatgttggggaacgtcgccatcatcctggcatcccgggtggatcctcaacgactcggaccgatg

SEQ ID NO: 10235 - DNA, 203 bp, Homo sapiens
ggcgcgccagtcctgaagtaagtgacaaccatagcttcttaggggactaccctaaagccttcatccttctgggtgtgtctgacaggccgtggctggaactccctctctttgtggtcctcctgctgtcctatgtgctggccatgttggggaacgtcgccatcatcctggcatcccgggtggatcctcaacgactcggaccgatg

SEQ ID NO: 10236 - DNA, 203 bp, Homo sapiens
ggcgcgccagtcctacaacaagtgacaaccatagcttcttaggggactcccctaaagccttcatccttctgggtgtgtctgacaggccgtggctggaactccctctctttgtggtcctcctgctgtcctatgtgctggccatgttggggagcgtcgccatcatcctggcatcccgggtggatcctcaacgactcggaccgatg

SEQ ID NO: 10237 - DNA, 203 bp, Homo sapiens
ggcgcgccagtcctcgcaacagtgcattcgagtaaatttaatttccaggcagcttaatacattctttttagccgtgttacttgtaatgtgtatgccctgctttcactcagtgtgtacagggaaacgcacctgattttttacttattagtttgttttttctttaacctttcagcatcacagaggaagtacgactcggaccgatg

SEQ ID NO: 10238 - DNA, 203 bp, Homo sapiens
ggcgcgccagtcctatgtacataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgaacagccaccacgactcggaccgatg

SEQ ID NO: 10239 - DNA, 203 bp, Homo sapiens
ggcgcgccagtcctggctggataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 10240 - DNA, 203 bp, Homo sapiens
ggcgcgccagtcctaggacgataccagtgtcagctgcacttgtaggggcccaagtgcctcatgacctactcggcagccttcctctccaggatccccaaggctaggaggccaacctactaacaggtgggtgggtatggtgtgtggtttcactcagttcttctcatggggtttctctgagctccattcatcgactcggaccgatg

SEQ ID NO: 10241 - DNA, 203 bp, Homo sapiens
ggcgcgccagtcctcgcccgatacttgatcctaaattcctgtacttcctcaggccatccgagcatgaaacgctgtcacctacccacatccgctggctgtgacgcttgtcagagtgttctctatcggctgcatgcctagaccaccaaagcgttctgaccggacagtgtcactggagaaggcggcgcgaccgactcggaccgatg

SEQ ID NO: 10242 - DNA, 203 bp, Homo sapiens
ggcgcgccagtcctaaggaaatcccaaacgcggtacagaccaaaccgcagcccacgttacggatcggcttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10243 - DNA, 203 bp, Homo sapiens
ggcgcgccagtcctgcaaggatcccaaacgcggtacagaccaaaccgcagtccacgttacgaatcggcttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10244 - DNA, 203 bp, Homo sapiens
ggcgcgccagtcctatcaagatcccaaacgcggtacagaccaaaccgcagtccacgttacggatcggcttactccgcggagttggcctcatttctgcacagagtcggcgctccctgtagtttctcctctcgaacgccaggtggagcaaccggccggataccgccacagccctggcaagaggcgctgtgcgactcggaccgatg

SEQ ID NO: 10245 - DNA, 203 bp, Homo sapiens
ggcgcgccagtcctgactacatcccaaacgcggtacagaccaaaccgcagtccacgttacggatcggtttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10246 - DNA, 203 bp, Homo sapiens
ggcgcgccagtcctccgcatatcccaaacgcggtacagaccaaaccgcagtccgcgttacggatcggcttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10247 - DNA, 203 bp, Homo sapiens
ggcgcgccagtcctcagctcatcccaaacgcggtacagaccaaaccgcagtccgcgttacggatcggtttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10248 - DNA, 203 bp, Homo sapiens
ggcgcgccagtcctcggtgaatgcggatggattatggtcgtcagaggctcccgtagtcttcagcggcgctggcttccgcaggctccgccctctcttgcccacccggaaacagcctcgccccgcctacgcgggacccaaccgcggcgaccggacgtgcactcctccagtagcggctgcacgtcgtgccacgactcggaccgatg

SEQ ID NO: 10249 - DNA, 203 bp, Homo sapiens
ggcgcgccagtcctgtccgcatgcggatggattgtggtcgtcagaggctcccgtagtcttcagcggcgctggcttccgcaggctccgccctctcttgcccacccggaaacagcctcgccccgcctacgcgggacccaaccgcggcgaccggacgtgcactcctccagtagcggctgcacgtcgtgccacgactcggaccgatg

SEQ ID NO: 10250 - DNA, 203 bp, Homo sapiens
ggcgcgccagtcctactcttcaactgaaaccgcgggaggagaaagcgcggaatcaggaactggccggggtccgcaccgggcctgagtgggtccgaggccgtcccaggagcagctgcccgtgcggaacagcactatgggcttctcttctgagctgtgcagcccccagggccacggggtcctgcagcaaacgactcggaccgatg

SEQ ID NO: 10251 - DNA, 203 bp, Homo sapiens
ggcgcgccagtcctcacttgcaactgaaaccgcgggaggaggaagcgcggaatcaggaactggccggggtccgcaccgggcctgagtgggtccgaggccgtcccaggagcagctgcccgtgcggaacagcactatgggcttctcttccgagctgtgcagcccccagggccacggggtcctgcagaaaacgactcggaccgatg

SEQ ID NO: 10252 - DNA, 203 bp, Homo sapiens
ggcgcgccagtccttcatgccaagtcaataagactgtggtgagagagttcgtcgtcctcagcttctcatccctggccaggctgcagcagctgctctttgttatcttcctgctcctctacctgttcactctgggcaccaatgcaatcatcatttccaccattgtgctggacagagcccttcatactccccgactcggaccgatg

SEQ ID NO: 10253 - DNA, 203 bp, Homo sapiens
ggcgcgccagtccttaacaacaagtcaataagactgtggtgagagagtttgtcgtcctcggcttctcatccctggccaggctgcagcagctgctctttgttatcttcctgctcctctacctgttcactctgggcaccaatgcaatcatcatttccaccattgtgctggacagagcccttcatactccccgactcggaccgatg

SEQ ID NO: 10254 - DNA, 203 bp, Homo sapiens
ggcgcgccagtcctcgtaggcacagtgcctccggaggaaatctgctcagtccccggcagccgccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 10255 - DNA, 203 bp, Homo sapiens
ggcgcgccagtcctcgtctacaccagaatcaagtgttccgcgtgattgaagacaccccctcgtccaagaatgcaaagcacatccaataaaatagctggattataactcctcttctttctctgggggccgtggggtgggagctggggtgagaggtgccgttggcccccgttgcttttcctctgggaaggcgactcggaccgatg

SEQ ID NO: 10256 - DNA, 203 bp, Homo sapiens
ggcgcgccagtccttaaacgcagaccgtcgcagctacagggggcctcgagccccggggtgagcgtccccgtcccgctcctgctccttcccatagggacgcgcctgatgcctaggaccggccgctgagcccaaggggaccgaggaggccatggtaggagcgctcgcctgctgcggtgcccgctgaggcccgactcggaccgatg

SEQ ID NO: 10257 - DNA, 203 bp, Homo sapiens
ggcgcgccagtcctgcgtagcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacacgactcggaccgatg

SEQ ID NO: 10258 - DNA, 203 bp, Homo sapiens
ggcgcgccagtcctgccgtccatggtaacaggttccagggtaacagaggagggagctgggtcctgtttactcccagtcctgccgatgaggattctgaccgtagaaactgaattgtcccgtacctatccgtgctctttctgtgttctcaccagggctgagctcgaactgccacctctgccagcaggacccgactcggaccgatg

SEQ ID NO: 10259 - DNA, 203 bp, Homo sapiens
ggcgcgccagtcctttcggacatggtaacaggttccagggtaacagaggagggagctgggtcctgtttactcccagtcctgccgatgaggattctgaccgtagacactgaattgtcccgtacctatccgtgctctttctgtgttctcaccagggctgagctcaaactgccacctctgccagcaggacccgactcggaccgatg

SEQ ID NO: 10260 - DNA, 203 bp, Homo sapiens
ggcgcgccagtcctcacggccatggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 10261 - DNA, 203 bp, Homo sapiens
ggcgcgccagtcctgtcgctcatggtaacaggttccagggtaacagaggagggagctgggtcctgtttactcccagtcctgccgatgaggattctgaccgtagacactgaattgtcccgtacctatccgtgctctttgtgtgttctcaccagggctgagctcgaactgccacctctgccagcaggacccgactcggaccgatg

SEQ ID NO: 10262 - DNA, 203 bp, Homo sapiens
ggcgcgccagtcctccgacccatggtaacaggttccagggtaacagaggagggagctgggtcctgtttactcccagtcctgccgatgaggattctgaccgtagacactgaattgtcccgtacctatccgtgttctttctgtgttctcaccagggctgagctcgaactgccacctctgccagcaggacccgactcggaccgatg

SEQ ID NO: 10263 - DNA, 203 bp, Homo sapiens
ggcgcgccagtcctagccatccaaggacagcccaagaactggtctagcctggcagccttttccctcgggtagtagaggctgcccctctgacagggagtttgtggtcagcaagtgggcccttgggggtcttgggctgtcacagggactccagaaagccatgcagagccttgtgccatgaaggacttctccgactcggaccgatg

SEQ ID NO: 10264 - DNA, 203 bp, Homo sapiens
ggcgcgccagtccttcccagccaaggacagcccaagaactggtctagcctggcagccttttccctcgggtagtagaggctgcccctttgacagggagtttgtggtcagcgagtgggcccttgggggtcttgggctgtcacaggaactccagaaagccatgcagagccttgtgccatgaaggacttctccgactcggaccgatg

SEQ ID NO: 10265 - DNA, 203 bp, Homo sapiens
ggcgcgccagtcctcgcccgccatcacccctaaatgtattccaaagaataagaacattgttttatacatagcacacttaacaaaatcaagaaatttaacattaatacagtactgttacctaatccgtagtcgattttcaaattttgtcagttgttccaataatgtcctttatatattccccgcccagccgactcggaccgatg

SEQ ID NO: 10266 - DNA, 203 bp, Homo sapiens
ggcgcgccagtcctgcaaggccatgagaagcgaccacccctcgacaacttctccttcacggttcccacccaggagcacggccaactctcccccggaatccataacggctcacgcaaatagatttctttccgttcctcctcggagggctctccacatttatctgctcgagacgtggcagctccagaacccgactcggaccgatg

SEQ ID NO: 10267 - DNA, 203 bp, Homo sapiens
ggcgcgccagtcctatcaagccatgagaagcgaccacccctcgacgacttctccttcacggttcccacccaggagcacggccaactctcccccggaatccataacggctcacgcaaatagatttctttccgttcctcctcggagggctctccacatttatctgctcgagacgtggcagctccagaacccgactcggaccgatg

SEQ ID NO: 10268 - DNA, 203 bp, Homo sapiens
ggcgcgccagtccttccttaccatgagaagcgaccacccctcgacgacttctccttcacggttcccatccaggagcacggccaactctcccccggaatccataacggctcacgcaaatagatttctttccgttcctcctcggagggctctccacatttatctgctcgagacgtggcagctccagaacccgactcggaccgatg

SEQ ID NO: 10269 - DNA, 203 bp, Homo sapiens
ggcgcgccagtcctcagctcccatgagaagcgaccacccctcgacgacttctccttcatggttcccacccaggagcacggccaactctcccccggaatccataacggctcacgcaaatagatttctttccgttcctcctcggagggctctccacatttatctgctcaagacgtggcagctccagaacccgactcggaccgatg

SEQ ID NO: 10270 - DNA, 203 bp, Homo sapiens
ggcgcgccagtccttactgtcccaggcctcgctggaccacggacccgccaggttctcccgcaacttgcggagctcctggaacggcccttcccagaggcgcagcgctgagtcccaggagcaggacctgaaccaggaaggggaggggcgagcacagtcctgcctcctcctccccgcacagtgctgggggacgactcggaccgatg

SEQ ID NO: 10271 - DNA, 203 bp, Homo sapiens
ggcgcgccagtcctcttccccccaggcctcgctggaccacggacccgccaggttctcccgcaacttgcggagctcctggaccggcccttcccagaggcacagcgctgagtcccaggagcaggacctgaaccaggaaggggaggggcgagcacagtcctgcctcctcctccccgcacagtgctgggggacgactcggaccgatg

SEQ ID NO: 10272 - DNA, 203 bp, Homo sapiens
ggcgcgccagtccttcggaccccaggcctcgctggaccacggacccgccaggttctcccgcaacttgcggagctcctggaccggcccttcccagaggcgcagcgctgagtcccaggagcaggacctgaaccaggaaggggaggggcgagcacagtcctgcctcttcctccccgcacagtgctgggggacgactcggaccgatg

SEQ ID NO: 10273 - DNA, 203 bp, Homo sapiens
ggcgcgccagtcctaccagcccctgagcaaagagtcacagataaaacaggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagaccgactcggaccgatg

SEQ ID NO: 10274 - DNA, 203 bp, Homo sapiens
ggcgcgccagtcctagcgccccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagaccgactcggaccgatg

SEQ ID NO: 10275 - DNA, 203 bp, Homo sapiens
ggcgcgccagtcctttcaccccgccgggctcagtcccagtgacccccctggtcggggttcgcgcgccctcccccagcacgaccgggcaaggctgccgcggcgtcggagtaatccccaaccctccgccgccgcttcttccctcacccgggcctccagacgtttgccgcggaaacgaaagtaacgctcggcgactcggaccgatg

SEQ ID NO: 10276 - DNA, 203 bp, Homo sapiens
ggcgcgccagtcctactgagccgccgggctcagtcccagtgacccccctggtcggggttcgcgcgccctcccccagcacgcccgggcaaggctgccgcggcgtcggagtaatccccaaccctccgccgccgcttcttccctcatccgggcctccagacgtttgccgcggaaacgaaagtaacgctcggcgactcggaccgatg

SEQ ID NO: 10277 - DNA, 203 bp, Homo sapiens
ggcgcgccagtcctactcttccgccgggctcagtcccggtgacccccctggtcggggttcgcgcgccctcccccagcacgaccgggcaaggctgccgcggcgtcggagtaatccccaaccctccgccgccgcttcttccctcatccgggcctccagacgtttgccgcggaaacgaaagtaacgctcggcgactcggaccgatg

SEQ ID NO: 10278 - DNA, 203 bp, Homo sapiens
ggcgcgccagtccttcagctccgccgggctcagtcccggtgacccccctggtcggggttcgcgcgccctcccccagcacgcccgggcaaggctgccgcggcgtcggagtaatccccaaccctccgccgccgcttcttccctcatccgggcctccagacgtttgccgcggaaacgaaagtaacgctcggcgactcggaccgatg

SEQ ID NO: 10279 - DNA, 203 bp, Homo sapiens
ggcgcgccagtcctgacacaccggcttccccgccccatttggtgggggctggcccttggccctccaactcctttaccctacatgcctgagaagccagggaccaagatggatcttctcctcgacatcagctaagcctggaggactcttcccctcagagaccatggagagggacagccacgggaatgtatcgactcggaccgatg

SEQ ID NO: 10280 - DNA, 203 bp, Homo sapiens
ggcgcgccagtcctatacctccggcttccccgccccatttggtgggggctggcccttggccctccaactcctttaccctacatgcctgagaagccaggggccaagatggatcttctcctcgacatcagctaagcctggaggactcttcccctcagagaccatggagagggacagccacgggaatgtatcgactcggaccgatg

SEQ ID NO: 10281 - DNA, 203 bp, Homo sapiens
ggcgcgccagtcctgagcgtccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgctctggcccagctgcccatgtccgactcggaccgatg

SEQ ID NO: 10282 - DNA, 203 bp, Homo sapiens
ggcgcgccagtcctcatgcgccgttccccaacttcctcggcgctccggactcccaagtctccgccggaccctcctttggatattcctcgtgtctccgattctgagacagagggggaagacggtggggcctacccacctgccccgcagaagatgcagttctttggccgcctggtcaataccttcagtggcgactcggaccgatg

SEQ ID NO: 10283 - DNA, 203 bp, Homo sapiens
ggcgcgccagtcctcgtctaccgttctccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgactcggaccgatg

SEQ ID NO: 10284 - DNA, 203 bp, Homo sapiens
ggcgcgccagtcctggtcagcctgtgaaagatctcacttgttcaaaagtccaagtgtgaattactgtctcacagacaaaccaaagtattttgaaaaacaaaggggagaaaagaaattactccccagaactctcaggcatctagaggacacccaagaacgtgggagtcagctgcttcttgtgtgcagcccgactcggaccgatg

SEQ ID NO: 10285 - DNA, 203 bp, Homo sapiens
ggcgcgccagtcctttcggacctgtgaaagatctcacttgttcaaaagtccaagtgtgaattactgtctcacagataaaccaaagtattttgaaaaacaaaggggagaaaagaaattactccccagaactctcaggcatctagaggacacccaagaacctgggagtcagctgcttcttgtgtgcagcccgactcggaccgatg

SEQ ID NO: 10286 - DNA, 203 bp, Homo sapiens
ggcgcgccagtcctccaattcgaaactttgcccatagcagcgggcgggcactttgcactggaacttacaacacccgagcaaggacgcgactctcccgacgtggggaggctattctgcccatttggggacacttccccgccgctgccaggacccgcttctctgaaaggctctccttgcagctgcttagacgactcggaccgatg

SEQ ID NO: 10287 - DNA, 203 bp, Homo sapiens
ggcgcgccagtcctcattatcgcactaagcaaactgctcggaagtctactggtggcaaggcgccacgcaaacagttagccactaaggcagcccgcaaaagcgctccggccaccggcggcgtgaaaaagccccaccgctaccggccgggcaccgtggctctgcgcgagatccgccgttatcagaagtcccgactcggaccgatg

SEQ ID NO: 10288 - DNA, 203 bp, Homo sapiens
ggcgcgccagtcctaaacgccgcactaagcaaactgctcggaagtctactggtggcaaggcgccacgcaaacagttggcgactaaggcagcccgcaaaagcgctccggccaccggcggcgtgaaaaagccccaccgctaccggccgggcaccgtggctctgcgcgagatccgccgttatcagaagtcccgactcggaccgatg

SEQ ID NO: 10289 - DNA, 203 bp, Homo sapiens
ggcgcgccagtcctaaggaacgcgctcctagagctcgggccgtggctcgtcggggtctgtgtcttttggctccgagggcagtcgctgggcttccgagaggggttggggctgcgtaggggcgctttgttttgttcggttttgtttttttgagagtgcgagagaggcggtcgtgcagacccgggagaaagcgactcggaccgatg

SEQ ID NO: 10290 - DNA, 203 bp, Homo sapiens
ggcgcgccagtcctgactaccgctggtcagcgccaagtgacttacgcccccgaccctgagccgggaccgctaggcgaggaggatcagatctccgctcgagaatctgaaggtgccctggtcctggaggagttccgtcccagcccgcggtctcccgggccgccctcctgaccggccggctcccggttcggcgactcggaccgatg

SEQ ID NO: 10291 - DNA, 203 bp, Homo sapiens
ggcgcgccagtccttactgtcggagtgtcagctctccatctgtctctgcctggcaggcgcacgcgcccagcaccctgcctccagcgatgccgccccagcccctctgatggccctcctctctgctgccactcattccagaacaggaggcatgagcccggaacgcgcttgcttttaggagacagccacttcgactcggaccgatg

SEQ ID NO: 10292 - DNA, 203 bp, Homo sapiens
ggcgcgccagtcctatcctacgtactaaacagacagctcggaaatccaccggcggtaaagcgccacgcaagcagctggctaccaaagctgctcgcaagagcgcgccggctaccggcggcgtgaaaaagcctcaccgttaccgcccgggcactgtggctctgcgcgagatccgccgctaccaaaagtcgcgactcggaccgatg

SEQ ID NO: 10293 - DNA, 203 bp, Homo sapiens
ggcgcgccagtcctgacacacgtactaaacagacagctcggaaatccaccggcggtaaagcgccacgcaagcagctggctaccaaggctgctcgcaagagcgcgccggctaccggcggcgtgaaaaaacctcaccgttaccgcccgggcactgtggctctgcgcgagatccgccgctaccaaaagtcgcgactcggaccgatg

SEQ ID NO: 10294 - DNA, 203 bp, Homo sapiens
ggcgcgccagtcctgagcgtcgtactaaacagacagctcggaaatccaccggtggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgcgactcggaccgatg

SEQ ID NO: 10295 - DNA, 203 bp, Homo sapiens
ggcgcgccagtcctcaaagacgtactaaacagacagctcggaaatccactggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgcgactcggaccgatg

SEQ ID NO: 10296 - DNA, 203 bp, Homo sapiens
ggcgcgccagtcctcatgcgcgtccctggagcgatcagggctcaggagcccgacccggagcccggggcgtccgcgctgacttcgggtccccggagcctggggcacggcagcgagaagacgacggcggagaaggcgacagcggagaaggaaggcaggctgcaggggcgccgtcggcgcagcgggccgggcgactcggaccgatg

SEQ ID NO: 10297 - DNA, 203 bp, Homo sapiens
ggcgcgccagtcctattgtccgtccctggagcgatcagggctcaggagcccgacccggagcccggggcgtccgcgctgacttcgggtccccggagcctggggcacggcaggaagaagacgacggcggagaaggcgacagcggagaaggcaggcaggctgcaggggcgccgtcggcgcggcgggccgggcgactcggaccgatg

SEQ ID NO: 10298 - DNA, 203 bp, Homo sapiens
ggcgcgccagtcctgcgtagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgtgcggccccgaggaggacgactcggaccgatg

SEQ ID NO: 10299 - DNA, 203 bp, Homo sapiens
ggcgcgccagtccttggtatcgttcgggggcggggcctgctccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgacgactcggaccgatg

SEQ ID NO: 10300 - DNA, 203 bp, Homo sapiens
ggcgcgccagtcctagaggactaaagggaaaaaggaagaatgcaacaaaactgaagtatgttctgccacgttcctgaactgcagccataggagccctcccagccctacccaaaccagcctactccctctcaagagctcacagctgcaggactagagccagatgtgccccagcaataaggacttcttcccgactcggaccgatg

SEQ ID NO: 10301 - DNA, 203 bp, Homo sapiens
ggcgcgccagtcctaataccctactgccttctccgaccgtccgtcctcggggcaggcgtgctctcttccctgagcttttaggggttggcttttccagttccagatcagctacagcaaacatcgttcgagatgtcccaccaagagggcagcacaggtggcttaccagacttagtgactgaaagcctgttcgactcggaccgatg

SEQ ID NO: 10302 - DNA, 203 bp, Homo sapiens
ggcgcgccagtcctgaagtactcaataagtctgcttccaccttccagcttactggcttcccaggcatggagaaggcacatcactggatattcatcccattattggcagcctacatctccatacttcttggcaatggcactcttctctttctcatcagaaatgatcataacctccatgagcccatgtaccgactcggaccgatg

SEQ ID NO: 10303 - DNA, 203 bp, Homo sapiens
ggcgcgccagtcctacaacactcaataagtctgcttccaccttccagcttactggcttcccaggcatggagaaggcacatcactggatattcatcccattattggcagcctacatctccatacttcttggcagtggcactcttctctttctcatcaggaatgatcataacctccatgagcccatgtaccgactcggaccgatg

SEQ ID NO: 10304 - DNA, 203 bp, Homo sapiens
ggcgcgccagtcctagccatctcaatacgtctgcttccaccttccagcttactggcttcccaggcatggagaaggcacatcactggatattcatcccattattggcagcctacatctccatacttcttggcaatggcactcttctctttctcatcaggaatgatcataacctccatgagcccatgtaccgactcggaccgatg

SEQ ID NO: 10305 - DNA, 203 bp, Homo sapiens
ggcgcgccagtccttatttcctcaatacgtctgcttccaccttccagcttactggcttcccaggcatggagaaggcacatcactggatattcatcccattattggcagcctacatctccatacttcttggcagtggcactcttctctttctcatcaggaatgatcataacctccatgagcccatgtaccgactcggaccgatg

SEQ ID NO: 10306 - DNA, 203 bp, Homo sapiens
ggcgcgccagtccttcccagctcatccttctactcgtgacacttcccagttctgcctttgtgaaagcaaagatgagcaacactcaagctgagaggtccataataggcatgatcgacatgtttcacaaatacaccggacgtgatggcaagattgagaagccaagcctgctgacgatgatgaaggagaaccgactcggaccgatg

SEQ ID NO: 10307 - DNA, 203 bp, Homo sapiens
ggcgcgccagtcctacgggtctcatccttctactcgtgacacttcccagttctgcctttttgaaagcaaagatgagcaacagtcaagctgagaggtccataataggcatgatcgacatgtttcacaaatacaccggacgtgatggcaagattgagaagccaagcctgctgacgatgatgaaggagaaccgactcggaccgatg

SEQ ID NO: 10308 - DNA, 203 bp, Homo sapiens
ggcgcgccagtcctgctactctcatccttctactcgtgacacttcccagttctgcgtttttgaaagcaaagatgagcaacactcaagctgagaggtccataataggcatgatcgacatgtttcacaaatacaccggacgtgatggcaagattgagaagccaagcctgctgacgatgatgaaggagaaccgactcggaccgatg

SEQ ID NO: 10309 - DNA, 203 bp, Homo sapiens
ggcgcgccagtcctaaacgcctcatccttctactcgtgacacttcccagttctggctttgtgaaagcaaagatgagcaacactcaagctgagaggtccataataggcatgatcgacatgtttcacaaatacaccggacgtgatggcaagattgagaagccaagcctgctgacgatgatgaaggagaaccgactcggaccgatg

SEQ ID NO: 10310 - DNA, 203 bp, Homo sapiens
ggcgcgccagtccttttcggctcatccttctactcgtgacacttcccagttctggctttttgaaagcaaagatgagcaacactcaagctgagaggtccataataggcatgatcgacatgtttcacaaatacaccggacgtgatggcaagattgacaagccaagcctgctgacgatgatgaaggagaaccgactcggaccgatg

SEQ ID NO: 10311 - DNA, 203 bp, Homo sapiens
ggcgcgccagtcctcgcccgctccaaagaccccgacaggccccggcgggtgggaggcgcgcgccccggggcgggcggggctccccctaccggccagacccagggagaggcgcgcggaggctgcgaaggttccagaagggcggggagggggcgccgcgcgctgaccctccctgggcaccgctggggacgcgactcggaccgatg

SEQ ID NO: 10312 - DNA, 203 bp, Homo sapiens
ggcgcgccagtcctgactacctcggtgcccgcagcgccggggcgtggaggcgttaacgcgcacgcgcttaaggatccggccgtggccgagcgcgcggccgtaagaccgcgggtgactagcatgcagatacccatgctctgactttctgcccctccactgacatggcccaccggggtggggagagggaccgactcggaccgatg

SEQ ID NO: 10313 - DNA, 203 bp, Homo sapiens
ggcgcgccagtcctcttcccctgcctggcaggcgcacgcgcccagcaccctgcctccagcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 10314 - DNA, 203 bp, Homo sapiens
ggcgcgccagtcctactcttcttatctggtcggtcatctctgtaacctccctaccaaggactaattggtctttaaaactcctcaatgcaccgggcgcggtggctcacgcctgtaatcccagcactttgggaggccgagacgggcagatcacgaggtcaggaaatcgagaccatcttggctaacaagaacgactcggaccgatg

SEQ ID NO: 10315 - DNA, 203 bp, Homo sapiens
ggcgcgccagtcctttgtcgcttatctggtcggtcatctctgtaacctccctaccaaggactaattggtctttaaaactcctcaatgcaccgggcgcggtggctcacgcctgtaatcccagcactttgggaggccgaggcgggcagatcacgaggtcaggaaatcgaaaccatcttggctaacaagaacgactcggaccgatg

SEQ ID NO: 10316 - DNA, 203 bp, Homo sapiens
ggcgcgccagtcctctggtacttccgtccagaccggaacccaagatggctgcgctgttgctgagttggtctcttcccatggcgatgtccatctgccaccgtggcactggtattgctttgagtgcaggggtctctctttttggcatgtcggccctgttactccctgggaactttgagtcttatttggaacgactcggaccgatg

SEQ ID NO: 10317 - DNA, 203 bp, Homo sapiens
ggcgcgccagtccttaacaacttttatagctccctggttcaacctcaaggccttgaggttttggcagctctggaggatgagagagaacatggccaggggcccttgcaacacgccgagatgggcgtccctgatggtgctggtcgccataggcaccgccgtgacagcggccgtcaaccctggcgtcgtggcgactcggaccgatg

SEQ ID NO: 10318 - DNA, 203 bp, Homo sapiens
ggcgcgccagtcctgtagaccttttatagctccctggttcaacctcaaggccttgaggttttggcagctctggaggatgagagagaacatggccaggggcccttgcaacgcgccgagatgggcgtccctgatggtgctcgtcgccataggcaccgccgtgacagcggccgtcaaccctggcgtcgtggcgactcggaccgatg

SEQ ID NO: 10319 - DNA, 203 bp, Homo sapiens
ggcgcgccagtccttgtaaagaacccgggccggacgctgccggcaccgccagcgcacagccccaaccgccgccgccccccccacccgctcccaaggagtccccattctccatcaagaacctgctcaacggagaccaccaccggccgccccctaagcctcagccgcccccacggacgctcttcgcgccacgactcggaccgatg

SEQ ID NO: 10320 - DNA, 203 bp, Homo sapiens
ggcgcgccagtcctattgtcgaagaggacgggtcaagtgctggcttccggcggaaaagcgcgcgagcaagatggccaccaccaagcgcgtcttgtacgtgggtggactggcagaggaagtggacgacaaagttcttcatgctgcgttcattccttttggagacatcacagatattcagattcctctggcgactcggaccgatg

SEQ ID NO: 10321 - DNA, 203 bp, Homo sapiens
ggcgcgccagtccttggtatgacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagagctgagggacgactcggaccgatg

SEQ ID NO: 10322 - DNA, 203 bp, Homo sapiens
ggcgcgccagtcctagaggagacaggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactaccgactcggaccgatg

SEQ ID NO: 10323 - DNA, 203 bp, Homo sapiens
ggcgcgccagtcctggtcaggacaggccagtgcctggcgccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactaccgactcggaccgatg

SEQ ID NO: 10324 - DNA, 203 bp, Homo sapiens
ggcgcgccagtccttatttcgacgggccagtgcctggcaccccggggttgccagggtccacggggaacccgaagtccgaggagcccgaggtccgggaccgggaggggctgcagcgcatcaccggcctgtctcccggccgttcggctctcatagtggcggtgctgtgctacatcaatctcctgaactaccgactcggaccgatg

SEQ ID NO: 10325 - DNA, 203 bp, Homo sapiens
ggcgcgccagtcctccaattgacgggccagtgcctggcaccccggggttgccagggtccacggggaacctgaagtccgaggagcccgaggtcccggaccaggaggggctgcagcgcatcaccggcctgtctcccggccgttcggctctcatagtggcggtgctgtgctacatcaatctcctgaactaccgactcggaccgatg

SEQ ID NO: 10326 - DNA, 203 bp, Homo sapiens
ggcgcgccagtcctcgcaacgactacaggggagttttgttgaagttgcaaagtcctggagcctccagagggctgtcggcgcagtagcagcaagcagcagagtccgcacgctccggcgaggggcagaagagcgcgagggagcgcggggcagcagaagcgagagccgagcgcggacccagccaggacccacgactcggaccgatg

SEQ ID NO: 10327 - DNA, 203 bp, Homo sapiens
ggcgcgccagtcctggctgggagccgcagtcagatcctagcgtcgagccccctctgagtcaggaaacattttcagacctatggaaactacttcctgaaaacaacgttctgtcccccttgccgtcccaagcaatggatgatttgatgctgtcctcggacgatattgaacaatggttcactgaagacccacgactcggaccgatg

SEQ ID NO: 10328 - DNA, 203 bp, Homo sapiens
ggcgcgccagtcctcgacgtgagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 10329 - DNA, 203 bp, Homo sapiens
ggcgcgccagtccttttcgggagccgggccccggccgctgtccagccgctccgtgccccgcgcgtcctgcgccgccgccaccgcctcttggggagacgcagccacttgcccgccatggatactcccagggtcctgctctcggccgtcttcctcatcagttttctgtgggatttgcccggtttccagcacgactcggaccgatg

SEQ ID NO: 10330 - DNA, 203 bp, Homo sapiens
ggcgcgccagtcctcgatccgatcgacttactccgcggagttggcctcatttctgcacagagtcggcgctccctgtagtttctcctctcgaacgccaggtggagcaaccggccggataccgccacagccctggcaggcggcgctgtgatgcctgagctgatcctgtatgttgcaatcactctatccgtcgactcggaccgatg

SEQ ID NO: 10331 - DNA, 203 bp, Homo sapiens
ggcgcgccagtcctatcaaggatcggcttactccgcggagttggcctcatttctgcacagagtcggcgctccctgtagtttctcctctcgaacgccaggtggagcaaccggccggataccgccacagccctggcaagaggcgctgtgatgcctgagctgatcctgtatgttgcaatcactctatccgtcgactcggaccgatg

SEQ ID NO: 10332 - DNA, 203 bp, Homo sapiens
ggcgcgccagtcctgactacgatcggcttactccgcggagttggcctcatttctgcacagagtcggcgctccctgtagtttctcctctcgaacgccaggtggagcaaccggccggataccgccacagccctggcaggcggcgctgtgatgcctgagctgatcctgtatgttgcaatcactctatccgtcgactcggaccgatg

SEQ ID NO: 10333 - DNA, 203 bp, Homo sapiens
ggcgcgccagtcctcggtgagcaaggcgcgcatgcgcaccgagggtggagccgctgagcacagaaccggaaacttagagacaaagttcggagccccgcccccgccgcgcgccgctgagttgtctggccccgccgacccacggctcacgacccaccgacccacgaatcggcccggccgtcgcgtgcacccgactcggaccgatg

SEQ ID NO: 10334 - DNA, 203 bp, Homo sapiens
ggcgcgccagtcctgtccgcgcaaggcgcgcatgcgtaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcacccgactcggaccgatg

SEQ ID NO: 10335 - DNA, 203 bp, Homo sapiens
ggcgcgccagtcctttgcttgccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaacgactcggaccgatg

SEQ ID NO: 10336 - DNA, 203 bp, Homo sapiens
ggcgcgccagtcctgaatctgccgtgctgttcccgccaattcctgtggtaatccttaccgtggcgagttccgcgctcaatggagacgtttgcccccaccgagctgcccgagctgcttaaactttattaccggaggctctttccctactctcagtactatcgctggctcaactacggtggagtgataaacgactcggaccgatg

SEQ ID NO: 10337 - DNA, 203 bp, Homo sapiens
ggcgcgccagtcctggtggcgccgtgctgttcccgccagttcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaacgactcggaccgatg

SEQ ID NO: 10338 - DNA, 203 bp, Homo sapiens
ggcgcgccagtcctaccagcgcctcctgcttgaggtagttgtttttactcccagtccccaggctcacgagccccacgcgcgctcaatctgccctcccgcttctcctcgccactccgagttctgcgccctcgagatccagcgcatccgcggggtgggcgggtcctggcagctctttgccctcttccaaccgactcggaccgatg

SEQ ID NO: 10339 - DNA, 203 bp, Homo sapiens
ggcgcgccagtcctagcgccgcctcctgcttgaggtagttgtttttactcccagtccccaggctcacgagccccacgcgcgctcaatctgccctcccgcttctcctcgccactccgagttctgcgccctcgagatccagcgcatccgcggggtgggcgggtcctggcggctctttgccctcttccaaccgactcggaccgatg

SEQ ID NO: 10340 - DNA, 203 bp, Homo sapiens
ggcgcgccagtcctactcttgccttcgccagcagcgccgcggcggaaccgggcgcaggggagcgagcccggccccgccagcccagcccagcccagcccagccctactccctccccacgccagggcagcagccgttgctcagagagaaggtggaggaagaaatccagaccctagcacgcgcgcaccatccgactcggaccgatg

SEQ ID NO: 10341 - DNA, 203 bp, Homo sapiens
ggcgcgccagtccttcatgcgcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaaccgactcggaccgatg

SEQ ID NO: 10342 - DNA, 203 bp, Homo sapiens
ggcgcgccagtccttcgatggcggggcggatggcgagggagcggggcgagctgctttttgaggctgcgcactcgcatggccccacctcgcaggtccatttccggcgccgcggctgttccgggcggagaccgcttgtgctggagtcggagttgtaacgctccactgactgatagagcgaccggccgacccgactcggaccgatg

SEQ ID NO: 10343 - DNA, 203 bp, Homo sapiens
ggcgcgccagtcctcagaaggctcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccgactcggaccgatg

SEQ ID NO: 10344 - DNA, 203 bp, Homo sapiens
ggcgcgccagtccttggtatgctcgtccgcctaataccgcgcctgcgcaccgcgtctcttcctttctgggctcggacctaggtcgcggcgacatggccaaacgtaccaagaaagttgggatcgtcggtaaatacgggacccgctatggggcctccctccggaaaatggtgaagaaaattgaaatcagccgactcggaccgatg

SEQ ID NO: 10345 - DNA, 203 bp, Homo sapiens
ggcgcgccagtcctgtcgctgctgtctgtgtacttccggcagcctccagacagtttcttccgcttcctgtaccacccggctcaagtagcggacacggaacagggaactatcagcccgtcggcctccgggccctgcattctctagctatggaccgggaccttttgcggcagtcgctaaattgccacgggcgactcggaccgatg

SEQ ID NO: 10346 - DNA, 203 bp, Homo sapiens
ggcgcgccagtcctccgaccgctgtctgtgtacttccggcagcctccagacagtttcttccgcttcctgtaccacccggctcaagtagcggacacggaacagggaactatcagcccgtcggcctccgggccctgtattctctagccatggaccgggaccttttgcggcagtcgctaaattgccacgggcgactcggaccgatg

SEQ ID NO: 10347 - DNA, 203 bp, Homo sapiens
ggcgcgccagtcctgaagtagctgtctgtgtacttccggcagcctccagacagtttcttccgcttcctgtaccaccctgctcaagtagcggacacggaacagggaactatcagcccgtcggcctccgggccctgcattctctagccatggaccgggaccttttgcggcagtcgctaaattgccacgggcgactcggaccgatg

SEQ ID NO: 10348 - DNA, 203 bp, Homo sapiens
ggcgcgccagtcctccaattgcttccgcctccttctttctcgacaagatggccacaccggcggtaccagtaagtgctcctctggccacgccaaccccagtcccggcggcggccccagcctcagttccagcgccaacgccagcaccggctgcggctccggttcccgctgcggctccagcctcatcctcacgactcggaccgatg

SEQ ID NO: 10349 - DNA, 203 bp, Homo sapiens
ggcgcgccagtccttcccaggcttccgcctccttttttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcacgactcggaccgatg

SEQ ID NO: 10350 - DNA, 203 bp, Homo sapiens
ggcgcgccagtcctgtgccagcttccgtctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcacgactcggaccgatg

SEQ ID NO: 10351 - DNA, 203 bp, Homo sapiens
ggcgcgccagtcctcattatgcttccgtctccttctttctcgacaagatggccacaccggcggtaccagtaagtgctcctctggccacgccaaccccagtcccggcggcggccccagcctcagttccagcgccaacgccagcaccggctgcggctccggttcccgctgcggctccagcctcatcctcacgactcggaccgatg

SEQ ID NO: 10352 - DNA, 203 bp, Homo sapiens
ggcgcgccagtcctacgggtggactggggacctcactcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctccccgactcggaccgatg

SEQ ID NO: 10353 - DNA, 203 bp, Homo sapiens
ggcgcgccagtcctatgtacggactggggacctcgctcaggaccgtggggagttggctgaaggacttggggagcccagaagttgccaccgaaccaagaaccacctctgtgcagaaaagcaaccaccttgttctctattctgctgcccgagacaaccacatcctcctcctcctacacccaaaggctccccgactcggaccgatg

SEQ ID NO: 10354 - DNA, 203 bp, Homo sapiens
ggcgcgccagtcctcgacgtggagctcagtgccagaggaggggattcccggcgccgggtcagagccccttttttcttttgccgaaagaccctttctgctggggagcctcttgtgtccagcctaggcccgcgtgcagcgccgacggatgatcgtcttcttggcaagaaagtgaataaacttaattgagacgactcggaccgatg

SEQ ID NO: 10355 - DNA, 203 bp, Homo sapiens
ggcgcgccagtccttttcggggagctcagtgccagaggaggggattcccggcgccgggtcagagcccctttttttttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 10356 - DNA, 203 bp, Homo sapiens
ggcgcgccagtcctacctcgggagctcagtgccagaggaggggattcctggcgccgggtcagagccccttttttcttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 10357 - DNA, 203 bp, Homo sapiens
ggcgcgccagtcctcgcccgggaggccgttcctgcgcggccgccccattcccagaccggccgccagcccatctggttagctcccgccgctccgcgccgcccgggagtcgggagccgcggggaaccgggcacctgcatccgccgctgggagtgagtggctccagctggtgcctggcctgtgtctcttggcgactcggaccgatg

SEQ ID NO: 10358 - DNA, 203 bp, Homo sapiens
ggcgcgccagtcctcgatccggagtaagtctgtctgatctaggatgtcttgcttaccacccaggtagggggttatatactcccagcctttctgattccattgtaactcttgccgaaatccgggtgaacggaagtagtctctttaagaactggtatgggcaggcccaagttgtcaaggcttcggaggtacgactcggaccgatg

SEQ ID NO: 10359 - DNA, 203 bp, Homo sapiens
ggcgcgccagtcctatcaagggagtaagtctgtctgatctaggatgtcttgcttatcacccaggtagggggttatatactcccagcctttctgattccattgtaactcttgccgaaatccgggtgaacggaagtagtctctttaagaactggtatgggcaggcccaagttgtcaaggcttcggaggtacgactcggaccgatg

SEQ ID NO: 10360 - DNA, 203 bp, Homo sapiens
ggcgcgccagtccttccttaggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccgactcggaccgatg

SEQ ID NO: 10361 - DNA, 203 bp, Homo sapiens
ggcgcgccagtcctgaggccggccgccggcactggattgcttctgtctggcggcggcagcatggcggcgggggcggctgaggcagctgtagcggccgtggaggaggtcggctcagccgggcactttgaggagctgctgtgcctcaaagccaagtccctccttgtggtccatttctgggcaccatgggccgactcggaccgatg

SEQ ID NO: 10362 - DNA, 203 bp, Homo sapiens
ggcgcgccagtcctcttcccggccgccggcactggattgcttctgtctggcggcggcagcatggcggcgggggcggctgaggcagctgtagcggccgtggaggaggtcggctcagccgggcagtttgaggagctgctgtgcctcaaagccaagtccctccttgtggtccatttctgggcaccatgggccgactcggaccgatg

SEQ ID NO: 10363 - DNA, 203 bp, Homo sapiens
ggcgcgccagtcctttaataggccgccgggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggccgactcggaccgatg

SEQ ID NO: 10364 - DNA, 203 bp, Homo sapiens
ggcgcgccagtcctagcgccggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcgactcggaccgatg

SEQ ID NO: 10365 - DNA, 203 bp, Homo sapiens
ggcgcgccagtcctagttctggcgattgcgtcccagaaccgacgtcccaccgccttcccacatcggatcgcagggctcccaaaatggcgagtgaggctgcggggactcgctgagcagcggaaggggagcgtgcagagccgctgcggccctcacagtccggagcccggccgtgccgtgccgtagggaaccgactcggaccgatg

SEQ ID NO: 10366 - DNA, 203 bp, Homo sapiens
ggcgcgccagtcctttgtcgggcggccgggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggccgactcggaccgatg

SEQ ID NO: 10367 - DNA, 203 bp, Homo sapiens
ggcgcgccagtccttcatgcggctcggccgccagtcggaagcgccagcccagagcctgggaagtggccgcagaggctgctcggccccgctgcccgccaggtcgtgggctcccgctccgggcccggggccaccggctgtggacttcaaaatgagcgtccctgactacatgcagtgtgctgaggaccacccgactcggaccgatg

SEQ ID NO: 10368 - DNA, 203 bp, Homo sapiens
ggcgcgccagtccttgattgggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgcccgactcggaccgatg

SEQ ID NO: 10369 - DNA, 203 bp, Homo sapiens
ggcgcgccagtcctatcctaggctgagacctctctcccagagctggggggagaggacaaagccacgccttgccccagcatcctggagctggaggagctcctgcgggcagggaagtcttcttgcagccgtgtggacgaagtttggcccaaccttttcataggagatgtagctggtccttactccctgcccgactcggaccgatg

SEQ ID NO: 10370 - DNA, 203 bp, Homo sapiens
ggcgcgccagtcctgacacaggctgagacctctctcctagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgcccgactcggaccgatg

SEQ ID NO: 10371 - DNA, 203 bp, Homo sapiens
ggcgcgccagtccttaacaaggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgcccggcgactcggaccgatg

SEQ ID NO: 10372 - DNA, 203 bp, Homo sapiens
ggcgcgccagtcctcgtaggggctgccggccggcggccccgcgctcgcccgccccgcttccgcccgctgtcctgctgcacgaacccttccaactctcctttcctcccccacccttgagttacccctctgtctttcctgctgtttcgcgggtgctcccacagcggagcggagattacagagccgccgggcgactcggaccgatg

SEQ ID NO: 10373 - DNA, 203 bp, Homo sapiens
ggcgcgccagtcctcaaagaggcttactgaggctggtggagggagccactgctgggctcaccatggaccgccggatgtggggggcccacgtcttctgcgtgttgagcccgttaccgaccgtattgggccacatgcacccagaatgtgacttcatcacccagctgagagaggatgagagtgcctgtctacgactcggaccgatg

SEQ ID NO: 10374 - DNA, 203 bp, Homo sapiens
ggcgcgccagtcctcatgcgggcttactgaggctggtggagggagccactgctgggctcaccatggaccgctggatgtggggggcccacgtcttctgcgtgttgagcccgttaccgaccgtattgggccacatgcacccagaatgtgacttcatcacccagctgagagaggatgagagtgcctgtctacgactcggaccgatg

SEQ ID NO: 10375 - DNA, 203 bp, Homo sapiens
ggcgcgccagtccttcgatggggcagccggccgtgcgcctgcgcggtggcccttccatcccggcagtcgtggctgcagcgctgaggcgagaggttgttgggtgtctccggccacaatgacccaggctgagaagggtgatacggagaacggaaaggagaagggcggcgagaaggagaaggagcagcgcgcgactcggaccgatg

SEQ ID NO: 10376 - DNA, 203 bp, Homo sapiens
ggcgcgccagtcctcagaaggggcattgcccccagtctcccccaaatttggccattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 10377 - DNA, 203 bp, Homo sapiens
ggcgcgccagtcctcgcaacggggtccgtcctggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacgactcggaccgatg

SEQ ID NO: 10378 - DNA, 203 bp, Homo sapiens
ggcgcgccagtcctggagcgggtaggcatttaaaaatgtgtgtgtatgtgtatatatgtatgtgtatgtatgtgtatatatgtatatgtatgtatgtatcgcgtgtatgtgtgtatgtatgcatgtgtatgtatgtatatgtatgtatgtgtatgtgtatatatgtatgtgtgtgtatgtatatgtgtcgactcggaccgatg

SEQ ID NO: 10379 - DNA, 203 bp, Homo sapiens
ggcgcgccagtcctaaacgcggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaacgactcggaccgatg

SEQ ID NO: 10380 - DNA, 203 bp, Homo sapiens
ggcgcgccagtcctggctggggtcccagactccccccagcacagcagagcgcttccctgcccacccgcggaaaccgccccaggtgggccgcgcccccgccccagcagccagcagggcgccagggctgagccggccgtggaggggagcgggtcccgcgggttatacaggcgccggggctccgcggcaggcgactcggaccgatg

SEQ ID NO: 10381 - DNA, 203 bp, Homo sapiens
ggcgcgccagtcctgcacccggtcccagactccccccagcacagcagagcgcttccctgcccacccgcggaaaccgccccaggtgggccgcgccccctccccagcagccagcagggcgccagggctgagccggccgtggaggggagcgggtcccgcgggttatacaggcgccggggctccgcggcaggcgactcggaccgatg

SEQ ID NO: 10382 - DNA, 203 bp, Homo sapiens
ggcgcgccagtcctacctcgggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtacccgactcggaccgatg

SEQ ID NO: 10383 - DNA, 203 bp, Homo sapiens
ggcgcgccagtccttatcctggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtccccgactcggaccgatg

SEQ ID NO: 10384 - DNA, 203 bp, Homo sapiens
ggcgcgccagtcctaggacgggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagtggtgcccgcccggccgtcagtacccgactcggaccgatg

SEQ ID NO: 10385 - DNA, 203 bp, Homo sapiens
ggcgcgccagtccttgcgttggtcccctccgcctgacgctcctctctgtctcagccaggactggtttctgtaagaaatagcaggagctgtggcagcggcgaaaggaagcggctgaggcgcttggaacccgaaaagtctcggtgctcctggctacctcgcacagcggtgcccgcccggccgtcagtacccgactcggaccgatg

SEQ ID NO: 10386 - DNA, 203 bp, Homo sapiens
ggcgcgccagtcctcgcccgggtcgcggcaaaggcggtaaaggtttgggtaagggagatgctaagcgtcaccgaaaagtgctgcgggataacatccaaggcatcaccaaaccggccattcggcgccttgctaggcgtggtggggttaagcgaatttccggtttgatttatgaggagactcgtggcgttcgactcggaccgatg

SEQ ID NO: 10387 - DNA, 203 bp, Homo sapiens
ggcgcgccagtcctaaggaaggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttcgactcggaccgatg

SEQ ID NO: 10388 - DNA, 203 bp, Homo sapiens
ggcgcgccagtcctatcaagggtcgcggcaaaggcggtaaaggtttgggtaagggaggtgctaagcgtcaccgaaaagtgctgcgggataacatccaaggcatcaccaaaccggccattcggcgccttgctaggcgtggtggggttaagcgaatttccggtttgatttatgaggagactcgtggcgttcgactcggaccgatg

SEQ ID NO: 10389 - DNA, 203 bp, Homo sapiens
ggcgcgccagtcctcggtgaggttcgcagcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccacgactcggaccgatg

SEQ ID NO: 10390 - DNA, 203 bp, Homo sapiens
ggcgcgccagtccttttgatggttcgcggcgctgggagcggccgtgacgtcaggcgcccggctgctcctcacttgctctgagacaggtgcggcaagtctactgcgggctggtccgggctcctcaggttcagacccgaccgttatccactcggttcgtggagaggagaggtgcactttacaggtccccgcgactcggaccgatg

SEQ ID NO: 10391 - DNA, 203 bp, Homo sapiens
ggcgcgccagtccttactgtggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagagcagaggtgcactttacaggtccccacgactcggaccgatg

SEQ ID NO: 10392 - DNA, 203 bp, Homo sapiens
ggcgcgccagtccttcggacggttcgcggcgctgggagcggccgtgacgtcaggcgcccggctgctcctcacttgctctgagacaggtgcggcaagtctactgtgggctggtccgggctcctcaggttcagacccgaccgttatccagtcggttcgtggagaggagaggtgcactttacaggtccccacgactcggaccgatg

SEQ ID NO: 10393 - DNA, 203 bp, Homo sapiens
ggcgcgccagtcctaccagcgtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacacctccaatcccagacgctcgactcggaccgatg

SEQ ID NO: 10394 - DNA, 203 bp, Homo sapiens
ggcgcgccagtcctagcgccgtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 10395 - DNA, 203 bp, Homo sapiens
ggcgcgccagtcctggcgaagtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagatgctcgactcggaccgatg

SEQ ID NO: 10396 - DNA, 203 bp, Homo sapiens
ggcgcgccagtcctcacttggtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcgactcggaccgatg

SEQ ID NO: 10397 - DNA, 203 bp, Homo sapiens
ggcgcgccagtccttggcgcgtttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 10398 - DNA, 203 bp, Homo sapiens
ggcgcgccagtccttgattgtaaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcgactcggaccgatg

SEQ ID NO: 10399 - DNA, 203 bp, Homo sapiens
ggcgcgccagtcctatcctataaaacggacatctccagcgtgggtggctcctttttctttttctttttttcccacccttcaggaagtggacgtttcgtaatcttctgatccttgcaccttcttttggggcaaacggggcccttctgcccagatcccctctcttttctcggaaaacaaactactaagtccgactcggaccgatg

SEQ ID NO: 10400 - DNA, 203 bp, Homo sapiens
ggcgcgccagtccttaacaataaaacggacatctccagcgtgggtggctcctttttctttttctttttttcccacccttcaggaagtggacgtttcgttgtcttctgatccttgcaccttcttttggggcaaacggggcccttctgcccagatcccctctcttttctcggaaaacaaactactaagtccgactcggaccgatg

SEQ ID NO: 10401 - DNA, 203 bp, Homo sapiens
ggcgcgccagtcctataccttaacaaacgggaggaggaagcgattctggggtttctgtgttgaacggttcttgtccgcgaagatgcgcttcggcctctgtcaggggacttgaacgggcttagtgggcttcagccagcttttctccaccggttccccacggagacccccccccccccccggccgttgcacgactcggaccgatg

SEQ ID NO: 10402 - DNA, 203 bp, Homo sapiens
ggcgcgccagtcctgagcgttacaacacccgagcaaggacgcgactctcccgacgtggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 10403 - DNA, 203 bp, Homo sapiens
ggcgcgccagtcctcaaagatacaacacccgagcaaggacgcgactctctcgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 10404 - DNA, 203 bp, Homo sapiens
ggcgcgccagtcctgttatgtacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaattactctatccgtcgactcggaccgatg

SEQ ID NO: 10405 - DNA, 203 bp, Homo sapiens
ggcgcgccagtcctaatacctcagtgcctgaggcagagactgcgagaaaaaaacgcgcttcattccttcttccaccgccatactgtattttatactaaatctcatttttattccaacattttactcccgctcgatatagcccttggcgaggtgcctggctccatagattaaagcaaggagagccaatccgactcggaccgatg

SEQ ID NO: 10406 - DNA, 203 bp, Homo sapiens
ggcgcgccagtcctggagcgtccctactcccagtctccacccaactcccccgcccgccccgtgcaggctgtggagactcccttcccgggggagggggcccccactgccgcaggtgccccctctgcctccaccccgctctgaaatagaaaatgtctgcagacggcggaggcatccaggacacccaggaccgactcggaccgatg

SEQ ID NO: 10407 - DNA, 203 bp, Homo sapiens
ggcgcgccagtcctcattattcccttctgatggtgaatgggaactcccttcctcctgcagcagcctgcctgcagctgtcctggtagaacagtgtggacattgcagaagctgtcactgtcccagaaagaaagcaccccagagccaaggcaaagagtcttgaaagcgccacaagcagcagctgctgagcccgactcggaccgatg

SEQ ID NO: 10408 - DNA, 203 bp, Homo sapiens
ggcgcgccagtcctacgggttccgactcgccctcggccttccgcgccagccgcagccacagccgcaacgccacccgcagccacagccacagccacagccccaggcatagccttcggcacagccccggctccggctcctgcgacagctcctctgggcaccgtccctgcgccgacatcctggaggttgggcgactcggaccgatg

SEQ ID NO: 10409 - DNA, 203 bp, Homo sapiens
ggcgcgccagtcctgctacttccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggcgactcggaccgatg

SEQ ID NO: 10410 - DNA, 203 bp, Homo sapiens
ggcgcgccagtcctaaacgctccgactcgccctcggccttccgcgccagccgcagcgacagccgcaacgccacccgcagccacagccacagccacagccccaggcatagccttcggcacagccccggctccggctcctgcgacagctcctctgggcaccgtccctgcgccgacatcctggaggttgggcgactcggaccgatg

SEQ ID NO: 10411 - DNA, 203 bp, Homo sapiens
ggcgcgccagtcctcagctctcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactccgactcggaccgatg

SEQ ID NO: 10412 - DNA, 203 bp, Homo sapiens
ggcgcgccagtcctgaggcctcggtgcagactccggttctccccaaccccgggcctgggcagctggacactggggcgccgttccccacccggcgcggacttcggaaccggccctgggactgactggctctaccactcgagcgcgtctccgctggacccggaatcccggtcggtccattccccgcgaagcgactcggaccgatg

SEQ ID NO: 10413 - DNA, 203 bp, Homo sapiens
ggcgcgccagtccttactgttcggtgcagactccggttctccccaaccccgggcctgggcagctgggcactggggcgccgttccccacccggcgcggacttcggaaccggccctgggactgactggctctaccactcgagcgcgtctccgctggacccggaatcccggtcggtccattccccgcgaagcgactcggaccgatg

SEQ ID NO: 10414 - DNA, 203 bp, Homo sapiens
ggcgcgccagtcctggtggctctgccgccgccgctgccttttttttttctcgagctcttgagatctccggttgggattcctgcggattgacatttctgtgaagcagaagtctgggaatcgatctggaaatcctcctaatttttactccctctccccccgactgctgattcattgggaagtttcaaatccgactcggaccgatg

SEQ ID NO: 10415 - DNA, 203 bp, Homo sapiens
ggcgcgccagtcctagcgcctctgtggagagtcctgctgccctccagccgggctcctccaccggcccttgcaggggcgcagagagctcggcgcccgcccttccgctcgcctttttcgtcagccggctggagcagcatgggtccgggaggtctctgggctgaggcggcgacagctcctctagttccacccgactcggaccgatg

SEQ ID NO: 10416 - DNA, 203 bp, Homo sapiens
ggcgcgccagtcctactctttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaacgactcggaccgatg

SEQ ID NO: 10417 - DNA, 203 bp, Homo sapiens
ggcgcgccagtcctttgtcgtcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggccttgattctacaggttattatgaccaggaacgactcggaccgatg

SEQ ID NO: 10418 - DNA, 203 bp, Homo sapiens
ggcgcgccagtcctgtttgttgaaaaactggagcctgttcttggcaagaagattctaatgcccaggaacatggcgctgctctgggggctcctggtgctcagctggtcctgcctgcaaggcccctgctccgtgttctcccctgtgagcgccatggagcccttgggccggcagctaactagcaggccgaacgactcggaccgatg

SEQ ID NO: 10419 - DNA, 203 bp, Homo sapiens
ggcgcgccagtccttcgatgtgagggctttttggagctcgctatgcttaacctggagatgattaaggccccgcttcctggcctcccagcctctaatgccaaaagataagggagaggctggcgtgtgaccccgttttgagtcaggtggacagagggctggccaccttcggaaccatgggtgcaatacggcgactcggaccgatg

SEQ ID NO: 10420 - DNA, 203 bp, Homo sapiens
ggcgcgccagtcctgcgtagtgaggtgtagacgccaactctccctagctcgctagtgggttgcaggaggtgcttacacatgtttgtttctttgctgccgtcttccagttgctttatctgttcacttgtgccctgactttcaactctgtctccttcctcttcctacagtactcccctgccctcaacaagcgactcggaccgatg

SEQ ID NO: 10421 - DNA, 203 bp, Homo sapiens
ggcgcgccagtccttggtattgaggtgtagacgccaactctctctagctcgctagtgggttgcaggaggtgcttacgcatgcttgtttctttgctgccgtcttccagttgctttatctgttcacttgtgccctgactttcaactctgtctccttcctcttcctacagtactcccctgccctcaacaagcgactcggaccgatg

SEQ ID NO: 10422 - DNA, 203 bp, Homo sapiens
ggcgcgccagtcctagaggatgaggtgtagacgccaactctctctagctcgctagtgggttgcaggtggtgcttacacatgtttgtttctttgctgccgtcttccagttgctttatctgttcacttgtgccctgactttcaactctgtctccttcctcttcctacagtactcccctgccctcaacaagcgactcggaccgatg

SEQ ID NO: 10423 - DNA, 203 bp, Homo sapiens
ggcgcgccagtcctggtcagtgagtcggagctctatggaggcggcagcgggtaccgagtggcggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 10424 - DNA, 203 bp, Homo sapiens
ggcgcgccagtcctgccgtctgagtcggggctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 10425 - DNA, 203 bp, Homo sapiens
ggcgcgccagtcctcacggctgatccggggctcggccaagctgaggcggcggcgcccggccgtgcgcccagctttcaggcgcctggctctcacgatgatgaagaagaagaagtttaagtttaaggtggacttcgagctcgaggagctctcctcagtgcccttcgtcaatggggtcctcttctgcaagacgactcggaccgatg

SEQ ID NO: 10426 - DNA, 203 bp, Homo sapiens
ggcgcgccagtcctggagcgtgctcctctacctgctccaccctcaatccaccagaaccatgggctgctgtggctgctccagaggctgtggctccggctgtgggggctgtggctccagctgtgggggttgtggctctggctgtgggggctgtggctccggccgtgggggctgtggctctggctgtggggcgactcggaccgatg

SEQ ID NO: 10427 - DNA, 203 bp, Homo sapiens
ggcgcgccagtcctgctacttggaagcgccccagccccgcagcgatcgcagattcggctttcaaacaaaagaggcgccccggggggtgggaccgggacctcacccggtcctcgcagagttgcggccgccctccccttcagccccggctctccgtatgcgcatgagcagaggcgcctccctctgttcctcgactcggaccgatg

SEQ ID NO: 10428 - DNA, 203 bp, Homo sapiens
ggcgcgccagtcctgcaccctggagcctccagagggctgtcggcgcagtagcagcgagcagcagagtccgcacgctccggcgaggggcagaagagcgcgagggagcgcggggcagcagaagcgagagccgagcgcggacccagccaggacccagagccctccccagctgcccaggaagagccccagcccgactcggaccgatg

SEQ ID NO: 10429 - DNA, 203 bp, Homo sapiens
ggcgcgccagtcctcgacgttggcgctggcctgctgccccggcgggtccgccggccggaggcgggagtcacaggaagagccctccacaaaaggaggcctcggcggatcaggacagctgcaggcttctgccaggtgggtgtgcagactggtgagctgccagcaggggcccagacgcgccaggcctggagcgactcggaccgatg

SEQ ID NO: 10430 - DNA, 203 bp, Homo sapiens
ggcgcgccagtcctgcaaggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 10431 - DNA, 203 bp, Homo sapiens
ggcgcgccagtcctcgatcctgttcagtacgccacaagcgacacaaatgaacacgccttctcagccccgccagcacttctaccctagccgggcccagcccccgagcagtgcagcctcccgagtgcagagtgcagcccctgcccgctctggcccagctgcccatgtctaccctgctggatcccaagtaacgactcggaccgatg

SEQ ID NO: 10432 - DNA, 203 bp, Homo sapiens
ggcgcgccagtcctcagctctgttgcctgttccactaggaatattgtttgcaaggcacaaggtgtcttttggtagtgagcgcgctctgcgcatgcgcagttccattcgggaattactgcccagcagccgactaagttgcattccttgaatcttcgcagaaaagacaattcttttaatcagagttagtacgactcggaccgatg

SEQ ID NO: 10433 - DNA, 203 bp, Homo sapiens
ggcgcgccagtcctgtccgctgtttcccgtcccccgcccgcgagaagtgggggtgaaaagcggcccgacctgcttgcggtgtagtggggggaccgcgcggctggaggtgtgaggatccgaacccaggggtggggggtggaggcggctcctgcgatcgaaggggacttgagactcaccggccgcacgcccgactcggaccgatg

SEQ ID NO: 10434 - DNA, 203 bp, Homo sapiens
ggcgcgccagtccttgggcatgtttcccgtcccccgcccgcgagaagtgggggtgaaaagcggcccgacctgcttggggtgtagtggggggaccgcgcggctggaggtgtgaggatccgaacccaggggtggggggtggaggcggctcctgcgatcgaaggggacttgagacttaccggccgcacgcccgactcggaccgatg

SEQ ID NO: 10435 - DNA, 203 bp, Homo sapiens
ggcgcgccagtcctggtggcttataaaaaacccagtctttgctgaccagacaaagcataccagatctcaccagagagtcctaggggactacagaaggaaaaagacaagaggcagcaggatatctgtgtgtcctcccgctgaccacacttcctttagtgacccgattgcctcctcaagtcgcagacactcgactcggaccgatg

SEQ ID NO: 10436 - DNA, 203 bp, Homo sapiens
ggcgcgccagtcctttgtcgttcaaagtctaactttgacagacaaccttacttccagcgaagtctactcccctccctccggagggaagaatgaatgggctgcggttaagcgtttgccctggtgtcagggccaactgcttcgaagcgccagactttcggagactgtgggtggggagcattaagcgggaacgactcggaccgatg

SEQ ID NO: 10437 - DNA, 203 bp, Homo sapiens
ggcgcgccagtcctgctcgattccagggccgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggcactgctgacgactcggaccgatg

SEQ ID NO: 10438 - DNA, 203 bp, Homo sapiens
ggcgcgccagtcctgtttgtttccagggccgccgtccacactctcccggtcagagtcctgggaccacatggggacgctgccatggcttcttgccttcttcattctgggtctccaggtttgggatactcccaccatcgtctcccgcaaggagtggggggcaagaccgctcgcctgcagggccctgctgacgactcggaccgatg

SEQ ID NO: 10439 - DNA, 203 bp, Homo sapiens
ggcgcgccagtcctatcctattccagggctgccgtccacactctcccggtcagagtcctgggaccacatggggacgctcccatggcttcttgccttcttcattctgggtctccaggcttgggatactcccaccatcgtctcccgcaaggagtggggggcaagaccgctcgcctgcagggccctgctgacgactcggaccgatg

SEQ ID NO: 10440 - DNA, 203 bp, Homo sapiens
ggcgcgccagtcctatacctttccagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgacgactcggaccgatg

SEQ ID NO: 10441 - DNA, 203 bp, Homo sapiens
ggcgcgccagtcctccataatttcttggctaagccgcgtttgtattgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaagcgactcggaccgatg

SEQ ID NO: 10442 - DNA, 203 bp, Homo sapiens
ggcgcgccagtcctgcgtagtttcttggctaagccgtgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaagcgactcggaccgatg

SEQ ID NO: 10443 - DNA, 203 bp, Homo sapiens
ggcgcgccagtccttggtattttgcgaattacacatctctttgattatgttgcgactagttttgttagatagtcatttagtgtttgggatacctgttaagccctttgtccagggactgtggttggatttatgaattatttggacggttgtccacttgaaagaactgacagtagcttcataacaatgttcgactcggaccgatg

SEQ ID NO: 10444 - DNA, 203 bp, Homo sapiens
ggcgcgccagtcctttgtcgaaggctctgtggaggcccagggactcctcacccagctccagcgccagcgcagcctcctagcccaccagccctttgaggagcacttggaccactgggtctcggcctaccacctgctggagtggctggtggagcagcagcagccccttcaagagtacaagggcaggcacccgactcggaccgatg

SEQ ID NO: 10445 - DNA, 203 bp, Homo sapiens
ggcgcgccagtcctcacttgaaggctctgtggaggcccagggactcctcacccagctccagcgccagcgcagcctcctagcccaccagccctttgaggagctcttggaccactgggtctcggcctaccacctgctggagtggctggtggagcagcagcagccccttcaagagtacaagggcaggcacccgactcggaccgatg

SEQ ID NO: 10446 - DNA, 203 bp, Homo sapiens
ggcgcgccagtcctgctcgaaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgactcggaccgatg

SEQ ID NO: 10447 - DNA, 203 bp, Homo sapiens
ggcgcgccagtccttcagctaagtgtctcccactgaaggcatccgtggttgtttttaagccacaaaaaagccacacccaagatcacctgacacccaccctgtcaagtgtccatgatgctgggccctgagggaggtgaaggctttgtggtcaagctccgtggcctgccctggtcctgctctgttgaggacgactcggaccgatg

SEQ ID NO: 10448 - DNA, 203 bp, Homo sapiens
ggcgcgccagtcctgtttgtaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgccgactcggaccgatg

SEQ ID NO: 10449 - DNA, 203 bp, Homo sapiens
ggcgcgccagtccttgattgacgaggcaggcggaagaggcgggacttcgcgggtgacgtcatcggggcgccggaggcccggggcgcctgggaatttgaagcaaacaggcagcgcgcgacaatggcggtcgctcgtgcagctttggggccattggtgacgggtctgtacgacgtgcaggctttcaagttcgactcggaccgatg

SEQ ID NO: 10450 - DNA, 203 bp, Homo sapiens
ggcgcgccagtcctgacacaacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatccgactcggaccgatg

SEQ ID NO: 10451 - DNA, 203 bp, Homo sapiens
ggcgcgccagtccttaacaaacgtgggtgggggaagctgagggctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatccgactcggaccgatg

SEQ ID NO: 10452 - DNA, 203 bp, Homo sapiens
ggcgcgccagtcctatacctactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagcgactcggaccgatg

SEQ ID NO: 10453 - DNA, 203 bp, Homo sapiens
ggcgcgccagtcctcgtaggactctacagctcagaacaccaactgctaaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagtcgactcggaccgatg

SEQ ID NO: 10454 - DNA, 203 bp, Homo sapiens
ggcgcgccagtcctattgtcagatgtcagcccaggagagctgcctcagcctcatcaagtcctcggcagcctgatcttctgcttcggcatctggatcctcatcgacaagaccagcttcgtgtcctttgtgggcttggccttcgtgcctctgcagatctggtccaaagtcctggccatctcaggaatcttcgactcggaccgatg

SEQ ID NO: 10455 - DNA, 203 bp, Homo sapiens
ggcgcgccagtcctgcgtagagctctaatgccaccatcctcacgagactctggggccccccaggctcccagacctttgagcaaccttcaccgcacagaaacccagccgcgccctgcaattcccaccgcggaaggtgccgaccaacccccaggatggcggaagctcaccaggccgtggccttccagttccgactcggaccgatg

SEQ ID NO: 10456 - DNA, 203 bp, Homo sapiens
ggcgcgccagtcctttcggaaggtacataagttccattaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactcgactcggaccgatg

SEQ ID NO: 10457 - DNA, 203 bp, Homo sapiens
ggcgcgccagtcctgtcgctatcctctctcttgccgttcgagagccccagtgaaacttgagtgagatgagagagcatggagcctgccagtctccccctctgcgcacacacacacgcaaacacatttaactttccacttgcagtgacctgcccttcagtgtgacttatcagctgtttggcttttgtcaccgactcggaccgatg

SEQ ID NO: 10458 - DNA, 203 bp, Homo sapiens
ggcgcgccagtcctccgaccatcctctctcttgccgttcgagagccccagtgaaacttgagtgagatgagagagcatggagcctgccagtctccccctctgtgcacacacacacgcaaacacatttaactttccacttgcagtgacctgcccttcagtgtgacttatcagctgtttggcttttgtcaccgactcggaccgatg

SEQ ID NO: 10459 - DNA, 203 bp, Homo sapiens
ggcgcgccagtccttcccagcactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagaccgactcggaccgatg

SEQ ID NO: 10460 - DNA, 203 bp, Homo sapiens
ggcgcgccagtcctaaacgccagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttcgactcggaccgatg

SEQ ID NO: 10461 - DNA, 203 bp, Homo sapiens
ggcgcgccagtcctgcaccccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagacgactcggaccgatg

SEQ ID NO: 10462 - DNA, 203 bp, Homo sapiens
ggcgcgccagtccttatcctcatcatctagataatcagaaccttggcttccacatcctcctcccttgtcttaactacaaacatttctttctgctgacttcaactcctcagacatgggaaagtctctttctcatttgcctttgcattcaagcaaagaagatgcttatgatggagtcacatctgaaaacacgactcggaccgatg

SEQ ID NO: 10463 - DNA, 203 bp, Homo sapiens
ggcgcgccagtcctctctcacatgaactgggaagagtagctgagccccagagcctctctggaagagaaaggaagagccagcagttctttctcccagtgtcccacctcactgtccagcgtcttcctctgcccctgctctgccctccctggctcctggactagagcccggcttccagcaggacgtttccccgactcggaccgatg

SEQ ID NO: 10464 - DNA, 203 bp, Homo sapiens
ggcgcgccagtccttgcgttcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccgactcggaccgatg

SEQ ID NO: 10465 - DNA, 203 bp, Homo sapiens
ggcgcgccagtcctcgcccgcatgcgcgcttccttgcgcgagccgggctgtcgggtgtgttttgctctccagcctccgtcgtctctgcagcactccgggttctcctccagagcgctagtcccaggagctcggaatgttcgtggaacttaataacctgcttaacaccacccccgacagggcggagcaggcgactcggaccgatg

SEQ ID NO: 10466 - DNA, 203 bp, Homo sapiens
ggcgcgccagtcctcagctcccccttggagctctgcatctccaacctggaacccaacccagaagtctcaagtttgacgcatcacgtggcgtgcggatccaccgagggtccacagagaggggcgcccatctcctgcgtctcagttatcctggtgttgggaattctgtgccctaaagaattccgactcagcgactcggaccgatg

SEQ ID NO: 10467 - DNA, 203 bp, Homo sapiens
ggcgcgccagtcctcggtgaccctcggctcccacccttgtgtacctgggccgaaccattcaccggagcgcgcagcgggtggagtgtggctcggaggaccgcagcgggtcaagcacctttctcccccatatctgaaagcatgccctttgtccacgtcgtttacgctcattaaaacttccagaatgcaaccgactcggaccgatg

SEQ ID NO: 10468 - DNA, 203 bp, Homo sapiens
ggcgcgccagtcctcttcccccgaacctgaaaccgggagcttcctgctcgtgttcgctgttgagaagctacccgcggggttgtagacctcggacctcatggcagagataattcaggaacgcatagaagatcggctcccggaattggaacagctggagcgcattggactgttcagtcatgcggagattacgactcggaccgatg

SEQ ID NO: 10469 - DNA, 203 bp, Homo sapiens
ggcgcgccagtccttgggcaccgcccctccccccagctagtgagtgcgcgaacgagaaaggaggagggcgctccaggcgacagcactgcagacgccattatcctctgtttctctgctgcaccgacctcgacgtcttgcctgtgtcccacttgttcgcggcctataggctactgcagcactggggtgtccgactcggaccgatg

SEQ ID NO: 10470 - DNA, 203 bp, Homo sapiens
ggcgcgccagtcctgaatctccgcgacttcgatccggcgctgctggagttcctggtgtgcccgctctccaagaagccgctcagatatgaagcatcaacaaacgaattgattaatgaagagttgggaatagcttatccaatcattgatgggatccctaatatgataccacaggcagctaggatgacacgcgactcggaccgatg

SEQ ID NO: 10471 - DNA, 203 bp, Homo sapiens
ggcgcgccagtcctggtggcccgcgacttcgatccggcgctgctggagttcctggtgtgcccgctctccaagaagccgctcagatatgaagcatcaacaaatgaattgattaatgaagagttgggaatagcttatccaatcattgatgggatccctaatatgataccacaggcagctaggatgacacgcgactcggaccgatg

SEQ ID NO: 10472 - DNA, 203 bp, Homo sapiens
ggcgcgccagtcctggcgaaccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctcccgactcggaccgatg

SEQ ID NO: 10473 - DNA, 203 bp, Homo sapiens
ggcgcgccagtcctttcaccccgcggctctcccacctgtcaccctggcccttctctgcttggatggtgtcttcctctcctcagccgagaatgacttcgtccgccggatccaggaggaactggaccgctttctgctgcagaagcagctgtcaaaggttcttcttttccccccactctccagtcgcctcccgactcggaccgatg

SEQ ID NO: 10474 - DNA, 203 bp, Homo sapiens
ggcgcgccagtcctagttctccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggacgactcggaccgatg

SEQ ID NO: 10475 - DNA, 203 bp, Homo sapiens
ggcgcgccagtcctgctcgacctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggctcgactcggaccgatg

SEQ ID NO: 10476 - DNA, 203 bp, Homo sapiens
ggcgcgccagtccttcagctcctgatacataaatcagacagcctctgctgcatgacacgaagcttgcttctgcctggcatctgtgagcagctgccaggctctggccaggatcccttccttctcctcattggctgatggatcccaaggggctcctctccttgaccttcgtgctgtttctctccctggctcgactcggaccgatg

SEQ ID NO: 10477 - DNA, 203 bp, Homo sapiens
ggcgcgccagtccttcatgcccttggagcgcgcgggaaagagaccaatataaactgtggcgggatagttttcgggtccttgtccagtgaaacaccctcggccgggaagtcagttcgttctctcctctcctctcttcttgtttgaacatggtgcggactaaagcagacagtgttccaggcacttacagacgactcggaccgatg

SEQ ID NO: 10478 - DNA, 203 bp, Homo sapiens
ggcgcgccagtcctctggtaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagacgactcggaccgatg

SEQ ID NO: 10479 - DNA, 203 bp, Homo sapiens
ggcgcgccagtccttggcgccgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggcttcgactcggaccgatg

SEQ ID NO: 10480 - DNA, 203 bp, Homo sapiens
ggcgcgccagtccttgattgcgccgcacaggctggcactgcttgaagaggaggctactcggagactgcgccgcgcggattggaggctccccaaatattttgcgatctgaggatccagctcaagtgaggtgccataggacgtgttcctgagtttgcattgcacggagaccttcctggaatttttcatttcgactcggaccgatg

SEQ ID NO: 10481 - DNA, 203 bp, Homo sapiens
ggcgcgccagtcctatacctcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgcgactcggaccgatg

SEQ ID NO: 10482 - DNA, 203 bp, Homo sapiens
ggcgcgccagtcctgtagaccgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgcgactcggaccgatg

SEQ ID NO: 10483 - DNA, 203 bp, Homo sapiens
ggcgcgccagtccttaaacgctaggtccccagatggggagactgaggccgtggctgtgtgtccctctgagagttggagcggggctgggcccgaattcgaccccagcaggattctctctcatttctgagccccggaggtggcagagcggcagacccgggcaagtgaaccctagggctgcaggagcccagcgactcggaccgatg

SEQ ID NO: 10484 - DNA, 203 bp, Homo sapiens
ggcgcgccagtcctccataactaggtccccagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccagcgactcggaccgatg

SEQ ID NO: 10485 - DNA, 203 bp, Homo sapiens
ggcgcgccagtcctattagactgaagccagtgaaggctctctcgcctcgccctctagcgttcgtctggagtagcgccaccccggcttcctggggacacaggtttggcaccatggggcccaccagcgtcccgctggtcaaggcccaccgcagctcggtctctgactacgtcaactatgatatcatcgtccgactcggaccgatg

SEQ ID NO: 10486 - DNA, 203 bp, Homo sapiens
ggcgcgccagtcctctagggctgtggtgggcgctgcgggtgtttgcaggaggttgcagtactcgctgggctgaggtcgtctcgggtgaggaggtcgcgccgaaagtggctctagccgtggcgcttcggcgtagtaaggagcctgcaacagagttttgttgtttagggggcgcggcaccgcaccgctcccgactcggaccgatg

SEQ ID NO: 10487 - DNA, 203 bp, Homo sapiens
ggcgcgccagtcctaatacccttcctctgcctgcccctcctcctccttccacgttgtctcctccacctagcagttggttggcaaccccttcctcagtccccggctgaaaaccctccagtcagcgcttatcccttctgctctctcccctcacccagagaaatacatggagtttgaccttaatggaaatgcgactcggaccgatg

SEQ ID NO: 10488 - DNA, 203 bp, Homo sapiens
ggcgcgccagtcctagaatccttgaggaccaagtttgcggccacttctgcaggcgtcccttcttagctctcgcccgcccctttctgcagcctaggcggcccaggttctcttctcttcctcgcgcgcccagccgcctcggttcccggcgaccatggtgacgatggaggagctgcgggagatggactgcacgactcggaccgatg

SEQ ID NO: 10489 - DNA, 203 bp, Homo sapiens
ggcgcgccagtcctacaacacttgaggaccaagtttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcacgactcggaccgatg

SEQ ID NO: 10490 - DNA, 203 bp, Homo sapiens
ggcgcgccagtcctccaattcttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcgactcggaccgatg

SEQ ID NO: 10491 - DNA, 203 bp, Homo sapiens
ggcgcgccagtcctggagcggaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatcgactcggaccgatg

SEQ ID NO: 10492 - DNA, 203 bp, Homo sapiens
ggcgcgccagtcctcattatgacctagaccatgcaacccagctgatcctacgatggaaccaaggtgccagtgagatgacaacagccctgctctggtcactccggaagctgaccagtccacacacggctgaagcttgaggagacaacagccctgctctagtcaccccagaagctgactagtctatgcaccgactcggaccgatg

SEQ ID NO: 10493 - DNA, 203 bp, Homo sapiens
ggcgcgccagtcctacgggtgacctagaccatgcaacccagctgatcctacgatggaaccaaggtgccagtgagatgacaacagccctgctctggtcactctggaagctgaccagtccacacacggctgaagcttgaggagacaacagccctgctctagtcaccccagaagctgactagtctatgcaccgactcggaccgatg

SEQ ID NO: 10494 - DNA, 203 bp, Homo sapiens
ggcgcgccagtcctggctgggagagccaggcgagcgcggactggggcggccacgccactccgccagaaggtcgccaggagcctccgcccttcaccttcctcggaaatccgccaggccacgccaagctccctgcccaacccttactgacgggggccacattttcccggcctccgcagccagaccttgaccgactcggaccgatg

SEQ ID NO: 10495 - DNA, 203 bp, Homo sapiens
ggcgcgccagtcctgcacccgaggcgggatggagtgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcccgactcggaccgatg

SEQ ID NO: 10496 - DNA, 203 bp, Homo sapiens
ggcgcgccagtccttatcctgagttccgctcctctctccaaccggggtccccctccagcgaccctaaagcttcccagacttccgcttcaattcctgtccgcaccccacgcccacctcaacgtggagcgcagtggtctccgaggagcgccggagctgccccgcctgcccagcggggtcagcacttcgcacgactcggaccgatg

SEQ ID NO: 10497 - DNA, 203 bp, Homo sapiens
ggcgcgccagtcctaggacggagttccgctcctctctccaaccggggtccccctccagcgaccctaaagcttcccagacttccgcttcaattcctgtccgccccccacgcccacctcaacgtggagcgcagtggtctccgaggagcgccggagctgccccgcctgcccagcggggtcagcacttcgcacgactcggaccgatg

SEQ ID NO: 10498 - DNA, 203 bp, Homo sapiens
ggcgcgccagtccttgcgttgattctgattagttcactactgctactttccctgtggcctaggctttgcctatttccagtgggcgagctagctagatcctcgtcccttaaataagccagtgtttttaagacagaatactacttgcatagtggacaataatatcttaaagaactgagcaggatgaaaagcgactcggaccgatg

SEQ ID NO: 10499 - DNA, 203 bp, Homo sapiens
ggcgcgccagtcctaaggaagatttgcaaaggtttttggagaggaataaatttaatgaaagatgtacatgacttctaaaaactataagcagtgctgggtaatattaaacacatgatgttcacggaagaccagggtgtagatgacaggctgctctatgacattgtattcaagcacttcaaaagaaataacgactcggaccgatg

SEQ ID NO: 10500 - DNA, 203 bp, Homo sapiens
ggcgcgccagtcctatcaaggcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgccgactcggaccgatg

SEQ ID NO: 10501 - DNA, 203 bp, Homo sapiens
ggcgcgccagtcctccgcatgcatctgcccggcccgggggcggaggcgcccattattcctttggctcctccgaagcgccgtaggggtgtttgttgttagagttggaagcttggcagttggcctcccttcttcccatggaggacgggggcttaacagcctttgaagaggaccagagatgcctttcccagcgactcggaccgatg

SEQ ID NO: 10502 - DNA, 203 bp, Homo sapiens
ggcgcgccagtcctcagctcgccagggcgcctgcgcggcggggttctcggtcgccagccattcctgaggaggactgccggtcgttcggacgtcttgcctgtagctggaggagaggtccgggctctccaggaaggtggctgcggcgacaaaatgaagatattcgtgggcaacgtcgacggggcggataccgactcggaccgatg

SEQ ID NO: 10503 - DNA, 203 bp, Homo sapiens
ggcgcgccagtcctgaggccgccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttcgactcggaccgatg

SEQ ID NO: 10504 - DNA, 203 bp, Homo sapiens
ggcgcgccagtcctgtccgcgccccacgctgctttcccagaaggctgtgcgtgctcctcgcttcctccgcggtctttcgagcggtcgcgtgaactgcttcctgcaggctggccatggcgcttcacgttcccaaggctccgggctttgcccagatgctcaaggagggagcgaaacacttttcaggattacgactcggaccgatg

SEQ ID NO: 10505 - DNA, 203 bp, Homo sapiens
ggcgcgccagtccttcggacgccgggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaacgactcggaccgatg

SEQ ID NO: 10506 - DNA, 203 bp, Homo sapiens
ggcgcgccagtcctgaatctgcttctgtcctgcgcgcgcagattctcgcaaatctggaagcggatcgcgtggagtgacggtcacaccgcggcgaattaattcccaaagactcatgttacatgagaaagccaccaagaagaccaaagaaaaggagacaaggatggctcttcctcagggatgcttgacttcgactcggaccgatg

SEQ ID NO: 10507 - DNA, 203 bp, Homo sapiens
ggcgcgccagtcctagcgccggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctcgactcggaccgatg

SEQ ID NO: 10508 - DNA, 203 bp, Homo sapiens
ggcgcgccagtcctggcgaaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatcgactcggaccgatg

SEQ ID NO: 10509 - DNA, 203 bp, Homo sapiens
ggcgcgccagtcctttcaccggacacgtggtacggaaccggcgccgcgcttgctgctggtaacagggccttgcctagtgggccttccttcccaggtcgcccgtcagtctccactagagacaggactgaccagttgctcttccttccaagaaccttcgagatctgcggtctggggtctggttgaaagatcgactcggaccgatg

SEQ ID NO: 10510 - DNA, 203 bp, Homo sapiens
ggcgcgccagtcctagttctggagagggagaacacagttggagaaaatcggcagctgagacggccttggccggacttagcactcaggcctgtgaatcaggaaatacaaagacctccaaaaaaggaccagttcctcggatgtgccccctcacagagagatgaaggggcagcagaaaacagctgaaacggcgactcggaccgatg

SEQ ID NO: 10511 - DNA, 203 bp, Homo sapiens
ggcgcgccagtcctactcttggagcagtgcggggtttaaatctgaggctaggctggctcttctcggcgtgctgcggcggaacggctgttggtttctgctggttgtaggtccttggctggtcgggcctccggtgttctgcttctccccgctgagctgctgcctggtgaagaggaagccatggcgctccgcgactcggaccgatg

SEQ ID NO: 10512 - DNA, 203 bp, Homo sapiens
ggcgcgccagtcctgctcgaggcaacaggcagatttgcctgctgagggtggagacccacgagccgaggcctcctgcagtgttccgcacagcaaaccgcacgctatggctgacagccgggatcccgccagcgaccagatgcagcactggaaggagcagcgggccgcgcagaaagctgatgtcctgaccacgactcggaccgatg

SEQ ID NO: 10513 - DNA, 203 bp, Homo sapiens
ggcgcgccagtccttcatgcggccgccgcccgctctcccggcgcggcagctgtctgggctgctgcgcgccgcctaggtgtctgggcgatctatgggcaagaacaagggccacgatgacagattacggcgaggagcagcgcaacgagctggaggccctggagtccatctaccctgactccttcacagctcgactcggaccgatg

SEQ ID NO: 10514 - DNA, 203 bp, Homo sapiens
ggcgcgccagtcctgacacaggcgtccgcgtccccgcgccgagctgctcgggctccctgagccccagatctgaccccttcccttcggcaacctgaacgactcccgccttccacggaagggaccgagcccgtgccaaacaggctgagcgatttgggagtgaggagccatcctaccgctttccccaacctcgactcggaccgatg

SEQ ID NO: 10515 - DNA, 203 bp, Homo sapiens
ggcgcgccagtcctcgtagggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcgactcggaccgatg

SEQ ID NO: 10516 - DNA, 203 bp, Homo sapiens
ggcgcgccagtcctcatgcgggtctttgcgtctggctactaccagaccgcgggttaggggcttcatctctctgcgtcctcagttgtgggaggccttggtgattcggccacagctcagcctccgtcgctctgtgacctgcgggtattggatgattggtagctaagactcccgaatacttcagaagtgggcgactcggaccgatg

SEQ ID NO: 10517 - DNA, 203 bp, Homo sapiens
ggcgcgccagtccttcgatggtcacttcctggagactggttgaatccggaagtgaccctagagaaatgagttgtggctgaggaccccggcggcagacgcaggttcgggaccatgagctggattccttttaagattgggcagcccaagaaacagattgtgcccaaaacagtggagagagactttgaaagcgactcggaccgatg

SEQ ID NO: 10518 - DNA, 203 bp, Homo sapiens
ggcgcgccagtcctgccgtctaatgaatcattgattgaccagcactattttaccagttggaatgaatgatcagaaatgggcatagtgctcttagatccaacatgtaacagatggatgttactccatgctgattacttcttcaagccagtacttttttgattgtgtaggatctttgtctcttcatctttcgactcggaccgatg

SEQ ID NO: 10519 - DNA, 203 bp, Homo sapiens
ggcgcgccagtcctaatacctacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgacgactcggaccgatg

SEQ ID NO: 10520 - DNA, 203 bp, Homo sapiens
ggcgcgccagtcctccaatttagggcttgaactgagagcctggcctcccagaaggttttaatagacctacggcacagaaattgacacagcccggaaaaggcccacaaagagaagcccaaccagccagcccccaggccgccccgccagggacccaccaatgaggcacagatggcagccgctgccgccctcgactcggaccgatg

SEQ ID NO: 10521 - DNA, 203 bp, Homo sapiens
ggcgcgccagtcctcgcaactatttcaaggcgcgcgcctcgtggtggactcaccgctagcccgcagcgctcggcttcctggtaattcttcacctcttctctcagctccctgcagcatgggtgctgggccctccttgctgctcgccgccctcctgctgcttctctccggcgacggcgccgtgcgctgcgcgactcggaccgatg

SEQ ID NO: 10522 - DNA, 203 bp, Homo sapiens
ggcgcgccagtcctggctggtcccgagggctggcctgagacgggactcccggttctcccgctgcgaagcagcgcggccccccggggccggggcagcggcgctggcatgtcgtctggcaccatgaagttcaatggctatttgagggtccgcatcggtgaggcagtggggctgcagcccacccgctggtccgactcggaccgatg

SEQ ID NO: 10523 - DNA, 203 bp, Homo sapiens
ggcgcgccagtcctacctcgtcctcttctgtctgctgtctatgagggtcatgtttcctgtgtgaaattgcttctgtcaaagggtgctgataagactgtgaagggcccagatggactgaccgcctttgaagccactgacaaccaggcaatcaaagctcttctccagtgatggatggatggactgataaccgactcggaccgatg

SEQ ID NO: 10524 - DNA, 203 bp, Homo sapiens
ggcgcgccagtcctaggacgtccttataaagacaaaatctttttctttcctggctgatgatttgtcattctagtcacttcctgccttgtgaccacacacccgggcttgacaaagctgttctgcagatcagaaagaaggggttcctggtcatacaccagtactaccaaggacagcttttttcctgcaagcgactcggaccgatg

SEQ ID NO: 10525 - DNA, 203 bp, Homo sapiens
ggcgcgccagtcctctctcatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagcgactcggaccgatg

SEQ ID NO: 10526 - DNA, 203 bp, Homo sapiens
ggcgcgccagtccttccttatcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcgcgactcggaccgatg

SEQ ID NO: 10527 - DNA, 203 bp, Homo sapiens
ggcgcgccagtcctgactactcttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatctcgactcggaccgatg

SEQ ID NO: 10528 - DNA, 203 bp, Homo sapiens
ggcgcgccagtcctccgcattcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatctcgactcggaccgatg

SEQ ID NO: 10529 - DNA, 203 bp, Homo sapiens
ggcgcgccagtcctctcagttgagaccaagggctaaagctgggaggtgagtctgtcaccttgagccgggcgagcgctgtgggccaagcaggggttgcagggtagtaggagtgcagactgaaaaaatgcagaccgccggggcattattcatttctccagctctgatccgctgttgtaccaggggtctaacgactcggaccgatg

SEQ ID NO: 10530 - DNA, 203 bp, Homo sapiens
ggcgcgccagtcctgtccgctgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgacgactcggaccgatg

SEQ ID NO: 10531 - DNA, 203 bp, Homo sapiens
ggcgcgccagtcctttgctttgcgcgaccggaaaattcgcgaaggttcctgaaacgcaacggatcgtttccggaagccggtagccgcctcagtcgtcagactggtgctagcgacacgggagtggcaaacgcatcctcttgccgttcccggtgtttgggccttgcctgtgacggtgggaaaagaaaatgcgactcggaccgatg

SEQ ID NO: 10532 - DNA, 203 bp, Homo sapiens
ggcgcgccagtcctgaatcttggaggtgggctagaggccgacgccagccagagagcgaaatgttcttttggggccagagtctgggcatatatgaatgcaaacccgtgtttgttcacaactaagcccagctgagacgatcacttttctgtaggccatttgtccaggtacagaatgagcacatgttgttgcgactcggaccgatg

SEQ ID NO: 10533 - DNA, 203 bp, Homo sapiens
ggcgcgccagtcctgggatatgggactttttggacacccagagaacaggtcccagataccgagtccgcaaccccaaacatcgcgattaataggaggcctctggtctctgcctgccctgggtgctcatggaaccagctgctgctctgcacttctccctgccagcctccctcctcctcctcctgctcctccgactcggaccgatg

SEQ ID NO: 10534 - DNA, 203 bp, Homo sapiens
ggcgcgccagtccttcatgcttgaacaaatttgatttccggagtcagtcattttactgtcaagacatttcttcggcattctgcaacagtttccaacatggccagatccatcagaaactgaagccgtggagaacgctctcggggcctttgccacttcttggagtagaagccgacagagagctgtttggacgactcggaccgatg

SEQ ID NO: 10535 - DNA, 203 bp, Homo sapiens
ggcgcgccagtcctatacctttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcccgactcggaccgatg

SEQ ID NO: 10536 - DNA, 203 bp, Homo sapiens
ggcgcgccagtcctctgtgaagaaaaactggagcctgttcttggcaagaagattctaatgccagaatttgaaagcgtgctctgggggctcctggtgctcagctggtcctgcctgcaaggcccctgctccgtgttctcccctgtgagcgccatggagcccttgggccggcagctaactagcgggccgaacgactcggaccgatg

SEQ ID NO: 10537 - DNA, 203 bp, Homo sapiens
ggcgcgccagtccttcgttataaaaaactggagcctgttcttggcaagaagattctaatgcccaggaacatggcgccctgaacaacctatctggtgctcagctggtcctgcctgcaaggcccctgctccgtgttctcccctgtgagcgccatggagcccttgggccggcagctaactagcgggccgaacgactcggaccgatg

SEQ ID NO: 10538 - DNA, 203 bp, Homo sapiens
ggcgcgccagtcctttgcgctcaaaaactggagcctgttcttggcaagcctgcgtcccgcgacaggaacatggcgctgctctgggggctcctggtgctcagctggtcctgcctgcaaggcccctgctccgtgttctcccctgtgagcgccatggagcccttgggccggcagctaactagcgggccgaacgactcggaccgatg

SEQ ID NO: 10539 - DNA, 203 bp, Homo sapiens
ggcgcgccagtcctctctctcgaaaaataataattaggcctagggaacaaatccctctcagcgaaggccgaaaagaggctagccatgccccagcacatcggttgataatgaggggggtagcaacagtggtgagttcgttggatggcttaagccctgagtacagggtagtcgtcagtggttcgacgcctcgactcggaccgatg

SEQ ID NO: 10540 - DNA, 203 bp, Homo sapiens
ggcgcgccagtcctacggattaaaaaataataattaggcctagggaacaaatccctctcagcgaaggccgaaaagaggctagccatgcccttagtaggactagcataatgaggggggttaatcgtcgttaatgttcgttggatggcttaagccctgagtacagggtagtcgtcagtggttcgacgcctcgactcggaccgatg

SEQ ID NO: 10541 - DNA, 203 bp, Homo sapiens
ggcgcgccagtcctggcagtaaaaaaattcaaattttaaaaatttccaggtctattacagagaaggcagagatcagctgtggaaaggacctggtgaactactgtggaagggagaaggacagaggccgcgtgcggtagggacagacataaaagtagtaccaagaaggaaggccaagattatcagggactcgactcggaccgatg

SEQ ID NO: 10542 - DNA, 203 bp, Homo sapiens
ggcgcgccagtcctcgatgcgcaaaaattcaaattttaaaaatttccaggtctattacagagggcatcacctagctctgtggaaaggacctggtgaactactgtggaagggagaaggagcagtcatagtcaaggtagggacagacataaaagtagtaccaagaaggaaggccaagattatcagggactcgactcggaccgatg

SEQ ID NO: 10543 - DNA, 203 bp, Homo sapiens
ggcgcgccagtccttcccacctaaaaattcaaattttaaaaatttccataagacacttgtgaaaggcagagatcagctgtggaaaggacctggtgaactactgtggaagggagaaggagcagtcatagtcaaggtagggacagacataaaagtagtaccaagaaggaaggccaagattatcagggactcgactcggaccgatg

SEQ ID NO: 10544 - DNA, 203 bp, Homo sapiens
ggcgcgccagtcctcggcgtgaaaaacgcgtataaattaagttacaaaaaaacatgggacaagtgaaaatgtctcttcaagggattcacctgagtgatctatcatacaagcatgctatattaaaagagtctcagtatacaataaagagagatgtaggcacaacaacagcagtgatcaagcttcatacccgactcggaccgatg

SEQ ID NO: 10545 - DNA, 203 bp, Homo sapiens
ggcgcgccagtcctcagggtgcaaaacgcgtataaattaagttacaaaaaaacatgggacaagtgaaaatgtctcttcaagggattcacctgagtgatctatcatacaagcatgctatattaaaagagtctcgcctgcgccggcgtagagatgtaggcacaacaacagcagtgacaccctcatcattgcgactcggaccgatg

SEQ ID NO: 10546 - DNA, 203 bp, Homo sapiens
ggcgcgccagtcctactatgacaaaagacgcagtcgacaagaacagtttcgactcggaagcttgcttaacgtagtgctgacagttttttattagagagcagatctctgatgaacaaccaacggaagaagacgggaaaaccgtctatcaatatgctgaaacgcgtgagaaaccgtgtgtcaactggatccgactcggaccgatg

SEQ ID NO: 10547 - DNA, 203 bp, Homo sapiens
ggcgcgccagtcctccttatctaaaaggagtagtaagtatgggcctaatgtgtgacctgcaggcattttgtgaaaagggtaaagtatgaaagctactctcagaaaagtacttatgtattgatgagagccttaaaatgactttatattcacaaaactgctggaagacaatgatctggggtatcacattccgactcggaccgatg

SEQ ID NO: 10548 - DNA, 203 bp, Homo sapiens
ggcgcgccagtcctccgaacttaaaaggagtagtggtctaatatagtctgtgtgacctgcaggcattttgtgaaaagggtaaagtatgaaagctactctcagaaaagtacttatgtatgccgatcttaggggaaatgactttatattcacaaaactgctggaagacaatgatctggggtatcacattccgactcggaccgatg

SEQ ID NO: 10549 - DNA, 203 bp, Homo sapiens
ggcgcgccagtcctttagttcaaaaaggagtagtggtctaatatagtctgtgtgacctgcaggcattttgtgaaaagggtaaagtatgaaagctactctcagaaaagtacttatgtattgatgagagccttaaaatgactttatatggtgtgttgctgcagaagacaatgatctggggtatcacattccgactcggaccgatg

SEQ ID NO: 10550 - DNA, 203 bp, Homo sapiens
ggcgcgccagtcctcgggtttgaaaattcttctggccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtccgactcggaccgatg

SEQ ID NO: 10551 - DNA, 203 bp, Homo sapiens
ggcgcgccagtcctagtcgaggaaacaacacctcacatcaatagaaggtgaatgtgtgcgggtttaataaaaaaagaaaagaagttaagtaaaatttaaaggacacaatagagaaaatctaggtccgaaagcttgcctctcagacagatcccaaaatcatagtccaaaccccaaacacagcagcagaccgactcggaccgatg

SEQ ID NO: 10552 - DNA, 203 bp, Homo sapiens
ggcgcgccagtcctgcaattccaaaccaagtttaaagaaaacttaaaaaggtctcccggcccaaccaagtttaaagaaaacttaaaatcaagaaaacttaaaaccaagtttaaagaaaactcaaaatcaagaaaacttaaagccaaaataagctagaaaactaaaagacatcatggcagtcccacaaccgactcggaccgatg

SEQ ID NO: 10553 - DNA, 203 bp, Homo sapiens
ggcgcgccagtcctccttcctaaaaccaagtttaaagaaaacttaaaatcaagaaaacttaatgatctaagcgtgaaaaacttaaaatcaagaaaacttaaaaccaagtttaaagaaaactcaaaatcaagaaaacttaaagccaaaataagctagaaaactaaaagacatcatggcagtcccacaaccgactcggaccgatg

SEQ ID NO: 10554 - DNA, 203 bp, Homo sapiens
ggcgcgccagtcctcgagcccgaaacccatctggagcctcagatcatcccaagtcattgttcatcagatctagtactcaaataagttaataaaaatatccacatggggcaaataatcattggaggaaatccaactaatcacaatatctgtcaacatagacgttggcgatgtagtggcaaaatcaaccacgactcggaccgatg

SEQ ID NO: 10555 - DNA, 203 bp, Homo sapiens
ggcgcgccagtcctgcttgaggaaacccatctggagcctcagatcatcccaagtcattgttcccagccggatccggtcaaataagttaataaaaatatccacatggggcaaataatcattggaggaaatccaactaatcacaatatctgtcaacatagacaagtcaacacgccaggcaaaatcaaccacgactcggaccgatg

SEQ ID NO: 10556 - DNA, 203 bp, Homo sapiens
ggcgcgccagtcctcacatgtaaaacccatctggagcctcagatcatcgatgtagtaaaccgatcagatctagtactcaaataagttaataaaaatatccacatggggcaaataatcattggaggaaatccaactaatcacaatatctgtcaacatagacaagtcaacacgccaggcaaaatcaaccacgactcggaccgatg

SEQ ID NO: 10557 - DNA, 203 bp, Homo sapiens
ggcgcgccagtccttccacgtgaaacccatctggtatacggctatgaaccaagtcattgttcatcagatctagtactcaaataagttaataaaaatatccacatggggcaaataatcattggaggaaatccaactaatcacaatatctgtcaacatagacaagtcaacacgccaggcaaaatcaaccacgactcggaccgatg

SEQ ID NO: 10558 - DNA, 203 bp, Homo sapiens
ggcgcgccagtcctcccttcgtaaacctttagcacgtgacgcggtgcctggcgccgagcctcccaagatggcggtgtgcatcgcggtgattgccaaggagaatcctaatgtctacattcgcagcacccctacggagaacgagctgaagttccactacatggtgcacacatctctggacgtggtggatgcgactcggaccgatg

SEQ ID NO: 10559 - DNA, 203 bp, Homo sapiens
ggcgcgccagtcctgcctaagcaaacctttagcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgcgactcggaccgatg

SEQ ID NO: 10560 - DNA, 203 bp, Homo sapiens
ggcgcgccagtcctacggttataaacggagggacgcagttccacttatagctccctgggtggtctaagtcctgagtacaggacagtcgtcagtagttcgacgtgagcagaagcccacctcgagatgctacgtggacgagggcatgccaagacacaccttaaccctagcgggggtcgctagggtgaaatcgactcggaccgatg

SEQ ID NO: 10561 - DNA, 203 bp, Homo sapiens
ggcgcgccagtccttgctcaaaaaacggagggactagccatagtggcgagctccctgggtggatctttaaacccacacaggacagtcgtcagtagttcgacgtgagcagaagcccacctcgagatgctacgtggacgagggcatgccaagacacaccttaaccctagcgggggtcgctagggtgaaatcgactcggaccgatg

SEQ ID NO: 10562 - DNA, 203 bp, Homo sapiens
ggcgcgccagtcctgcgatgcaaaacggagggactagccatagtggcgagctccctgggtggtctaagtcctgagtacaggacagtcgtcagtagttcgacgtgagcagaagcccacctcgagatgctacgtggacgagggcatgccaagacacaccttaaccctagcgggggtgagcccccaaggcccgactcggaccgatg

SEQ ID NO: 10563 - DNA, 203 bp, Homo sapiens
ggcgcgccagtcctccaaccagaaacggagggactagccatagtggcgagctccctgggtggtctaagtcctgagtacaggacagtcgtcagtagttcgacgtgtaggccccatggagtcgagatgctacgtggacgagggcatgccaagacacaccttaaccctagcgggggtcgctagggtgaaatcgactcggaccgatg

SEQ ID NO: 10564 - DNA, 203 bp, Homo sapiens
ggcgcgccagtcctaggccaagaaacggagggactagccatagtggcgagctccctgggtggtctaagtcctgagtacaggacagtcgtctccctcggagacatagcagaagcccacctcgagatgctacgtggacgagggcatgccaagacacaccttaaccctagcgggggtcgctagggtgaaatcgactcggaccgatg

SEQ ID NO: 10565 - DNA, 203 bp, Homo sapiens
ggcgcgccagtcctcgttctacaaacggagggactagccatagtggcgtcgctagcataacttctaagtcctgagtacaggacagtcgtcagtagttcgacgtgagcagaagcccacctcgagatgctacgtggacgagggcatgccaagacacaccttaaccctagcgggggtcgctagggtgaaatcgactcggaccgatg

SEQ ID NO: 10566 - DNA, 203 bp, Homo sapiens
ggcgcgccagtcctgtcgatccaaacgtgcctttttagataagttagatgttaatagtggttcgcgcaacacgccgaagtctaaagttggtaactatcgtttaccgtctagtaaacctagtggtatggatactgccttgttaagagcttaaatctaaactattaggatgtcttatactcccggtcattcgactcggaccgatg

SEQ ID NO: 10567 - DNA, 203 bp, Homo sapiens
ggcgcgccagtcctgagtacctaaacgtgcctttttagataagttagatgttaatagtggttttgctgtttttgttaagtctaaagttggtaactatcgtttaccgtctagtaaacctagtggtatggatactgccttgttaagagcttaaatctaaactccatactctaggactactcccggtcattcgactcggaccgatg

SEQ ID NO: 10568 - DNA, 203 bp, Homo sapiens
ggcgcgccagtcctttcgctttaaactacggattgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgcccgactcggaccgatg

SEQ ID NO: 10569 - DNA, 203 bp, Homo sapiens
ggcgcgccagtcctacgtcaggaaagcgccgagccgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcgactcggaccgatg

SEQ ID NO: 10570 - DNA, 203 bp, Homo sapiens
ggcgcgccagtcctacctatgaaaaggcccagggaggctgaatgaatgtatttcaccagtagcaaatgagatgaaccatcttcctgcacacagccacgatttgcaaaggtttttggagaggaataaatttaatgaaagatgtacatacagcaggcgcgacataagcagtgctgggtaaaattaaacaccgactcggaccgatg

SEQ ID NO: 10571 - DNA, 203 bp, Homo sapiens
ggcgcgccagtcctttacaatgaaaggcccaggggtaggcttaacgcctatttcaccagtagcaaatgagatgaaccatcttcctgcacacagccacgatttgcaaaggtttttggagaggaataaatttaatgaaagatgtacatgacttctaaaaactataagcagtgctgggtaaaattaaacaccgactcggaccgatg

SEQ ID NO: 10572 - DNA, 203 bp, Homo sapiens
ggcgcgccagtcctgtaccgttaaagtattccacgacaaaaccaaattcacgcattatctctccacgaatccagcccttcaaaggataataacagaaaaaaaccaatacaagaacgggaacaacgccctagaaaaaacaagaaggtgcggtgatgctttccctaaaagaagacagccacaagaacagacgactcggaccgatg

SEQ ID NO: 10573 - DNA, 203 bp, Homo sapiens
ggcgcgccagtccttcgtagccaaagtattccacgacaaaaccaaattggattccctcactaccacgaatccagcccttcaaaggataataacagaaaaaaaccaatacaagaacgggaacaacgccctagaaaaaacaagaaggtaatccctcaacaaacctaaaagaagacagccacaagaacagacgactcggaccgatg

SEQ ID NO: 10574 - DNA, 203 bp, Homo sapiens
ggcgcgccagtccttgggctcgaaatcaaaagataataacaattggctctgtctctctcaccattgcaacagtatgcttcctcatgcagattgccatcctggtaactactgtgacattgcattttaagcaacatgagtgcgactcccccgcgagcaaccattagggctgcctcaaaccaataataatacgactcggaccgatg

SEQ ID NO: 10575 - DNA, 203 bp, Homo sapiens
ggcgcgccagtcctcttataccaaatgaaaagagcaggctagcgtttggactgttttgtttttggcggaactaccgggcaggaagattgcacaagtcagggggcgtttccaatcgggtgtcaattttggatctccccccccccacccccctttggatcttgtcgggctttccacgtttcacttaaaaacgactcggaccgatg

SEQ ID NO: 10576 - DNA, 203 bp, Homo sapiens
ggcgcgccagtcctccgcaggtaaatgcgtacaacaaacttgcgtaaaccaaaaaaatggggcaaataagaatttgataagtaccacttaaatttaactcccttggttagagatgggcagcaattcattgagtatgataaaagttatgcacgcttgaccctttgacaatgatgaagtagcattgttaacgactcggaccgatg

SEQ ID NO: 10577 - DNA, 203 bp, Homo sapiens
ggcgcgccagtccttggttcaaaaatgcgtacaacaaacttgcgtaaagtgttgttgaacaccaaataagaatttgataagtaccacttaaatttaactcccttggttagagatgggcagcaattcattgagtatgataaaagttagattacaaaatttgtttgacaatgatgaagtagcattgttaacgactcggaccgatg

SEQ ID NO: 10578 - DNA, 203 bp, Homo sapiens
ggcgcgccagtcctcacgcctcaaatgcgtacaatcggtgaataagctccaaaaaaatggggcaaataagaatttgataagtaccacttaaatttaactcccttggttagagatgggcagcaattcattgagtatgataaaagttagattacaaaatttgtttgacaatgatgaagtagcattgttaacgactcggaccgatg

SEQ ID NO: 10579 - DNA, 203 bp, Homo sapiens
ggcgcgccagtcctgtcgcagcaaatgcgtactacaaacttgcacattcggaaaaaatggggcaaataagaatttgataagtgctatttaagtctaaccttttcaatcagaaatggggtgcaattcactgagcatgataaaggttagattacaaaatttatttgacaatgacgattagcacgaaagcgcgactcggaccgatg

SEQ ID NO: 10580 - DNA, 203 bp, Homo sapiens
ggcgcgccagtcctattcagggaaatgcttctctagataatgcttaaaggaccctgcagcagttcttggtattggacatagcatctcagcacaccgtcttaatcccgtgactaccagatttgactcatttgtgattccttcgagaatctcccatgatttgcaatggttacatgaatgtttgggaaggacgactcggaccgatg

SEQ ID NO: 10581 - DNA, 203 bp, Homo sapiens
ggcgcgccagtccttctagttgaaatgttaggagccggctcctgcgtcgctccggaagcctgcgagttccggaagccttggtaatccagattcggctaggaaaagacaagctttccagagaatgtttcagagaaagttacgtggagcgtgggcgtttcgcagactcctaagagaccttcagagaagaccgactcggaccgatg

SEQ ID NO: 10582 - DNA, 203 bp, Homo sapiens
ggcgcgccagtcctcaactgacaaattccagttgttagtcgaatccaacaagctgagtaaaagggatttcaggcctttgaatcgctatacatcttgctaaccgaacctctccactcagtccctctagacaataaagtccgagatgtcctaaagtcaacatgaaaaaaacaggcaacaccactgataaacgactcggaccgatg

SEQ ID NO: 10583 - DNA, 203 bp, Homo sapiens
ggcgcgccagtccttgagcgtgaaattccagttgttagtcgaatccaacaagctgagtaaaatcatgcaagatgacttgaatcgctatacatcttgctaaccgaacctctccactcagtccctctagacaataaagtccgagatgtcctaaagtcaacatgaaaaaaacaggcaacaccactgataaacgactcggaccgatg

SEQ ID NO: 10584 - DNA, 203 bp, Homo sapiens
ggcgcgccagtcctgactaataaaattctgatgcagaacgtatcagtgaaactccctcccactgtctcttgtattagcatcaaggaagcgagaaaaaataagcaccctgagaatggagacagtgtttgaagagatggatgaagaaagcacaggaggagttaggcggattttttcagaaatagtccttgcgactcggaccgatg

SEQ ID NO: 10585 - DNA, 203 bp, Homo sapiens
ggcgcgccagtccttttcgtccaaattctgatgcagaacgtatcagtgaaactccctcccactgtctcttgtattagcatcaaggaagcgagaaaaaataagcaccctgagaatggagacagtgtttgaagagatggatgaagaaagcacaggaggagtttcatcttcgaaagaagaaatagtccttgcgactcggaccgatg

SEQ ID NO: 10586 - DNA, 203 bp, Homo sapiens
ggcgcgccagtcctatcctaagaaattctgatgcagaacgtatcagtgaaactccctcccactgtctcttgtattagcatcaaggaagcgagaaaaaataagcaccctgagaatggagacagtgtttgaagagatggatgaagaaagcacaggaggagtttcatcttcgaaagatccccacaggtgcacgactcggaccgatg

SEQ ID NO: 10587 - DNA, 203 bp, Homo sapiens
ggcgcgccagtcctcctcgcaaaacaaagaagtacttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaacgactcggaccgatg

SEQ ID NO: 10588 - DNA, 203 bp, Homo sapiens
ggcgcgccagtccttagtttctaacaacatagattcaagacttgattgatgcaattcaaaattttctacaacatctaggtattactgatgatatatacacaatatatatattagtgtcataacactcaatcctaatgcttaccacatcatcaaactattaactcaaacaattcaagccatgggacaaacgactcggaccgatg

SEQ ID NO: 10589 - DNA, 203 bp, Homo sapiens
ggcgcgccagtcctggccaaataacaagggatgtcagcaagctacacaaagtatagatatttccaatgcgacggggaagctatatttacacatttcaagagagggtgcacttgctggggggaggacatgggccgggaaggattggaagaccaaggacctccccctcctccccctccaggtctagtctacgactcggaccgatg

SEQ ID NO: 10590 - DNA, 203 bp, Homo sapiens
ggcgcgccagtcctaccgcacaaacaagggatgtcagcaagctacacaaagtatagatatttgtgcctaatgcaaaaagctatatttacacatttcaagagagggtgcacttgctggggggaggacatgggccgggaaggattggagttatcgtacaggacccctcctccccctccaggtctagtctacgactcggaccgatg

SEQ ID NO: 10591 - DNA, 203 bp, Homo sapiens
ggcgcgccagtcctcttgacagaacaagggatgttgcggcatccatataagtatagatatttgtgcctaatgcaaaaagctatatttacacatttcaagagagggtgcacttgctggggggaggacatgggccgggaaggattggaagaccaaggacctccccctcctccccctccaggtctagtctacgactcggaccgatg

SEQ ID NO: 10592 - DNA, 203 bp, Homo sapiens
ggcgcgccagtcctcccggaacaaccgcgtctccttagcttgccttaagcagtctttatatcttctgtatattattttaaagtttataggagcaaagttcgctttactcgcaatagctattttatttattttaggaatattatcacctcgtaattatttaattataacattagctttatctatttatacgactcggaccgatg

SEQ ID NO: 10593 - DNA, 203 bp, Homo sapiens
ggcgcgccagtcctgcgcaacgaaccggtacctaatgtgtatgtgtatatatgtatgtgtgtgtatgtatatgtgtgtgtatgtgtatgtgtgtgtgtatgtgtgtgtgtatgtatgtatgtatgtatatgtattatacacatatacacatattggtttttttaatcatttgagagttagttgaagatcgactcggaccgatg

SEQ ID NO: 10594 - DNA, 203 bp, Homo sapiens
ggcgcgccagtcctaaggcatgaaccttcggggacctcccacctgcattgctctacaatctgtggcctcagcccttgccaactctgcctcttcccccgctgactgggcctctgcagagatgtgggcagctggtcaggatggccattcgggctcagcacagcaacgcagcccagactcagactggggaacgactcggaccgatg

SEQ ID NO: 10595 - DNA, 203 bp, Homo sapiens
ggcgcgccagtcctgtggcttaaacgctactgcactgcctcccctctcctgtattgaaagcgtttgtgttcatcttatcagggacctgaccctaagagaatccttcccctgccaaggcagttccagcccccagaactcatcaccccatctcctgaggtggttcctatcctccctctcttctcctcgcccgactcggaccgatg

SEQ ID NO: 10596 - DNA, 203 bp, Homo sapiens
ggcgcgccagtcctcgtgcagtaacggcgagggatctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggacgactcggaccgatg

SEQ ID NO: 10597 - DNA, 203 bp, Homo sapiens
ggcgcgccagtcctcgcaaagcaacggtcactctgaaaacagggtgggagagctgcctctctttgaacctctcccactctagtggactgaccagggaggcaaacttggtcgatgtaagcggtggcttggagacagaatcatctaatggaaaagatacactagaaggtgctggggatacatcagaggtgcgactcggaccgatg

SEQ ID NO: 10598 - DNA, 203 bp, Homo sapiens
ggcgcgccagtccttccaatttaacggtcactctgaaaacagggtgggagagctgcctctctttgaacctctcccaggaccaactctaacccagggaggcaaacttggtcgatgtaagcggtggcttggagaacctcagtcagtcaggaaaagatacactagaaggtgctggggatacatcagaggtgcgactcggaccgatg

SEQ ID NO: 10599 - DNA, 203 bp, Homo sapiens
ggcgcgccagtcctttatttataacggtcactctgaaaacagggtgggagagctgcctctctttgaacctctcccaggaccaactctaacccagggaggcaaacttggtcgatgtaagcggtggcttggagaagagtagcaaactcggaaaagatacactagaaggtgctggggatacatcagaggtgcgactcggaccgatg

SEQ ID NO: 10600 - DNA, 203 bp, Homo sapiens
ggcgcgccagtccttatctcgcaacggtcactctgaaaacagggtgggagagctgcctctctttgaacctctcccaggaccaactctaacccagggaggcaaacttggtcgatgtaagcggtggcttggagacagaatcatctaatggaaaagatacactgcgccaccagtcacatacatcagaggtgcgactcggaccgatg

SEQ ID NO: 10601 - DNA, 203 bp, Homo sapiens
ggcgcgccagtcctgaccatgtaacggtcactctgaaaacagggtgggagagctgcctctctttgaacctctcccaggaccaactctaacggtcctcaagtccattggtcgatgtaagcggtggcttggagacagaatcatctaatggaaaagatacactagaaggtgctggggatacatcagaggtgcgactcggaccgatg

SEQ ID NO: 10602 - DNA, 203 bp, Homo sapiens
ggcgcgccagtcctgccgcgggaacggtcactctgaaaacagggtggggattgcttagtatcttgaacctctcccaggaccaactctaacccagggaggcaaacttggtcgatgtaagcggtggcttggagacagaatcatctaatggaaaagatacactagaaggtgctggggatacatcagaggtgcgactcggaccgatg

SEQ ID NO: 10603 - DNA, 203 bp, Homo sapiens
ggcgcgccagtccttcgccaataactattatctcgcctgcacgcccgcctcgcgtcccgggggggtcccgcctcccaccccgcctctggacttgtctctttccccgcgcgcgcggacagagccggcgtttaggcccgagcgagcccgggggccgccggccgggaagacaacgcgggcaccgattcgcccgactcggaccgatg

SEQ ID NO: 10604 - DNA, 203 bp, Homo sapiens
ggcgcgccagtccttcacccgcaactcgaccgaggcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtggcgactcggaccgatg

SEQ ID NO: 10605 - DNA, 203 bp, Homo sapiens
ggcgcgccagtcctgtactttgaagaacaaaagcaaaaacaaaaacaagaacaaaaaagggaagaaaaacaaaagtatacacaaaaaccaaaaaagaaaaaaggccagagacaaaaacggaggcaagaacaaaaatttaaacaaaaacagaatttaaattcataataaacaccaagatagagacaaaacgactcggaccgatg

SEQ ID NO: 10606 - DNA, 203 bp, Homo sapiens
ggcgcgccagtcctgcagcctgaagaacaaaagcaaaaacaaaaacaagaacaaaaaagggactctttcagggtaaatacacaaaaaccaaaaaagaaaaaaggccagagacaaaaacggaggcaagaacaaaaatttaaacaaaaacagaatttaaattcataataaacaccaagatagagacaaaacgactcggaccgatg

SEQ ID NO: 10607 - DNA, 203 bp, Homo sapiens
ggcgcgccagtcctgtgatctcaagacaaaaaccattcaacgccggagacgacttgtcttaacagtggatgcattgagtggattgactgtcagggctgtctttaggcttaattccagacctctctgtgcttagggcaaacatcatttggccttaaatgggattctgtgagaggggatccctccattgacgactcggaccgatg

SEQ ID NO: 10608 - DNA, 203 bp, Homo sapiens
ggcgcgccagtcctgcccgtgaaagacaaaaaccattcaacgccggaggactgactctcatccagtggatgcattgagtggattgactgtacatctaaagcgggggcttaattccagacctctctgtgcttagggcaaacatcatttggccttaaatgggattctgtgagaggggatccctccattgacgactcggaccgatg

SEQ ID NO: 10609 - DNA, 203 bp, Homo sapiens
ggcgcgccagtcctgcgtgtaaaagacaaaaaccattcaacgccggaggactgactctcatccagtggatgcattgagtggattgactgtcagggctgtctttaggcttaattccagacctctctgtgcttattaacctgccgccgtggccttaaatgggattctgtgagaggggatccctccattgacgactcggaccgatg

SEQ ID NO: 10610 - DNA, 203 bp, Homo sapiens
ggcgcgccagtcctctcgttgtaagacaaaaaccattcaacgccggaggactgactctcatcggacttgatatgatagtggattgactgtcagggctgtctttaggcttaattccagacctctctgtgcttagggcaaacatcatttggccttaaatgggattctgtgagaggggatccctccattgacgactcggaccgatg

SEQ ID NO: 10611 - DNA, 203 bp, Homo sapiens
ggcgcgccagtccttcagaagaaagacaaaaacccaagtcgcatcctagactgactctcatccagtggatgcattgagtggattgactgtcagggctgtctttaggcttaattccagacctctctgtgcttagggcaaacatcatttggccttaaatgggattctgtgagaggggatccctccattgacgactcggaccgatg

SEQ ID NO: 10612 - DNA, 203 bp, Homo sapiens
ggcgcgccagtcctatcttagcaagatgcggcatatcattctcaaattcttaggacggtcgggccctggaaggaacgctctcggaattggccgcggaaaccgatctgcccgttgtgtttgtgaaacagagaaagataggcggccatggtccaaccttgaaggaggcagcccaatatggcaagaaggtgcgactcggaccgatg

SEQ ID NO: 10613 - DNA, 203 bp, Homo sapiens
ggcgcgccagtcctctgtgggcaagattgcgtggccgaccgaatcgtgtgaattcccagcgctttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 10614 - DNA, 203 bp, Homo sapiens
ggcgcgccagtccttggactgaaagattgcgtgggttctgcctaaagccatgacaagcctcttttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 10615 - DNA, 203 bp, Homo sapiens
ggcgcgccagtccttctaacgaaagattgcgtgggttctgcctaaagctgaattcccagcgctttggcttctctgagttggggttgtgtactctatggggactgcagttccggaaccagccagcagcctttaattcttgggcggaccacggccggttctgtgttcttggctaagatgagcagccaccacgactcggaccgatg

SEQ ID NO: 10616 - DNA, 203 bp, Homo sapiens
ggcgcgccagtcctgcagattcaagattgcgtgggttctgcctaaagctgaattcccagcgctttggcttctctgagttggggttgtgtataggggtcttcgaacagttccggaaccagccagcagcctttaattcttgggcggacattaattctgcgaatgttcttggctaagatgagcagccaccacgactcggaccgatg

SEQ ID NO: 10617 - DNA, 203 bp, Homo sapiens
ggcgcgccagtcctggctttcaaagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 10618 - DNA, 203 bp, Homo sapiens
ggcgcgccagtcctgctctataaagattgcgtgggttctgcctaaagctgaattcccagcgctttggcttctctgagttggggttgtgtataggggtcttcgaacagttccggaaccagccagcagcctttacacgactttttcgacacggccggttctgtgttcttggctaagatgagcagccaccacgactcggaccgatg

SEQ ID NO: 10619 - DNA, 203 bp, Homo sapiens
ggcgcgccagtcctggcggtgtaagattgcgtgggttctgcctaaagctgaattcccagcgctttggcttctctgagttggggttgtgtataggggtcttcgaagtcagttcctcgtcgccagcagcctttaattcttgggcggaccacggccggttctgtgttcttggctaagatgagcagccaccacgactcggaccgatg

SEQ ID NO: 10620 - DNA, 203 bp, Homo sapiens
ggcgcgccagtccttgcgtatcaagatttcatttgccaaccgctccgctgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaaccgactcggaccgatg

SEQ ID NO: 10621 - DNA, 203 bp, Homo sapiens
ggcgcgccagtcctaaatttagaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagagttcacactagaagcgactcggaccgatg

SEQ ID NO: 10622 - DNA, 203 bp, Homo sapiens
ggcgcgccagtcctactaatcgaagcaattactcaaaaacggagaaaacatcagctgatgcgtgccctactctcccacccctttatatagttccttcagtatttacttgaggcagacaggaagacttctgaagaacaaatcagcctggtcaccagcttttgcccttgagtagatcacagagggcagtccgactcggaccgatg

SEQ ID NO: 10623 - DNA, 203 bp, Homo sapiens
ggcgcgccagtcctgcgttaccaagcccaacacgacgcatcagatgaccaattcagttcactggtgcaatgagggtattggggctttttgaacgtgggaataacttgaatttcgcagatacctacgtatatacatggaaccaacagtactcgtatcatgaaaatgcattcctaatttcaaatcaagtacgactcggaccgatg

SEQ ID NO: 10624 - DNA, 203 bp, Homo sapiens
ggcgcgccagtcctccatgtttaagcccaacacgcaatgcgtttattgcaattcagttcactggtgcaatgagggtattggggctttttgaacgtgggaataacttgaatttcgcagagttgcttcaggtatcatggaaccaacagtactcgtatcatgaaaatgcattcctaatttcaaatcaagtacgactcggaccgatg

SEQ ID NO: 10625 - DNA, 203 bp, Homo sapiens
ggcgcgccagtcctaagtctgaaagcccaacacgcaatgcgtttattgcaattcagttcactggtgcaatgagggtattggggctttttgaacgtgggaataacttgaatttcgcagatacctacgtatatacatggaaccaacagggtgacatagcctcaaatgcattcctaatttcaaatcaagtacgactcggaccgatg

SEQ ID NO: 10626 - DNA, 203 bp, Homo sapiens
ggcgcgccagtcctagtctacaaagcccaacacgcaatgcgtttattgcaattcagttcactggtgcaatgagggtattggggctttttgaacgtgggaataacttgaatttcgcagatacctacgtatatacatggaaccaacagtactcgtatcatgaaaatgcattcctaatttcaaatcaagtacgactcggaccgatg

SEQ ID NO: 10627 - DNA, 203 bp, Homo sapiens
ggcgcgccagtcctactgccctaagcccaacacgcaatgcgtttattgcaattcagttcactggtgcaatgagggtattggggctttttgaacgtgggaataacttgaatttcgcagatacctacgtatatacatggaaccaacagtactcgtatcatgactcctggagagcggtttcaaatcaagtacgactcggaccgatg

SEQ ID NO: 10628 - DNA, 203 bp, Homo sapiens
ggcgcgccagtcctaaggagcgaagcccaacacgcaatgcgtttattgtttgaagtggggtaggtgcaatgagggtattggggctttttgaacgtgggaataacttgaatttcgcagatacctacgtatatacatggaaccaacagtactcgtatcatgaaaatgcattcctaatttcaaatcaagtacgactcggaccgatg

SEQ ID NO: 10629 - DNA, 203 bp, Homo sapiens
ggcgcgccagtcctggacccataagcccacctcgagatgctacgtggaacgacaatgagacggacacaccttaaccctagcgggggtcgctagggtgaaatcacaccacgtgatgggagtacgacctgatagggcgctgcagaggcccactattaggctagtataaaaatctctgctgtacatggcaccgactcggaccgatg

SEQ ID NO: 10630 - DNA, 203 bp, Homo sapiens
ggcgcgccagtcctgtcattctaagcccacctcgagatgctacgtggacgagggcatgccaagacacaccttaaccctagcgggggtcgccttctaccgtggggaccacgtgatgggagtacgacctgatagggcgctgcagaggcccactattaggctagtataaaaatctctgctgtacatggcaccgactcggaccgatg

SEQ ID NO: 10631 - DNA, 203 bp, Homo sapiens
ggcgcgccagtcctgaattccgaagcccacctcgagatgctacgtggacgagggcatgccaagacacaccttaaccctagcgggggtcgctagggtgaaatcacaccacgtgatgggagtacgacctgatagacatgccattcctaccactattaggctagtataaaaatctctgctgtacatggcaccgactcggaccgatg

SEQ ID NO: 10632 - DNA, 203 bp, Homo sapiens
ggcgcgccagtcctcggatcgcaagcccacctcgagatgctacgtggacgagggcatgccaagacacaccttaaccctagcgggggtcgctagggtgaaatcacaccacgtgatgggagtacgacctgatagggcgctgcagaggcagcagtaagtctcggtataaaaatctctgctgtacatggcaccgactcggaccgatg

SEQ ID NO: 10633 - DNA, 203 bp, Homo sapiens
ggcgcgccagtcctacttcgaaaagcccacctcgagatgctacgtggacgagggcatgccaagacacaccttaaccctagcgggggtcgctagggtgaaatcacaccacgtgatgggagtacgacctgatagggcgctgcagaggcccactattaggctacataccctgcaatcgctgtacatggcaccgactcggaccgatg

SEQ ID NO: 10634 - DNA, 203 bp, Homo sapiens
ggcgcgccagtcctggatgggaaagcccacctcgagatgctacgtggacgagggcatgccaagacacaccttaaccctagcgggggtcgctagggtgaaatcacaccacgtgatgggataggcggtaagcgaggcgctgcagaggcccactattaggctagtataaaaatctctgctgtacatggcaccgactcggaccgatg

SEQ ID NO: 10635 - DNA, 203 bp, Homo sapiens
ggcgcgccagtcctacgctttcaagcccacctcgagatgctacgtggacgagggcatgccaatggcataacacttactagcgggggtcgctagggtgaaatcacaccacgtgatgggagtacgacctgatagggcgctgcagaggcccactattaggctagtataaaaatctctgctgtacatggcaccgactcggaccgatg

SEQ ID NO: 10636 - DNA, 203 bp, Homo sapiens
ggcgcgccagtcctaatcacttaagcggcagcgcatagacgaaagaacggtggcaggaggctgcgaggagccggcgcggtcgcagtctccacggcgcaggcccacggtagcgcagccgctctgagaacttcatggaggaacacggagtgacccaaaccgaacatatggctaccatagaagcacatgcacgactcggaccgatg

SEQ ID NO: 10637 - DNA, 203 bp, Homo sapiens
ggcgcgccagtcctcttactagaagcggcagcgctcgccattgccgctggtggcaggaggctgcgaggagccggcggatagaggactgatacggcgcaggcccacggtagcgcagccgctctgagaacttcatggaggaacacggagtgacccaaaccgaacatatggctaccatagaagcacatgcacgactcggaccgatg

SEQ ID NO: 10638 - DNA, 203 bp, Homo sapiens
ggcgcgccagtcctccattagcaagctggggccgccaggagtgcgatcgcctgcggatctgcagctgggcaccggccgcaacgcccgccccgcgacggcagggaataaaggctcagggaccggcagttctactctagagcccaccagcctctcagagcctccggtgactggcctgtgtctccccctggcgactcggaccgatg

SEQ ID NO: 10639 - DNA, 203 bp, Homo sapiens
ggcgcgccagtcctctatacaaaagctggggccgccaggagtgcgatcgcctgcggatctgcagctgggcaccggccgcaacgcccgccccgcgacggcagggaataaaggctcagggaccggcagttctactctagagcccaccataaatagctcttgcccggtgactggcctgtgtctccccctggcgactcggaccgatg

SEQ ID NO: 10640 - DNA, 203 bp, Homo sapiens
ggcgcgccagtcctaacgcggcaagctggggccgccaggagtgcgatcgcctgcggatctgcagctgggcaccggccgcaacgcccgccccgcgacggcagggaataaaggctcagggtttacagcctctactctagagcccaccagcctctcagagcctccggtgactggcctgtgtctccccctggcgactcggaccgatg

SEQ ID NO: 10641 - DNA, 203 bp, Homo sapiens
ggcgcgccagtcctcccatttgaagctggggccgccaggagtgcgatcgcctgcggatctgcagctgggctagctttctaacgcccgccccgcgacggcagggaataaaggctcagggtttacagcctctactctagagcccaccagcctctcagagcctccggtgactggcctgtgtctccccctggcgactcggaccgatg

SEQ ID NO: 10642 - DNA, 203 bp, Homo sapiens
ggcgcgccagtcctaatctttaaagctggggccggaccactgcgtcatgcctgcggatctgcagctgggcaccggccgcaacgcccgccccgcgacggcagggaataaaggctcagggaccggcagttctactctagagcccaccagcctctcagagcctccggtgactggcctgtgtctccccctggcgactcggaccgatg

SEQ ID NO: 10643 - DNA, 203 bp, Homo sapiens
ggcgcgccagtccttggagtagaaggagccaacgatcttgccaagttccaccagatgctgatgaagataataatgaagtagctacagctcaacttacctgccaaccccatgccagtcgacctaattagtacaacctaaatccattactctcttagcgtcggcaaagtgattgcctcctaagttccacacgactcggaccgatg

SEQ ID NO: 10644 - DNA, 203 bp, Homo sapiens
ggcgcgccagtcctgagaaagaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacacgactcggaccgatg

SEQ ID NO: 10645 - DNA, 203 bp, Homo sapiens
ggcgcgccagtcctcgcactgtaaggagccaacgatcttgccaagttccaccagatgctgatgaagataataatgagccgttatttaggaaacttacctgccaaccccatgccagtcgacctaattagtacaacctaaatccattataaaaaacttaggagcaaagtgattgcctcctaagttccacacgactcggaccgatg

SEQ ID NO: 10646 - DNA, 203 bp, Homo sapiens
ggcgcgccagtccttacataacaaggagccaacgcgtggagttgtgcgcaccagatgctgatgaagataataatgaagtagctacagctcaacttacctgccaaccccatgccagtcgacctaattagtacaacctaaatccattataaaaaacttaggagcaaagtgattgcctcctaagttccacacgactcggaccgatg

SEQ ID NO: 10647 - DNA, 203 bp, Homo sapiens
ggcgcgccagtccttcagtgccaaggagccagggagtacttagccggagtggggcagcaccgctccttgggtccccactccccatttctcattgcttggaaatccatgccaagatgcctgccttccttggtctaaagtgtctggggaaattgtgcagctctgagaaaagcaaagtcacctcatctgagcgactcggaccgatg

SEQ ID NO: 10648 - DNA, 203 bp, Homo sapiens
ggcgcgccagtcctgaatgttaaaggagccaggggaacagagagaattgtggggcagcaccgctccttgggtccccactccccatttctcattgcttggaaatccatgccaagatgcctgccttccttggtctaaagtgtctggggaaattgtgcagctcaattgggctgggtctcacctcatctgagcgactcggaccgatg

SEQ ID NO: 10649 - DNA, 203 bp, Homo sapiens
ggcgcgccagtcctcccaggccaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagcgcgggtcgacatccgactcggaccgatg

SEQ ID NO: 10650 - DNA, 203 bp, Homo sapiens
ggcgcgccagtccttgggcaacaaggagccaggggaacagagagaattgtggggcagcaccgctccttgggtccccactccccatttctccggctcgacttccacatgccaagatgcctgccttccttggtctaaagtgtctggggaaattgtgcagctctgagaaaagcaaagtcacctcatctgagcgactcggaccgatg

SEQ ID NO: 10651 - DNA, 203 bp, Homo sapiens
ggcgcgccagtcctggtgatataaggagccaggggaacagagagaattgtggggcagcaccgctccttgggtccccgtcattgtccgaggattgcttggaaatccatgccaagatgcctgccttccttggtctaaagtgtctggggaaattgtgcagctctgagaaaagcaaagtcacctcatctgagcgactcggaccgatg

SEQ ID NO: 10652 - DNA, 203 bp, Homo sapiens
ggcgcgccagtcctgcacgatgaagggacggcggcgattggcggacgctcctggcaggagagcgcggattggtcaggcacggagcaggaggcggggctgatagcccagcagcagcagcggcggcggcggctgcggagcgggtgtgaggcggctggaccgcagaatgaatcgatacagggcgcggcaagcgactcggaccgatg

SEQ ID NO: 10653 - DNA, 203 bp, Homo sapiens
ggcgcgccagtcctcccaccgaaaggtcagtggtaggtaaggaaggggccttaacctctgctggtgaccagaagcctgcatttctgcattctgcttaattccctttccttagatttgaaagaagccaacactaaaccacaaatatatcgtctacgagcaatctcaaacgagagtcagcctttaacgaacgactcggaccgatg

SEQ ID NO: 10654 - DNA, 203 bp, Homo sapiens
ggcgcgccagtcctagacaataaaggtcagtggtaggtaaggaaggggccttaacctctgctggtgaccagaagcctgcatttctgcattctgcttaattccctttccttagatttgactacttgttgtctgaaaccacaaatatacaacaaggccattttctcaaacgagagtcagcctttaacgaacgactcggaccgatg

SEQ ID NO: 10655 - DNA, 203 bp, Homo sapiens
ggcgcgccagtcctccggctgaaaggtcagtggtaggtaaggaaggggtagcgcgtctacggggtgaccagaagcctgcatttctgcattctgcttaattccctttccttagatttgaaagaagccaacactaaaccacaaatatacaacaaggccattttctcaaacgagagtcagcctttaacgaacgactcggaccgatg

SEQ ID NO: 10656 - DNA, 203 bp, Homo sapiens
ggcgcgccagtccttactctataagtacggttttcggagggatcagactcagactcacgtcgcactcctcgcagttggactggtgggaactgggaacactggagacctgatttctaactgacgctaccgtcgaacgtttatgtcccgacgacttcagcatgtctcaggccaccaagaggaagcatgtgcgactcggaccgatg

SEQ ID NO: 10657 - DNA, 203 bp, Homo sapiens
ggcgcgccagtcctggcacggaaagtacggttttcggagggatcagactcagactcacgtcgcactcctcgcagttggactggtgggaactgggaacactggagacctgatttctaactgacgctaccgtcgcggccgccgtgtggctacggcgtttgtagtctcaggccaccaagaggaagcatgtgcgactcggaccgatg

SEQ ID NO: 10658 - DNA, 203 bp, Homo sapiens
ggcgcgccagtcctactggtttaagtacggttttcggagggatcagactcagactcacgtcgcactcctcgcagttggactggtgggaactgggaacactggagacctgatttctaactgacgctaccgtcgcggccgccgtgtgggacgacttcagcatccgcgtttggggatagaggaagcatgtgcgactcggaccgatg

SEQ ID NO: 10659 - DNA, 203 bp, Homo sapiens
ggcgcgccagtcctacgtcgctaagtacggttttcggagggatcagactcagactcacgtcgcactcctcgcagttggactggtgggaactgggaacactggagacctgatttctaactgacgctaccgtcgcggccgccgtgtgggacgacttcagcatgtctcaggccaccaagaggaagcatgtgcgactcggaccgatg

SEQ ID NO: 10660 - DNA, 203 bp, Homo sapiens
ggcgcgccagtcctgattgcgtaagtacggttttcggagggatcagactcagactcacgtcgcactcctcgcagtttatgctcactactatgggaacactggagacctgatttctaactgacgctaccgtcgcggccgccgtgtgggacgacttcagcatgtctcaggccaccaagaggaagcatgtgcgactcggaccgatg

SEQ ID NO: 10661 - DNA, 203 bp, Homo sapiens
ggcgcgccagtccttaaacgcgaagttgggtaaggatagatcaatcaatgatcatattctagtacacttaggattcaagatcctattatcagggacaagagcaggattagggatatccgagatggccacacttttgaggagcttagcattgttcaaaagaccgtccacttgcagacccattacatcagcgactcggaccgatg

SEQ ID NO: 10662 - DNA, 203 bp, Homo sapiens
ggcgcgccagtcctcattcaggaagttgggtaaggatagatcaatcaatgatcatattctagtacacttaggattcttcgaggccaccgaagggacaagagcaggattagggatatccgagatggccacacttttgaggagcttagcattgttcaaaagaaacaaggacaaaccacccattacatcagcgactcggaccgatg

SEQ ID NO: 10663 - DNA, 203 bp, Homo sapiens
ggcgcgccagtcctgtcctggcaagttgggtaagtccttcggcggacctgatcatattctagtacacttaggattcaagatcctattatcagggacaagagcaggattagggatatccgagatggccacacttttgaggagcttagcattgttcaaaagaaacaaggacaaaccacccattacatcagcgactcggaccgatg

SEQ ID NO: 10664 - DNA, 203 bp, Homo sapiens
ggcgcgccagtcctgccaagataataacggtatagcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctcgactcggaccgatg

SEQ ID NO: 10665 - DNA, 203 bp, Homo sapiens
ggcgcgccagtcctacccaagtaataattaggccgctcatgtgccgttctctcagcgaaggccgaaaagaggctagccatgcccttagtaggactagcataatgaggggggtagcaacagtggtgagttcgttggatggcttaagccctgagtacagggtagtcgtcagtggttcgacgccttggaatcgactcggaccgatg

SEQ ID NO: 10666 - DNA, 203 bp, Homo sapiens
ggcgcgccagtcctcctataataataattaggcctagggaacaaatccctctcagcgaaggcactgtgattctctcccatgcccttagtaggactagcataatgaggggggtagcaacagtggtgagttcgttggatggcttaagccctgagtacagggtagtcgtcagtggttcgacgccttggaatcgactcggaccgatg

SEQ ID NO: 10667 - DNA, 203 bp, Homo sapiens
ggcgcgccagtcctaggtccataataattaggcctagggaacaaatccctctcagcgaaggccgaaaagaggctagccatgcccttagtaggactagcataatgaggggggtagcaacagtggtgagttcgttggatggcttaagccctgagtacagggtagtcgtcagtggttatcatgagcaatgacgactcggaccgatg

SEQ ID NO: 10668 - DNA, 203 bp, Homo sapiens
ggcgcgccagtcctgcatcgataataattaggcctagggaacaaatccctctcagcgaaggccgaaaagaggctagccatgcccttagtaggactagcataatgaggggggtagcaacagtggtgagttcgttggatggcttaagccctgagtacagggtagtcgtcagtggttcgacgccttggaatcgactcggaccgatg

SEQ ID NO: 10669 - DNA, 203 bp, Homo sapiens
ggcgcgccagtcctagtagttcaatacaattttgagaggttaataaattacaagtagtgctatttttgtatttaggttagctatttagctttacgttccaggatgcctagtggcagccccacaatatccaggaagccctctctgcggtttttcagattaggtagtcgaaaaaccaccagttcgacttgcgactcggaccgatg

SEQ ID NO: 10670 - DNA, 203 bp, Homo sapiens
ggcgcgccagtcctttgacgcaaatactcctaaacaactgctaggaccacggaactcagaaacacagcaagcgatcatattggaaatatggcccaaagtgacttcctttacccagagaacccaaaaaggcgggaagaagtaaatcgtcttcaccagcagcttcttgattgcttatctgacagcttcgacgactcggaccgatg

SEQ ID NO: 10671 - DNA, 203 bp, Homo sapiens
ggcgcgccagtcctcgacacagaatactcctaaacaactgctaggaccacggaactcagaaacacagcaagcgatcatattggaaatatgttgtgggcccgtcgcctttacccagagaacccaaaaaggcgggaagaagtaaatcgtcttcaccagcagcttcttgattgcttatctgacagcttcgacgactcggaccgatg

SEQ ID NO: 10672 - DNA, 203 bp, Homo sapiens
ggcgcgccagtcctcaaagtcgaatagtatgttcgaatcccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcgcgactcggaccgatg

SEQ ID NO: 10673 - DNA, 203 bp, Homo sapiens
ggcgcgccagtcctagcgcgagaatataccctacgtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattacgactcggaccgatg

SEQ ID NO: 10674 - DNA, 203 bp, Homo sapiens
ggcgcgccagtcctctttggcgaatatctgggagacctcgggctcttgatctccgagacaccccgtttcgtagtggagaacagtccagatcggggaagtttattttgcccaaagccggttagaggccccctggccctcgattcccacacttactagacttgctcccctgaacagcagctgcagcagcccgactcggaccgatg

SEQ ID NO: 10675 - DNA, 203 bp, Homo sapiens
ggcgcgccagtcctaagagacaaatatctgggagacctcgggctcttgatctccgagacaccccgtttcgtagtggtatcgtaaagtctccggggaagtttattttgcccaaagccggttagaggccccctggccctcgattcccagtgcggggctcagagctcccctgaacagcagctgcagcagcccgactcggaccgatg

SEQ ID NO: 10676 - DNA, 203 bp, Homo sapiens
ggcgcgccagtcctctcaacataatatctgggagacctcgggctcttggcggatacttttttccgtttcgtagtggagaacagtccagatcggggaagtttattttgcccaaagccggttagaggccccctggccctcgattcccagtgcggggctcagagctcccctgaacagcagctgcagcagcccgactcggaccgatg

SEQ ID NO: 10677 - DNA, 203 bp, Homo sapiens
ggcgcgccagtcctaaagcactaatatgttcattaccaacactgcagattcccattgagttggtgggggttttgttacctttgttttttttctcagcaaaataattctataactttttgtttgtgacaagaaatggactttcagtttacttaagattaattgaagggtggattaaaaatcattttgcccgactcggaccgatg

SEQ ID NO: 10678 - DNA, 203 bp, Homo sapiens
ggcgcgccagtcctgcacctcaaatattcacggcgttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaacgactcggaccgatg

SEQ ID NO: 10679 - DNA, 203 bp, Homo sapiens
ggcgcgccagtcctaggaacggaatatttctattgcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagaccgactcggaccgatg

SEQ ID NO: 10680 - DNA, 203 bp, Homo sapiens
ggcgcgccagtcctagtttggcaatcactattttgtactactaactcacccgtttttctccgggatccaagagatttactctaggatctcctattaagcttagcagtcattagttgagagttcaacttgcaaaactctaaccttcactctaataacaattcatccaatggataaattggaactagtcacgactcggaccgatg

SEQ ID NO: 10681 - DNA, 203 bp, Homo sapiens
ggcgcgccagtcctatcgggtcaatcactattttgtactactaactcattaagaaaaacttaggatccaagagatttactctaggatctcaggcatcatgggatagtcattagttgagagttcaacttgcaaaactctaaccttcactctaataacaattcatccaatggataaattggaactagtcacgactcggaccgatg

SEQ ID NO: 10682 - DNA, 203 bp, Homo sapiens
ggcgcgccagtcctgttgtaacaatcccaacctcggagcaggtggtcacaaaccagtgattggcctgtcgtaacgcgcaagtccgtggcggaaccgactactttgggtgtccgtgtttccttttattttattgtggctgcttatggtgacaatcacagattgttatcataaagccgtactagagacgacgactcggaccgatg

SEQ ID NO: 10683 - DNA, 203 bp, Homo sapiens
ggcgcgccagtcctcctgggtcaatcccaacctcggagcaggtggtcacaaaccagtgattggcctgtcgtaacgcgcaagtccgtggcggaaccgactactttgggtgtccgtgtttccttttattttatttgaaggaggcggcctgacaatcacagattgttatcataaagcgaattggattggcccgactcggaccgatg

SEQ ID NO: 10684 - DNA, 203 bp, Homo sapiens
ggcgcgccagtcctgggctcccaatcccaacctcggagcaggtggtcacaaaccagtgattggcctgtcgtaacgcttcgcattcgatttgaaccgactactttgggtgtccgtgtttccttttattttattgtggctgcttatggtgacaatcacagattgttatcataaagcgaattggattggcccgactcggaccgatg

SEQ ID NO: 10685 - DNA, 203 bp, Homo sapiens
ggcgcgccagtccttttagggtaatcccaacctcggagcaggtggtcaggtctgtagtccatgcctgtcgtaacgcgcaagtccgtggcggaaccgactactttgggtgtccgtgtttccttttattttattgtggctgcttatggtgacaatcacagattgttatcataaagcgaattggattggcccgactcggaccgatg

SEQ ID NO: 10686 - DNA, 203 bp, Homo sapiens
ggcgcgccagtcctaccagttaaatcccactcaaaatccaaaatcactaccagccactatctgctagacctagagtgcgaataggtaaataaaaccaaaatatgctcagccatacgtgtagttagagttcaatcaatctcaacaaccatttataccgccaattcaatacatatactataaatcttaaacgactcggaccgatg

SEQ ID NO: 10687 - DNA, 203 bp, Homo sapiens
ggcgcgccagtcctcgtgtcataatcccactcaaaatccaaaatcactaccagccactatctgctagacctagagtgcgaataggtaaatcgcggagtgccgatgggtaaatagacattagttagagttcaatcaatctcaacaaccatttataccgccaattcaatacatatactataaatcttaaacgactcggaccgatg

SEQ ID NO: 10688 - DNA, 203 bp, Homo sapiens
ggcgcgccagtcctcctaattcaatcccagtcctaacagaagtactgcgaatcttgtggcctcattctgaacaaaagggattagagaagaaaaatctcttgatataaggcttgaaagcaagggcaggcaatcaactggtcaccgtatttctgatttttccagaaatcaagcagaagattgagctgctgcgactcggaccgatg

SEQ ID NO: 10689 - DNA, 203 bp, Homo sapiens
ggcgcgccagtcctgaatatccaatcccagtcctaacagaagtactgcgaatcttgtggcctcattctgaacaaaagggattagagaagatttgatctacatgctaaggcttgaaagcaagggcaggcaatcttggttgtgaatattttctgatttttccagaaatcaagcagaagattgagctgctgcgactcggaccgatg

SEQ ID NO: 10690 - DNA, 203 bp, Homo sapiens
ggcgcgccagtcctcttcagataatcccagtcctaacagaagtactgcgaatcttgtggccttccaggtggttgttgggattagagaagaaaaatctcttgatataaggcttgaaagcaagggcaggcaatcttggttgtgaatattttctgatttttccagaaatcaagcagaagattgagctgctgcgactcggaccgatg

SEQ ID NO: 10691 - DNA, 203 bp, Homo sapiens
ggcgcgccagtcctaaccgacgaatccccgcgcgccggccggccccgggcacgcaggcagggcggcgcaggatccagggcgtctgggatgcagtggagctcagagagaggagaacggctcctcacgcctggggcctgctcttcagaagtccccagcgccgcataggaagttcacggacctcagcagcccgactcggaccgatg

SEQ ID NO: 10692 - DNA, 203 bp, Homo sapiens
ggcgcgccagtcctcgagatgcaatccccgcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcatcgagatgaggtgtcgactcggaccgatg

SEQ ID NO: 10693 - DNA, 203 bp, Homo sapiens
ggcgcgccagtccttccgacggaatcgcgatcagagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgacgactcggaccgatg

SEQ ID NO: 10694 - DNA, 203 bp, Homo sapiens
ggcgcgccagtcctgtctgagtaatctctagcagtggcgcccgaacagggacctgaaagcgaaagggaaaccagaggagctctctcgacgtgctgagacaacccctgaagcgcgcacggcaagaggcgaggggcggcgactggtgagtacgccaaaaattttgactagcggaggctagaaggagagagcgactcggaccgatg

SEQ ID NO: 10695 - DNA, 203 bp, Homo sapiens
ggcgcgccagtcctgtctgcccaatggaagaaagcagggcataagatcacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagagcgactcggaccgatg

SEQ ID NO: 10696 - DNA, 203 bp, Homo sapiens
ggcgcgccagtccttattaagtaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaattccatcaatggggtgaagaatcagagcgactcggaccgatg

SEQ ID NO: 10697 - DNA, 203 bp, Homo sapiens
ggcgcgccagtcctctgaagtcaatggaagaaagggacctgctgtccgacttacaggacatcagcgacagcgagaggaagaccagctcggggccagggaatgtcgcagaatcaggctcaggttctgaggaagaagaggaggaggaggaagaggaggaggaggaagggagcaccagtgaagaatcagagcgactcggaccgatg

SEQ ID NO: 10698 - DNA, 203 bp, Homo sapiens
ggcgcgccagtcctaacattggaatggcataggtgcccgcgtgcgccatcccctcagctagcaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 10699 - DNA, 203 bp, Homo sapiens
ggcgcgccagtcctgaaagctgaatggcttcgctcatttatagacaattgctcacgaattcttatacagtagatttatccgatgagatacaagagattggatcaactaaatcacaaaatgtcacaattaatctctacagccaaaaccaaacaggttatgctccagttaactggggacctggagaaattcgactcggaccgatg

SEQ ID NO: 10700 - DNA, 203 bp, Homo sapiens
ggcgcgccagtccttagtaatgaatggcttcgctcatttatagacaattgctcacgaattcttatacagtagatttatccgatgagatacgctgtggcaatcgcactaaatcacaaaatgtcacaattaatcctggaccatttgcgcaaacaggttatgctccagttaactggggacctggagaaattcgactcggaccgatg

SEQ ID NO: 10701 - DNA, 203 bp, Homo sapiens
ggcgcgccagtcctggagccgcaatgtgatcttgcttgtaaatacaattttgagaggttaataaattacaagtagtgctatttttgtatttaggttagctatttagctttacgttccaggatgcctagtggcagccccacaatatccaggaagccctctcgcgtaggccatgtgttaggtagtcgaaacgactcggaccgatg

SEQ ID NO: 10702 - DNA, 203 bp, Homo sapiens
ggcgcgccagtcctcgcgactgaatgtgatcttgcttgtaaatacaattttgagaggttaataaattacaagtagtgctatttttgtatttaggttagctatttagctttacgttccaggatgcctagtggcagccccacaatatccaggaagccctctctgcggtttttcagacggctagcagatcgcgactcggaccgatg

SEQ ID NO: 10703 - DNA, 203 bp, Homo sapiens
ggcgcgccagtcctcggtcgagaatgtgatcttgcttgtaaatacaattttgagaggttaatccggcgttgtctaagctatttttgtatttaggttagctatttagctttacgttccaggatgcctagtggcagccccacaatatccaggaagccctctctgcggtttttcagattaggtagtcgaaacgactcggaccgatg

SEQ ID NO: 10704 - DNA, 203 bp, Homo sapiens
ggcgcgccagtcctagtcatctaatgttgtacccctaagagtcataaactctggaattactcagtttcaaaagggaaaggagtttgagtttgtagaaggacaaggtgtgcctattgcaccaggagtcccagctactgaagctaaggggtactggtacagacacaacagacgttcttttaaaacagccgcgactcggaccgatg

SEQ ID NO: 10705 - DNA, 203 bp, Homo sapiens
ggcgcgccagtcctattccttcaatgttgtaccctactattcttggttctctggaattactcagtttcaaaagggaaaggagtttgagtttgtagaaggacaaggtgtgcctattgcaccaggagtcccagccgaccggttcctctggtactggtacagacacaacagacgttcttttaaaacagccgcgactcggaccgatg

SEQ ID NO: 10706 - DNA, 203 bp, Homo sapiens
ggcgcgccagtcctatgcatttaatgttgtaccctactattcttggttctctggaattactcagtttcaaaagggagtatttaacttagatgtagaaggacaaggtgtgcctattgcaccaggagtcccagctactgaagctaaggggtactggtacagacacaacagacgttcttttaaaacagccgcgactcggaccgatg

SEQ ID NO: 10707 - DNA, 203 bp, Homo sapiens
ggcgcgccagtccttccgtaataattatagaaagttctgaacctaggggtctttctgtctctgctgtgtggtgggaatcacacggtctccactaatcacatacgaatctgtaaaagaacggtgctgccgcttttgctttaattcaaatgaagaatatgaagtgcactttgaaagtcgaggaaacaactcgactcggaccgatg

SEQ ID NO: 10708 - DNA, 203 bp, Homo sapiens
ggcgcgccagtcctattagcggaattccagacctctctgtgcttagggcaaacatcatttggccttaaatgggattctgtgagaggggatccctccattgacagctggactgttctttggggccttatgtggtgtttgcctctgaggtactcaggggcataccctcagagtactattcttaaataatacgactcggaccgatg

SEQ ID NO: 10709 - DNA, 203 bp, Homo sapiens
ggcgcgccagtcctcgcctactaattccagacctctctgtgcttagggcaaacatcatttggccttaaatgggattctgtgagaggggatccctccattgacagctggactgttctttggggccttatgtggtgtttgcctctgagtagacggctacgtgttaggtttttcctcattcttaaataatacgactcggaccgatg

SEQ ID NO: 10710 - DNA, 203 bp, Homo sapiens
ggcgcgccagtcctccggcactaattccagacctctctgtgcttagggtcgggccagggaccccttaaatgggattctgtgagaggggatccctccattgacagctggactgttctttggggccttatgtggtgtttgcctctgaggtactcaggggcatttaggtttttcctcattcttaaataatacgactcggaccgatg

SEQ ID NO: 10711 - DNA, 203 bp, Homo sapiens
ggcgcgccagtcctgcaccagtaattcttgagaggttcttggagagattctgggagccaaacactccattgggatcctagctggaatataaagaatggcttatcagtggagaccatcgacagttgagaaaagaagaagcccaaaaagtacaagaatgaaagctaccttcacgccgagaacaacttgtacgactcggaccgatg

SEQ ID NO: 10712 - DNA, 203 bp, Homo sapiens
ggcgcgccagtcctcctacgcaaattgcaattgagacttgactcccctttgtacctccagagacctcctagagccagaacccggctggcttgctgtttcctttagagcagcgcatatcattatttggtgttctggtggaggacttttctgatggcagaaattagtttctctgggttcatcaggacgggcgactcggaccgatg

SEQ ID NO: 10713 - DNA, 203 bp, Homo sapiens
ggcgcgccagtcctctgaggctaattgcaattgatcaggtttatattattgtacctccagagacctcctagagccacgtggtacgaacgatgctgtttcctttagagcagcgcatatcattatttggtgttctggtggaggacttttctgatggcagaaattagtttctctgggttcatcaggacgggcgactcggaccgatg

SEQ ID NO: 10714 - DNA, 203 bp, Homo sapiens
ggcgcgccagtcctccctcaagaattgcaattgatcaggtttatattattgtacctccagagacctcctagagccagaacccggctggcttgctgtttcctttagagcagcgcatatcattatttggtgttctggtggaggacttttctgatggcagaaaccgtggagcaatatttcatcaggacgggcgactcggaccgatg

SEQ ID NO: 10715 - DNA, 203 bp, Homo sapiens
ggcgcgccagtcctcggcagcgaatttaacaggatacttggacaatagaagccagatcaaaagtaagaaaaacttaactgcggattggcgtcacagatcagctcaaccagacaccaccagcatacacgaaaccaaccttcacagtggatacctcagcatccaaaactctccttcccgaatggatcaggcgactcggaccgatg

SEQ ID NO: 10716 - DNA, 203 bp, Homo sapiens
ggcgcgccagtcctagtggccaaatttaacaggatacttggacaatagtctttcttagtttggtaagaaaaacttagggtgaatgacaattcacagatcagctcaaccagacaccaccagcatacacgaaaccaaccttcacagtggatacctcagcatccaaaactctccttcccgaatggatcaggcgactcggaccgatg

SEQ ID NO: 10717 - DNA, 203 bp, Homo sapiens
ggcgcgccagtccttcgtatgtaatttgttctcctgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcgactcggaccgatg

SEQ ID NO: 10718 - DNA, 203 bp, Homo sapiens
ggcgcgccagtccttcataaataattttgccttaaacagaaagacttgaccctcttaggtgtcatacctaagatcagtgtgttttttgtgatatcaaagcagtacaccaaaaaagagaagaaatattgcagtgaatgaagattcctctgcattttagcactgctttttcaactgtagttggcttttgacgactcggaccgatg

SEQ ID NO: 10719 - DNA, 203 bp, Homo sapiens
ggcgcgccagtccttgtcaagcaattttgccttaaacagaaagacttgaccctcttaggtgtcatacctaagatcagtgtgttttttgtgtccaattcttttatagtgtgttcccgcgagaaatattgcagtgaatgaagattcctctgcattttagcactgctttttcaactgtagttggcttttgacgactcggaccgatg

SEQ ID NO: 10720 - DNA, 203 bp, Homo sapiens
ggcgcgccagtcctactaacataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgggacaatacccgagcgactcggaccgatg

SEQ ID NO: 10721 - DNA, 203 bp, Homo sapiens
ggcgcgccagtccttgcgtcgtaattttgccttaaacagaaagacttgaccctcttaggtgtcatacctaagatcagtgtgttttttgtgtccaattcttttatcaccaaaaaagagagatcgctggaagacgaatgaagattcctctgcattttagcactgctttttcaactgtagttggcttttgacgactcggaccgatg

SEQ ID NO: 10722 - DNA, 203 bp, Homo sapiens
ggcgcgccagtcctgatttctaaattttgccttaaacagaaagacttgcatagggcgttgtccatacctaagatcagtgtgttttttgtgtccaattcttttatcaccaaaaaagagaagaaatattgcagtgaatgaagattcctctgcattttagcactgctttttcaactgtagttggcttttgacgactcggaccgatg

SEQ ID NO: 10723 - DNA, 203 bp, Homo sapiens
ggcgcgccagtcctatctcaatacaaaatcaaaccagcatctcagacttcctgctcctgggcctgcccatccaaccagagcagcaaaaccgcccaatatatagtttcttggccatgtatcttaccaccctcctggggaacctcctcatcattgtcctcattcgactggactcccatctccacacgcctcgactcggaccgatg

SEQ ID NO: 10724 - DNA, 203 bp, Homo sapiens
ggcgcgccagtcctactgtaagacaaaatcaaaccagcatctcagacttcctgctcctgggcctgcccatccaaccagagcagcaaaacctgtgctatgccctgttcttggccatgtatcttaccaccctcctggggaacctcctcatcattgtcctcatctagtacacagattatctccacacgcctcgactcggaccgatg

SEQ ID NO: 10725 - DNA, 203 bp, Homo sapiens
ggcgcgccagtcctaatttaccacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctcgactcggaccgatg

SEQ ID NO: 10726 - DNA, 203 bp, Homo sapiens
ggcgcgccagtccttcgggcttacaaaatcaaaccagcatctcagacttcctgctcctgggctaatgggcgacggaagagcagcaaaacctgtgctatgccctgttcttggccatgtatcttaccaccctcctggggaacctcctcatcattgtcctcattcgactggactcccatctccacacgcctcgactcggaccgatg

SEQ ID NO: 10727 - DNA, 203 bp, Homo sapiens
ggcgcgccagtccttacccggaacaaaccagtgggtggtgtgtcgtaacgggcaactctgcagcggaaccgactactttgggtgtccgtgtttccttttattcctatattggctgcttcgaaaactttcatgaaagttgttaccatatagctattggattggccatccggtgtgcaacagggcaattgcgactcggaccgatg

SEQ ID NO: 10728 - DNA, 203 bp, Homo sapiens
ggcgcgccagtccttcggtaggacacaaggaggaatggtgacaatcaaaaagttgttaccatatagctattggattggccatccggtgtgcaacagggcaattgtttacctatttattggttttgtaccattatcactgaagtctgtgatcactctcaaattcattttgaccctcaacacaatcaaaccgactcggaccgatg

SEQ ID NO: 10729 - DNA, 203 bp, Homo sapiens
ggcgcgccagtccttcggcccaacaccaaaacgcatccacctaactggctgacgctacaccttggtctttccgggtatgccgcacacggcctccaactcctgcagagctgagccggaggggaatccggaagggacacgctgaacaggaacagaaatgaataaaagtcgctggcagagtagaagacgaccgactcggaccgatg

SEQ ID NO: 10730 - DNA, 203 bp, Homo sapiens
ggcgcgccagtcctgacagggtacaccaaaacgcatccacctaactggctgacgctacaccttggtctttccgggtccttgcacgcttcgctccaactcctgcagagctgagccggaggggaatccggaaggccggacaactgattgaacagaaatgaataaaagtcgctggcagagtagaagacgaccgactcggaccgatg

SEQ ID NO: 10731 - DNA, 203 bp, Homo sapiens
ggcgcgccagtcctgaattaatacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcatctgtctgtcttcgcgactcggaccgatg

SEQ ID NO: 10732 - DNA, 203 bp, Homo sapiens
ggcgcgccagtcctgcgggatcacaccaaaacgcatccacctaactggctgacgctacaccttggtctttccgggtccttgcacgcttcgctccaactcctgcagagctgagccggaggggaatccggaagggacacgctgaacagtttgttctcctgcaaaaagtcgctggcagagtagaagacgaccgactcggaccgatg

SEQ ID NO: 10733 - DNA, 203 bp, Homo sapiens
ggcgcgccagtcctcaaatcggacagagcagaggaccagcagatgaatcttgcaacctccatagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 10734 - DNA, 203 bp, Homo sapiens
ggcgcgccagtcctaacgttcaacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 10735 - DNA, 203 bp, Homo sapiens
ggcgcgccagtcctcagacgtgacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagacattgccatgagagcgactcggaccgatg

SEQ ID NO: 10736 - DNA, 203 bp, Homo sapiens
ggcgcgccagtcctataccggcacagagcagaggaccagcagatgaatggacaccttgaagcagaggagcagcaggaccagagatcacccctgacctgctacctcggccgccccggttgcttctattggtcagcgttgcatccttacggggcctggcctggcagtggtgtaagaaccacgtgcttccccgactcggaccgatg

SEQ ID NO: 10737 - DNA, 203 bp, Homo sapiens
ggcgcgccagtcctagtaaggtacagagcagaggaccagcagatgaatggacaccttgaagcagaggagcagcaggaccagagatcacccctgacctgctaccttctggaggagcagagcttctattggtcaatccctttgggggtcggggcctggcctggcagtggtgtaagaaccacgtgcttccccgactcggaccgatg

SEQ ID NO: 10738 - DNA, 203 bp, Homo sapiens
ggcgcgccagtcctgagacgaaacagagcagagggatcttcccaccgcggacaccttgaagcagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 10739 - DNA, 203 bp, Homo sapiens
ggcgcgccagtcctagggagtcacagcggccctagaagggggatcttgggtgaaggtcagggcttgggcgctagctctccgaggcctgttctgaatcggtctccagaaatgctttgggagacgtcactgcgtctgcaaggaacttccatgcctctaacactcatcttcaaaagactgggactgctgagcgactcggaccgatg

SEQ ID NO: 10740 - DNA, 203 bp, Homo sapiens
ggcgcgccagtcctgttggcatacagcggccctagaagggggatcttgggtgaaggtcagggcttgggcgctagctctccgaggcctgttctgaatcggtctccagaaatgctttgggttcatctttcattgctgcaaggaacttccatgcctctaacacatcgggcttgtcctctgggactgctgagcgactcggaccgatg

SEQ ID NO: 10741 - DNA, 203 bp, Homo sapiens
ggcgcgccagtccttccgcgaaacagcggccctagaagggggatcttgggtgaaggtcagggcttgggcgctagctctccgaggcctgttctgaatcggtctccgccctcaaggcaatttcatctttcattgctgcaaggaacttccatgcctctaacactcatcttcaaaagactgggactgctgagcgactcggaccgatg

SEQ ID NO: 10742 - DNA, 203 bp, Homo sapiens
ggcgcgccagtccttcgttataacagtaaccttggtcgcacccccctgcaaccctcacctctttacaaaaccacatcaacatctcaccatgcaagccatcatccatattataaagtagttaattaaaaataatcataacaatgaactaagatattaagactaacaataacgttggggcaaatgcaaaccgactcggaccgatg

SEQ ID NO: 10743 - DNA, 203 bp, Homo sapiens
ggcgcgccagtccttatcggatacagtgcttggacggaacccggcgctaaacgtagtatagtgccggccgcccatagccagccctccgtcacctcttcaccgcaccctcggactgccccaaggcccccgccgccgctccagcgccgcgcagccaccgccgccgccgccgcctctccttagtcgccgcccgactcggaccgatg

SEQ ID NO: 10744 - DNA, 203 bp, Homo sapiens
ggcgcgccagtcctagtgctgcacagtgcttggacggaacccggcgctcgttccccaccccggccggccgcccatagccagccctccgtcacctcttcaccgcaatacatcctgtggacaaggcccccgccgccgctccagcgccgcgcagccaccgccgccgccgccgcctctccttagtcgccgcccgactcggaccgatg

SEQ ID NO: 10745 - DNA, 203 bp, Homo sapiens
ggcgcgccagtcctgaaaccctacagtgcttggacggaacccggcgctcgttccccaccccggccggccgcccatatgataattagaagaacctcttcaccgcaccctcggactgccccaaggcccccgccgccgctccagcgccgcgcagccaccgccgccgccgccgcctctccttagtcgccgcccgactcggaccgatg

SEQ ID NO: 10746 - DNA, 203 bp, Homo sapiens
ggcgcgccagtcctggtgctcaacatagatgttccttaaaagctaaatctttttgaacagatgatgataaacctggaagagattcaccaaatgccatttgacggacactggcttggaaagtactcccatgttccgtttgatcttggcaatttaatgctgttcttgaagactaattagttacactggatcgactcggaccgatg

SEQ ID NO: 10747 - DNA, 203 bp, Homo sapiens
ggcgcgccagtcctgacgcgtaacatagatgttccttaaaagctaaatctttttgaacagatgatgataaacctggaagagattcaccaacaatagcaaattacacactggcttggaaagtactcccatgttccgtttgatcttggcaatttaatgctgtcaaacgtagaactatagttacactggatcgactcggaccgatg

SEQ ID NO: 10748 - DNA, 203 bp, Homo sapiens
ggcgcgccagtcctggcagtaaacatagatgttccttaaaagctaaattggacgccgtctgggatgataaacctggaagagattcaccaacaatagcaaattacacactggcttggaaagtactcccatgttccgtttgatcttggcaatttaatgctgttcttgaagactaattagttacactggatcgactcggaccgatg

SEQ ID NO: 10749 - DNA, 203 bp, Homo sapiens
ggcgcgccagtcctctactagaacatcataagaacgttcagaggctcatttgataaatagaagatttatttgggcttggtggtaagtgtgattttatgttttctttgattttcttgtagacttgttcctgacgctgctacaggagcagaagactaacaagcttcatttatttttccaggtaagcaaaccgactcggaccgatg

SEQ ID NO: 10750 - DNA, 203 bp, Homo sapiens
ggcgcgccagtcctcgtagcctacatcatttcgctttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagacgactcggaccgatg

SEQ ID NO: 10751 - DNA, 203 bp, Homo sapiens
ggcgcgccagtcctagatcaccacatgttttatgtcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggacgactcggaccgatg

SEQ ID NO: 10752 - DNA, 203 bp, Homo sapiens
ggcgcgccagtcctagtgggacacattgcgaaaacacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 10753 - DNA, 203 bp, Homo sapiens
ggcgcgccagtcctcgatgcgcaccaattgaacgatggtgacaatcatagattgttatcataaagcgagttggattggccatccagtgtgaatcagattaattactcccttgtttgttggatccactcccgaaacgttttactccttaacttattgaaattgtttgaagacaggatttcagtgtcacacgactcggaccgatg

SEQ ID NO: 10754 - DNA, 203 bp, Homo sapiens
ggcgcgccagtcctactatgacaccaggggcgccaggattcaacactccaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagcgactcggaccgatg

SEQ ID NO: 10755 - DNA, 203 bp, Homo sapiens
ggcgcgccagtccttggtacgcaccaggggcgccgccgccggcgctcgcaggccgcggatgaagaagaaaacccggcgccgctcgacccggagcgaggagttgacccggagcgaggagttgaccctgagtgaggaagcgacctggacaagctgaatagatcagagtgaggaggcgacccagggcgaagcgactcggaccgatg

SEQ ID NO: 10756 - DNA, 203 bp, Homo sapiens
ggcgcgccagtcctgggctgataccaggtgtggaaagtccccaggctccccagcaggcagaagtatgcaaagcatgcatctcaattagtcccactaatctactacgcccctaactccgcccatcccgcccctaactccgcccagttccgcccattctccgccccatggctgactaattttttttatttcgactcggaccgatg

SEQ ID NO: 10757 - DNA, 203 bp, Homo sapiens
ggcgcgccagtcctagttaagaaccaggtgtggaaagtccccaggctccccagcaggcagaagtatgcaaagcatggggaagggccttgaagcaaccatagtcccgcccctaactccgcccatcccgcccctaactccgcccagttccgcccattctccgccccatggctgactaattttttttatttcgactcggaccgatg

SEQ ID NO: 10758 - DNA, 203 bp, Homo sapiens
ggcgcgccagtcctagaccctgaccaggtgtggaaagtccccaggctcgatctatccacccggtatgcaaagcatgcatctcaattagtcagcaaccatagtcccgcccctaactccgcccatcccgcccctaactccgcccagttccgcccattctccgccccatggctgactaattttttttatttcgactcggaccgatg

SEQ ID NO: 10759 - DNA, 203 bp, Homo sapiens
ggcgcgccagtcctgggtttgcacccagccccgatcctaaggggtcggggcttttgctcactcagcacaggatctgatcaggagacctcccccccctgctttacagggggcgggggttctcttgcgataacgggcctggcaaataacctaggggactaggttttcctttttattttaaagttgtcaatcgactcggaccgatg

SEQ ID NO: 10760 - DNA, 203 bp, Homo sapiens
ggcgcgccagtcctttgcgtgtacccagccccgatcctaaggggtcggggcttttgctcactcagcacaggatctgatcaggagacctcccccccctgctttacagggggcgggggtttaaaaattgcccaaggcctggcaaataacctaggggactaggttttcctttttattggccgaaataattacgactcggaccgatg

SEQ ID NO: 10761 - DNA, 203 bp, Homo sapiens
ggcgcgccagtcctaggatagaacccagccccgatcctaaggggtcggggcttttgctcactcagcacaggatctgatcaggagacctcccccccctgctttacagggggcgggggtttaaaaattgcccaaggcctggcaaataacctaggggactaggttttcctttttattttaaagttgtcaatcgactcggaccgatg

SEQ ID NO: 10762 - DNA, 203 bp, Homo sapiens
ggcgcgccagtcctccttcctaacccagccccgatcctaaggggtcggggcttttgctcactcagcacaggatctggatcatcacgtggtcccccctgctttacagggggcgggggtttaaaaattgcccaaggcctggcaaataacctaggggactaggttttcctttttattttaaagttgtcaatcgactcggaccgatg

SEQ ID NO: 10763 - DNA, 203 bp, Homo sapiens
ggcgcgccagtcctatatgaacacccagccccgatcctaaggggtcggggcttttgctcactggtggggctcctaaatcaggagacctcccccccctgctttacagggggcgggggtttaaaaattgcccaaggcctggcaaataacctaggggactaggttttcctttttattttaaagttgtcaatcgactcggaccgatg

SEQ ID NO: 10764 - DNA, 203 bp, Homo sapiens
ggcgcgccagtccttgaatacgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccaccgactcggaccgatg

SEQ ID NO: 10765 - DNA, 203 bp, Homo sapiens
ggcgcgccagtcctgcgatgcaaccccgagaaaccgaaaccgcagggcctagggcgggtggaacgagagggaactacatttcccagcaggctgcggaaacgggactgcggccactacttgtttaaatcaccgagagactggcgtccggcgtgtaccgagagactggcgtccggtgtgcaggtggccaccgactcggaccgatg

SEQ ID NO: 10766 - DNA, 203 bp, Homo sapiens
ggcgcgccagtcctaaccgtaaaccccgagaaaccgaaaccgcagggcctagggcgggtggaacgagagggaactacatttcccagcaggctgcggaaacgggatacgttggctctagtccggcgtgtaccgagagactggcgtccggcgtgtaccgagagactggcgtccggtgtgcaggtggccaccgactcggaccgatg

SEQ ID NO: 10767 - DNA, 203 bp, Homo sapiens
ggcgcgccagtcctcgtcttgcaccccgagaaaccgaaaccgcagggcctagggcgggtggaacgagagggaactacatttcccagcaggtgcttctctattacctgcggccactacttccggcgtgtaccgagagactggcgtccggcgtgtaccgagagactggcgtccggtgtgcaggtggccaccgactcggaccgatg

SEQ ID NO: 10768 - DNA, 203 bp, Homo sapiens
ggcgcgccagtcctaggccaagaccccgagaaaccgaaaccgcagggcctagggcgggtggacgagccccactaagcatttcccagcaggctgcggaaacgggactgcggccactacttccggcgtgtaccgagagactggcgtccggcgtgtaccgagagactggcgtccggtgtgcaggtggccaccgactcggaccgatg

SEQ ID NO: 10769 - DNA, 203 bp, Homo sapiens
ggcgcgccagtcctataaatccaccccgagaaaccgaaaccgcagggcgcgttttaccgaacacgagagggaactacatttcccagcaggctgcggaaacgggactgcggccactacttccggcgtgtaccgagagactggcgtccggcgtgtaccgagagactggcgtccggtgtgcaggtggccaccgactcggaccgatg

SEQ ID NO: 10770 - DNA, 203 bp, Homo sapiens
ggcgcgccagtcctgcgttctgaccccggctactcctgctcagcatggctgctttagggactgttctcttcacaggtgtccggaggctgcactgcagcgtagccatcctacttccaccccagtggcgactacagcagggactggctgccaacccctccggctacgggccccttaccgagctcccagaccgactcggaccgatg

SEQ ID NO: 10771 - DNA, 203 bp, Homo sapiens
ggcgcgccagtcctggtagattaccccggctactcctgctcagcatggtcctacaccttcaggttctcttcacaggtgtccggaggctgcactgcagcgtagccgcttgggcgggcggccagtggcgactacagcagggactggctgccaacccctccggctacgggccccttaccgagctcccagaccgactcggaccgatg

SEQ ID NO: 10772 - DNA, 203 bp, Homo sapiens
ggcgcgccagtcctcggccgttaccccggctacttgccgcggttcgaactgctttagggactgttctcttcacaggtgtccggaggctgcactgcagcgtagccgcttgggcgggcggccagtggcgactacagcagggactggctgccaacccctccggctacgggccccttaccgagctcccagaccgactcggaccgatg

SEQ ID NO: 10773 - DNA, 203 bp, Homo sapiens
ggcgcgccagtcctttcgctttacccctgaatggcaatctcaagcgcctctgtagggaagccaagaatgtccaggaggtaccccttcctctcggaagggatctgacctggagacacatacggtccctcaatgacctgtgcttgtgtttaaaaattgttacagcttccccgaaccaagtggtcttggttcgactcggaccgatg

SEQ ID NO: 10774 - DNA, 203 bp, Homo sapiens
ggcgcgccagtcctgagcgcacacccctgaatggcaatctcaagcgcctctgtagggaagccaagaatgtccaggaggtaccccttcctctcggaagggatctgacctggagacacatcacacgtgctttacacctgtgcttgtgtcgggtgtcaccacgagcttccccgaaccaagtggtcttggttcgactcggaccgatg

SEQ ID NO: 10775 - DNA, 203 bp, Homo sapiens
ggcgcgccagtcctgagaccggaccctgatggtttcctcacttgtgtccccaatggggctagctcgggtccacaacagctgccgatcaatccatctgaccagaatgtttcatgggtgtccagattttatcaattaaagcctgtgggaactgccagctcggcaagaggtaggcttggtctgcgccgatacgactcggaccgatg

SEQ ID NO: 10776 - DNA, 203 bp, Homo sapiens
ggcgcgccagtcctccgcgagcaccctgcactccgtcgccggaagtgccaccgagaagcgccggcctcggggctgtctacagcggcccgggagaggctgtggtggccccgagcgcgaggtgagctcaccagcgacagcggccaggcccgcccctcccctcgtgatggtcattgtcctccagagcagtgcgactcggaccgatg

SEQ ID NO: 10777 - DNA, 203 bp, Homo sapiens
ggcgcgccagtcctgctattggaccctgcactccgtcgccggaagtgccaccgagaagcgccggcctcggggctgtctacagcggcccgggagaggctgtggtggccccgagcgcgagtgtgtaggtgacaggacagcggccaggctatatgacttgacggtgatggtcattgtcctccagagcagtgcgactcggaccgatg

SEQ ID NO: 10778 - DNA, 203 bp, Homo sapiens
ggcgcgccagtccttgggctcgaccctgcactccgtcgccggaagtgccaccgagaagcgccggcctcggggctgttatactgtatttatgagaggctgtggtggccccgagcgcgagtgtgtaggtgacaggacagcggccaggcccgcccctcccctcgtgatggtcattgtcctccagagcagtgcgactcggaccgatg

SEQ ID NO: 10779 - DNA, 203 bp, Homo sapiens
ggcgcgccagtcctagcgtgttaccgcccgagactgtgtttcctgtgagtccagatgtgtgatccagatatgctgcttgctaatacagccctgttgactgagactaggagcgtgcctgaaactccatccctcctcctattattttttaatggtgcttctactggaatagtcaacaaagtgcacccaaccgactcggaccgatg

SEQ ID NO: 10780 - DNA, 203 bp, Homo sapiens
ggcgcgccagtcctcacgcctcacctcacccggtcctcgcagagttgcggccgcccgccccttcagccccggctctccgtatgcgcatgagcagaggcgcctccaagatagtacgatcaggctaaactttctaattcccttctttgggctcgggggctcccggagcagggcgagagctcgcgtcgccgcgactcggaccgatg

SEQ ID NO: 10781 - DNA, 203 bp, Homo sapiens
ggcgcgccagtcctatagcgtaacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccgcgactcggaccgatg

SEQ ID NO: 10782 - DNA, 203 bp, Homo sapiens
ggcgcgccagtcctcataacgcacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagctgaaagccaaggacgactcggaccgatg

SEQ ID NO: 10783 - DNA, 203 bp, Homo sapiens
ggcgcgccagtcctaccttacgacctcacccggtcctcgcagagttgcggccgcccgccccttcagccccggctctccgtatgcgcatgagcagaggcgcctccctctgttcctcccaaggctaaactttctaattcccttctttgttacgttacatcgtcggagcagggcgagagctcgcgtcgccgcgactcggaccgatg

SEQ ID NO: 10784 - DNA, 203 bp, Homo sapiens
ggcgcgccagtcctgcacaggaacctcacccggtcctcgcagagttgcggccgcccgccccttcagccccggctctccgtatgcgcatgatttccaaatttcagctctgttcctcccaaggctaaactttctaattcccttctttgggctcgggggctcccggagcagggcgagagctcgcgtcgccgcgactcggaccgatg

SEQ ID NO: 10785 - DNA, 203 bp, Homo sapiens
ggcgcgccagtcctctacgattacctcacccggtcctcgcagagttgcggccgcccgccccttcagccccggctctgatccgcattcgaggcagaggcgcctccctctgttcctcccaaggctaaactttctaattcccttctttgggctcgggggctcccggagcagggcgagagctcgcgtcgccgcgactcggaccgatg

SEQ ID NO: 10786 - DNA, 203 bp, Homo sapiens
ggcgcgccagtcctgggtccgaacctccaagagaaaataaccggggaccagagaggaaagacaggtccttaggtcctcaccctcccgtctccttgcccttgcagttctgggaactggacagattggacaactataacgacacctccctggtggaaaatcatctctgccctgccacagaggggcccctccgactcggaccgatg

SEQ ID NO: 10787 - DNA, 203 bp, Homo sapiens
ggcgcgccagtcctggtacctaacctccaagagagctagggttcctctcagagaggaaagacaggtccttaggtcccatttagtgacctcccttgcccttgcagttctgggaactggacagattggacaactataacgacacctccctggtggaaaatcatctctgccctgccacagaggggcccctccgactcggaccgatg

SEQ ID NO: 10788 - DNA, 203 bp, Homo sapiens
ggcgcgccagtcctgtccgtcgacctccaagagagctagggttcctctcagagaggaaagacaggtccttaggtcctcaccctcccgtctagcatataaaagccttctgggaactggacagattggacaactataacgacacctccctggtggaaaatcatctctgccctgccacagaggggcccctccgactcggaccgatg

SEQ ID NO: 10789 - DNA, 203 bp, Homo sapiens
ggcgcgccagtcctttactgtcacctccaagagagctagggttcctctcagagaggaaagacaggtccttaggtcctcaccctcccgtctccttgcccttgcagttctgggaactggaacctccaactcttgataacgacacctccctggtggaaaatcatctctgccctgccacagaggggcccctccgactcggaccgatg

SEQ ID NO: 10790 - DNA, 203 bp, Homo sapiens
ggcgcgccagtcctgttgggtaacctccaagagagctagggttcctctcagagaggaaagacaggtccttaggtcctcaccctcccgtctccttgcccttgcagttctgggaactggacagattggacaactataacgacacctccctggtggaaaatcatctctgccctgccacagaggggcccctccgactcggaccgatg

SEQ ID NO: 10791 - DNA, 203 bp, Homo sapiens
ggcgcgccagtcctactgtgcaacctccaagagagctagggttcctctcagagaggaaagacaggtccttaggtcctcaccctcccgtctccttgcccttgcagttctgggaactggacagattggacaactataacgacacctcctcctaaagtgggggtctctgccctgccacagaggggcccctccgactcggaccgatg

SEQ ID NO: 10792 - DNA, 203 bp, Homo sapiens
ggcgcgccagtcctctcgtgacacctccaagagagctagggttcctctcagagaggaaagaccatcgggctcaagatcaccctcccgtctccttgcccttgcagttctgggaactggacagattggacaactataacgacacctccctggtggaaaatcatctctgccctgccacagaggggcccctccgactcggaccgatg

SEQ ID NO: 10793 - DNA, 203 bp, Homo sapiens
ggcgcgccagtcctggttgaccacctcccagaagagtcacgtgggctgacccagagccggggcggaaaggctgcgttagtttcttccgggtcattgacagaagaccggtcgaggtaaagtagttcgttggttttctttcccctcatccttttgccgtgagatggcgaggggtggctttgatttcggcgcgactcggaccgatg

SEQ ID NO: 10794 - DNA, 203 bp, Homo sapiens
ggcgcgccagtcctcgggcgcaacctcccagaagagtcacgtgggctgacccagagccggggcggaaaggctgcgttagtttcttccgggtcattgacagaagaccggtcgaggtaaagtagttcgttggttttctttcccctcatccttttgcctgctcccggcgaggggtggctttgatttcggcgcgactcggaccgatg

SEQ ID NO: 10795 - DNA, 203 bp, Homo sapiens
ggcgcgccagtccttgagcgtgacctcccagaagagtcacgtgggctgacccagagccggggcggaaaggctgcgttagtttcttccgggtcattgacagaagcgtcaattcctgggagtagttcgttggttttctttcccctcatccttttgcctgctctaatttcttacgacctttgatttcggcgcgactcggaccgatg

SEQ ID NO: 10796 - DNA, 203 bp, Homo sapiens
ggcgcgccagtcctcaatcattacctcccagaagagtcacgtgggctgacccagagccggggcggaaaggctgcgttagtttcttccgggtcattgacagaagcgtcaattcctgggagtagttcgttggttttctttcccctcatgtgccatgacatatccggcgaggggtggctttgatttcggcgcgactcggaccgatg

SEQ ID NO: 10797 - DNA, 203 bp, Homo sapiens
ggcgcgccagtcctccacaccaacctcccagaagagtcacgtgggctggtgagtcaagcctacggaaaggctgcgttagtttcttccgggtcattgacagaagcgtcaattcctgggagtagttcgttggttttctttcccctcatccttttgcctgctcccggcgaggggtggctttgatttcggcgcgactcggaccgatg

SEQ ID NO: 10798 - DNA, 203 bp, Homo sapiens
ggcgcgccagtcctgatggtgaacgaaatagatgatctgtttaatgcatttggaagcaactaatcgaatcaacattttgatccaaattaagggccgccgcttccaacttaggattaaagaatcctattataccagaatatagggtggtaaatttagagtttgcttgcaactcaatcaatagagagttgcgactcggaccgatg

SEQ ID NO: 10799 - DNA, 203 bp, Homo sapiens
ggcgcgccagtcctcgcgctaaacgaacctcagcatttctgttggagactctagacctactggaaataacataactctggacctattggaacttatataattggcgcccaaccaacaatctgaacccaccaatctaatttaacacactttgtcaggcgacaaacagggtagttaagttagaaaagcatcgactcggaccgatg

SEQ ID NO: 10800 - DNA, 203 bp, Homo sapiens
ggcgcgccagtcctaccgcacaacgaacctcagcgaaagaaggaagatctctagacctactggaaataacataacttgatcttacaatttacttatataattggcgcccaaccaacaatctgaacccaccaatctaatttaacacactttgtcaggcgacaaacagggtagttaagttagaaaagcatcgactcggaccgatg

SEQ ID NO: 10801 - DNA, 203 bp, Homo sapiens
ggcgcgccagtcctgagatggcacgatatcatatgcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaaccgactcggaccgatg

SEQ ID NO: 10802 - DNA, 203 bp, Homo sapiens
ggcgcgccagtcctgaggagttacgatgggaaacgcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgaccgactcggaccgatg

SEQ ID NO: 10803 - DNA, 203 bp, Homo sapiens
ggcgcgccagtcctcttgacagacgcagccaggcgcgcactgcacagcgtaaagggaaattggccgcccgagcgcacccttcagcccgcgcgccggccgtgagtcctcggtgctcgcccgccggccagacaaacagcccgcccgaccccgtcccgaccctggccgccccgagcggagcctggagcaaacgactcggaccgatg

SEQ ID NO: 10804 - DNA, 203 bp, Homo sapiens
ggcgcgccagtcctccgtctatacgccgccaaaaccttcgggacagctatgcgggttgacaatcccagtggggggcattatgattatatgttacttgtcctgcgagttcctcttgagactggccgaaaggcagccacggggccaccaaggcggcgcagcgctgcatgcggcaaggggaaaaatccttccgactcggaccgatg

SEQ ID NO: 10805 - DNA, 203 bp, Homo sapiens
ggcgcgccagtcctccatacggacgccgccaaaaccttcgggacagctatgcgggttgacaatcccagtggggggccggggaccagctgattacttgtcctgcgagttcctcttgagactggccgaaaggcagccacggggccaccgcacacttatttaactgcatgcggcaaggggaaaaatccttccgactcggaccgatg

SEQ ID NO: 10806 - DNA, 203 bp, Homo sapiens
ggcgcgccagtcctcgaggtatacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgcgactcggaccgatg

SEQ ID NO: 10807 - DNA, 203 bp, Homo sapiens
ggcgcgccagtccttccttcagacggacacccctagggtatacaatgacagagatcttctagactaggtgcgagaggccgaggaccagaacaacatccgcctaccctccatcattgttataaaaaacttaggtgatgttcaacgggagccgccagccaaccaaccatccactcccacgactggagccgcgactcggaccgatg

SEQ ID NO: 10808 - DNA, 203 bp, Homo sapiens
ggcgcgccagtccttagggcaaacggacacccctagggtatacaatgacagagatcttctagactaggtgcgagaggccgaggaccagaacaacatccgcctaccctccatcattgtttcctgttggggttaaaccaggtccacacagccgccagccaaccaaccatccactcccacgactggagccgcgactcggaccgatg

SEQ ID NO: 10809 - DNA, 203 bp, Homo sapiens
ggcgcgccagtcctatcacgctacggacacccctagggtatacaatgacagagatcttctagactaggtgcgagaggccgaggaccagaagtctcgatttgatacctccatcattgttataaaaaacttaggaaccaggtccacacagccgccagccaaccaaccatccactcccacgactggagccgcgactcggaccgatg

SEQ ID NO: 10810 - DNA, 203 bp, Homo sapiens
ggcgcgccagtcctttatttatacggacacccctagggtatacaatgacagagatcttctagttcgtcccatgtttgccgaggaccagaacaacatccgcctaccctccatcattgttataaaaaacttaggaaccaggtccacacagccgccagccaaccaaccatccactcccacgactggagccgcgactcggaccgatg

SEQ ID NO: 10811 - DNA, 203 bp, Homo sapiens
ggcgcgccagtcctctaatgatacggacagccaatttttgttgtattgttgagtcttcttgtgttttgttgtctttctacaggttgttgtggttgttgcaattgtttaacttcatcaatgcgaggctgttgtgattgtggttcaactaaacttccttattacgaatttgaaaaggtccacgttcaatacgactcggaccgatg

SEQ ID NO: 10812 - DNA, 203 bp, Homo sapiens
ggcgcgccagtccttctcctgaacggcctctggctaggacccaggtccttgattatgccaattttctcgagaaatcattcaattgaccatagactgaaagcgttgttacctagttcttcagaagagatcttattagaattaatttatatgatctaattcccttaaaaactgaataccaaaaaacaaaacgactcggaccgatg

SEQ ID NO: 10813 - DNA, 203 bp, Homo sapiens
ggcgcgccagtccttgaggcctacgtcctcgccacatctctgtaacctccctaccaaggactaattggtctttaaaactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 10814 - DNA, 203 bp, Homo sapiens
ggcgcgccagtccttttagctaacgtcgttgaagacccacaggctgctgggaggagagcataaggaatctacttgaaaatggatcggtttatgttggattaaatgctgctctttgtggcctcatagcaaacagtctttttcgacgcatcttgaatgtgacaaaggctcgcatagctgctggcttaccacgactcggaccgatg

SEQ ID NO: 10815 - DNA, 203 bp, Homo sapiens
ggcgcgccagtcctgaccatgtacgtctgtgcggctgcgtggggctcgagttacacttgaccaggagactgaagcacttctaccctagccgggcccagcccccgagcagtgcagcctcccgagtgcagagtgcagcccctgcccgccctggcccagctgcccatgtctaccctgctggatcccaagtacgactcggaccgatg

SEQ ID NO: 10816 - DNA, 203 bp, Homo sapiens
ggcgcgccagtcctagatcgggacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcaggctgaagtgagtctggatcccaagtacgactcggaccgatg

SEQ ID NO: 10817 - DNA, 203 bp, Homo sapiens
ggcgcgccagtcctagttagcgacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtacgactcggaccgatg

SEQ ID NO: 10818 - DNA, 203 bp, Homo sapiens
ggcgcgccagtccttacgaaagacgtctgtgcggctgcgtggggctcggccgcgcggactgaaggagactgaagcacttctaccctagccgggcccagcccccgagcagtgcagcctcccgagtgcagagtgcagcccctgcccgcgagcctaagcaataccatgtctaccctgctggatcccaagtacgactcggaccgatg

SEQ ID NO: 10819 - DNA, 203 bp, Homo sapiens
ggcgcgccagtccttcgccaatacgtctgtgcggctgcgtggggctcggccgcgcggactgaaggagactgaagcacttctaccctagccgggcccagcccccgagcagtgcagcctctgccagttgagcgtcagcccctgcccgccctggcccagctgcccatgtctaccctgctggatcccaagtacgactcggaccgatg

SEQ ID NO: 10820 - DNA, 203 bp, Homo sapiens
ggcgcgccagtccttcacccgcacgtctgtgcggctgcgtggggctcggccgcgcggactgaaggagactgaagcacttctaccctagccgggcccagcccccggttttgtgtttactccgagtgcagagtgcagcccctgcccgccctggcccagctgcccatgtctaccctgctggatcccaagtacgactcggaccgatg

SEQ ID NO: 10821 - DNA, 203 bp, Homo sapiens
ggcgcgccagtcctcataaataacgtctgtgcggctgcgtggggctcggccgcgcggactgaaggagactgaagcatcagcggatgcattgggcccagcccccgagcagtgcagcctcccgagtgcagagtgcagcccctgcccgccctggcccagctgcccatgtctaccctgctggatcccaagtacgactcggaccgatg

SEQ ID NO: 10822 - DNA, 203 bp, Homo sapiens
ggcgcgccagtcctacattattacgtctgtgcggtgtgtgcttctgtagccgcgcggactgaaggagactgaagcacttctaccctagccgggcccagcccccgagcagtgcagcctcccgagtgcagagtgcagcccctgcccgccctggcccagctgcccatgtctaccctgctggatcccaagtacgactcggaccgatg

SEQ ID NO: 10823 - DNA, 203 bp, Homo sapiens
ggcgcgccagtcctagagtttaactaatgtgccgcgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagccgactcggaccgatg

SEQ ID NO: 10824 - DNA, 203 bp, Homo sapiens
ggcgcgccagtcctgcagcctgactaccagatttgactcatttgtgattccttcgagaatctagttattagacacgtggttacatgaatgtttgggaaggaaaactggcaacatcttagtatatgttctccatggcacattagggaaagaagccagaaaaggctcccaacgcattgatttttaaaatgcgactcggaccgatg

SEQ ID NO: 10825 - DNA, 203 bp, Homo sapiens
ggcgcgccagtccttgccgaccactaccagatttgactcatttgtgattccttcgagaatctcccatgatttgcaatggttacatgaatgtttgggaaggaaaactggcaacatcttagtatatgttctccatggcacattagggaaagaagccagaaaaactcaattgttagctgatttttaaaatgcgactcggaccgatg

SEQ ID NO: 10826 - DNA, 203 bp, Homo sapiens
ggcgcgccagtcctgacaaaccactacccccaattgcaataaccccaggacaatctagccacagctaactgcccaaatccactacattccattcatatttagtcagctttgcgtggggaggcccggaaagaattagttctacgagcatcgacacaattatcttgatcgtgtttctttccgggcaagcccgactcggaccgatg

SEQ ID NO: 10827 - DNA, 203 bp, Homo sapiens
ggcgcgccagtccttcagaagaactacccccaattgcaataaccccaggacaatctagccacagctaactgcccaaatccactacattccattcatatttagtctttaagaaaaaactaggcccggaaagaattagttctacgagcatcgacacaattatcttgatcgtgtttccccttaatgcgcggcgactcggaccgatg

SEQ ID NO: 10828 - DNA, 203 bp, Homo sapiens
ggcgcgccagtcctgtttggacactacccccaattgcaataaccccaggacaatctagccacagctaactgcccaagggactacttgataattcatatttagtctttaagaaaaaactaggcccggaaagaattagttctacgagcatcgacacaattatcttgatcgtgtttctttccgggcaagcccgactcggaccgatg

SEQ ID NO: 10829 - DNA, 203 bp, Homo sapiens
ggcgcgccagtcctatggacgcactacccccaattgcaataaccccagtgtcgggataaataagctaactgcccaaatccactacattccattcatatttagtctttaagaaaaaactaggcccggaaagaattagttctacgagcatcgacacaattatcttgatcgtgtttctttccgggcaagcccgactcggaccgatg

SEQ ID NO: 10830 - DNA, 203 bp, Homo sapiens
ggcgcgccagtcctacagatagactagtcgacgttcttcgttaagaagcacgacttccagcagttggggccacggtgggacggaccctacactgtagtcctcagcacccccaccgcggtaaaggtcgctgggaagaccccgtggatccaccactctcgactcaagaaagctcctgacaaccaagaagacgactcggaccgatg

SEQ ID NO: 10831 - DNA, 203 bp, Homo sapiens
ggcgcgccagtcctggcggtgtactataatttatagtagagtcggaagccgaccctcacagtaaaatagcacaggctgggttttctacgtacgagtaaaacacggtgatttttctgcagtgagctctcccatgagcaacatgacagaaaacgaaagattgcttcattttttctaaactgaacgaaaagcgactcggaccgatg

SEQ ID NO: 10832 - DNA, 203 bp, Homo sapiens
ggcgcgccagtcctgcctggtcactattacttttgtttcttttgatgacctttatgttgctattagaggttcttgtgaaaagaacctacaacttatgcgtaaggttgacttgtataatggtgctgtcatttacatttttgccgaagagcctgttgttggtatagtctactcttcgtggaccgtttcgtcgactcggaccgatg

SEQ ID NO: 10833 - DNA, 203 bp, Homo sapiens
ggcgcgccagtcctccatgtttactattacttttgtttcttttgatgacctttatgttgctattagaggttcttgtgaaaagaacctacaacttatgcgtaaggttgacttgtataatggtgctgtcatttacatttttgccgaagagcctgttgttggtatagtctactcttctcaactatacgaagcgactcggaccgatg

SEQ ID NO: 10834 - DNA, 203 bp, Homo sapiens
ggcgcgccagtcctactgccctactattacttttgtttcttttgatgacctttatgttgctattagaggttcttgtgaaaagaacctacaggcctaatagggttttgacttgtataatggtgctgtcatttacatttttgccgaagagcctgttgttggtatagtctactcttctcaactatacgaagcgactcggaccgatg

SEQ ID NO: 10835 - DNA, 203 bp, Homo sapiens
ggcgcgccagtcctatcaagagactattacttttgtttcttttgatgagaaacgcagaatgcttagaggttcttgtgaaaagaacctacaacttatgcgtaaggttgacttgtataatggtgctgtcatttacatttttgccgaagagcctgttgttggtatagtctactcttctcaactatacgaagcgactcggaccgatg

SEQ ID NO: 10836 - DNA, 203 bp, Homo sapiens
ggcgcgccagtcctgtcattctactcagactttactctaaaagtcaaatcttctgacattctttgaagtgaagcataaccacgggaaccactgaagaaatgaatgaaatgaaataatgcagcatctagtgctttttgcatggcccaaaggggctctgtgctgctccactacagaggaaacttcaagaacgactcggaccgatg

SEQ ID NO: 10837 - DNA, 203 bp, Homo sapiens
ggcgcgccagtcctcaatgggtactcagactttactctaaaagtcaaatcttctgacattctttgaagtgaagcattctatgaatgtgagctgaagaaatgaatgaaatgaaataatgcagcatctagtgctttttgcatggcccaaaggggctctgtgcctgcgggaatttacggaaacttcaagaacgactcggaccgatg

SEQ ID NO: 10838 - DNA, 203 bp, Homo sapiens
ggcgcgccagtcctcgatagatactcagactttactctaaaagtcaaatcttctgacattctttgaagtgaagcattctatgaatgtgagctgaagaaatgaatgaaatgaaataatgcagcatctagtgctttttgcatggcccaccatatgataactttgctccactacagaggaaacttcaagaacgactcggaccgatg

SEQ ID NO: 10839 - DNA, 203 bp, Homo sapiens
ggcgcgccagtcctatccactaactcagactttactctaaaagtcaaatcttctgacattctttgaagtgaagcattctatgaatgtgagctgaagaaatgaatgaaatgaaataatgcagcatctagtgctttttgcatggcccagtctcatgtgtgtatgctccactacagaggaaacttcaagaacgactcggaccgatg

SEQ ID NO: 10840 - DNA, 203 bp, Homo sapiens
ggcgcgccagtcctaggtaactactcagactttatagactggacggtctcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaacgactcggaccgatg

SEQ ID NO: 10841 - DNA, 203 bp, Homo sapiens
ggcgcgccagtcctaatcacttactcagcacaggatctgatcaggagatttgtctccggtgctttacaccggagcaaccccagttggtgcgcccaaggcctggcaaataacctaggggactaggttttcttttaatttacacgtctgtcaatatgggtgcaaacaatagcaaggagtctgtgtcaagccgactcggaccgatg

SEQ ID NO: 10842 - DNA, 203 bp, Homo sapiens
ggcgcgccagtccttgtttaacactcagcacaggatctgatcaggagatttgtctccggtgctttacaccggagcacaaatttaaaaattgcccaaggcctggcaaataacctaggggactaggttttctttatgaggtggtagaagtcaatatgggtgcaaacaatagcaaggagtctgtgtcaagccgactcggaccgatg

SEQ ID NO: 10843 - DNA, 203 bp, Homo sapiens
ggcgcgccagtcctttgtcctgactcagcacaggatctgatcaggagatttgtctccggtgctttacaccggagcacaaatttaaaaattgcccaaggcctggcggtgtttaccccccactaggttttcttttaatttacacgtctgtcaatatgggtgcaaacaatagcaaggagtctgtgtcaagccgactcggaccgatg

SEQ ID NO: 10844 - DNA, 203 bp, Homo sapiens
ggcgcgccagtcctcctggacaactcccaggctcctcgggacattttttagcctcctgggagtctcggagggggtgatactagcaggtttgggccttgacgtggctgtggatgcagtcgttctgacccctggtggccgagaggtgaagtgcagtggcggctgcttgctcaaggccggaggaagacgcccgactcggaccgatg

SEQ ID NO: 10845 - DNA, 203 bp, Homo sapiens
ggcgcgccagtcctttacctacactcccaggctcctcgggactcggcgggtcctcctgggagtctcggaggggaccggctgtgcaggtttgggccttgacgtggaaacatccctgtaggttctgacccctggtggccgagaggtgaagtgcagtggcggctgcttgctcaaggccggaggaagacgcccgactcggaccgatg

SEQ ID NO: 10846 - DNA, 203 bp, Homo sapiens
ggcgcgccagtcctaacgcggcactcccaggctcctcgggactcggcgggtcctcctgggagtctcggaggggaccggctgtgcaggtttgggccttgacgtggctgtggatgcagtctccggcctgtagattggccgagaggtgaagtgcagtggcggctgcttgctcaaggccggaggaagacgcccgactcggaccgatg

SEQ ID NO: 10847 - DNA, 203 bp, Homo sapiens
ggcgcgccagtccttctatgctactcccaggctcctcgggactcggcgtcgatgagaccatatctcggaggggaccggctgtgcaggtttgggccttgacgtggctgtggatgcagtcgttctgacccctggtggccgagaggtgaagtgcagtggcggctgcttgctcaaggccggaggaagacgcccgactcggaccgatg

SEQ ID NO: 10848 - DNA, 203 bp, Homo sapiens
ggcgcgccagtcctcccatttgactcccaggctctggacatagaaataggtcctcctgggagtctcggaggggaccggctgtgcaggtttgggccttgacgtggctgtggatgcagtcgttctgacccctggtggccgagaggtgaagtgcagtggcggctgcttgctcaaggccggaggaagacgcccgactcggaccgatg

SEQ ID NO: 10849 - DNA, 203 bp, Homo sapiens
ggcgcgccagtcctcggctaggactcttgccatacgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagcccgactcggaccgatg

SEQ ID NO: 10850 - DNA, 203 bp, Homo sapiens
ggcgcgccagtcctgggccggcactgagagcgcctggaggctcgagcgagtacctcgaatcatgcacacctgttagcaagaaacagaagttgaaggactggaacaagtgaactaggaaagagggaacgccaatccaaggatagaaggacaaggacagaatcaccagcactggctgaaggtaccttaaccgactcggaccgatg

SEQ ID NO: 10851 - DNA, 203 bp, Homo sapiens
ggcgcgccagtcctacttgtcaactgagagcgcctggaggctcgagcggagggtaattcatttgcacacctgttagcaagaaacagaagttgaaggactggaacaagtgaactaggaaagagggaacgccaaagtccaatgtcccagacaaggacagaatcaccagcactggctgaaggtaccttaaccgactcggaccgatg

SEQ ID NO: 10852 - DNA, 203 bp, Homo sapiens
ggcgcgccagtccttttacgacactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctctgctatgagccgtcgactcggaccgatg

SEQ ID NO: 10853 - DNA, 203 bp, Homo sapiens
ggcgcgccagtcctgtcgtcaaactgagagcgcctggaggctcgagcggagggtaattcatttgcacacctgttagcaagaaacagaagttgaaggactggaacaagtgaactaggaaagagggaacgccaatccaaggatagaaggacaaggacagaatgcggccgtgaattcgaaggtaccttaaccgactcggaccgatg

SEQ ID NO: 10854 - DNA, 203 bp, Homo sapiens
ggcgcgccagtcctcagacccaactgagagcgcctggaggctcgagcggagggtaattcatttgcacacctgttagcaagaaacagaagttgaaggactggaacaagtgaactaggaacttataccgatatctccaaggatagaaggacaaggacagaatcaccagcactggctgaaggtaccttaaccgactcggaccgatg

SEQ ID NO: 10855 - DNA, 203 bp, Homo sapiens
ggcgcgccagtcctcgcactgtactgagagcgcctggaggctcgagcggagggtaattcatttgcacacctgttagcaagaaacagaagttgaaggactggaactgtccgctgtccgtagagggaacgccaatccaaggatagaaggacaaggacagaatcaccagcactggctgaaggtaccttaaccgactcggaccgatg

SEQ ID NO: 10856 - DNA, 203 bp, Homo sapiens
ggcgcgccagtccttcagtgccactgataaagaaaggaaaagctaccaccattacatcagtcttaccgaagccagcactagttgcatctcaacggcgtagaaataaagtccttattctaggatcaggaggtctgtccattggtcaggctggagaatttgattactcaggatctcaagctgtaaaagcccgactcggaccgatg

SEQ ID NO: 10857 - DNA, 203 bp, Homo sapiens
ggcgcgccagtcctctccgtgcactgcaataggccactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgacgactcggaccgatg

SEQ ID NO: 10858 - DNA, 203 bp, Homo sapiens
ggcgcgccagtccttggtgtccactggcgctaaaagttttgagcttctattgtactctacctcaccgtccagggagcaggtagctgctgggctccggggacactttgcgttcgggctgggagcgtgctttccacgacggtgacacgcttccctggattggcagccagactgccttccgggtcactgcccgactcggaccgatg

SEQ ID NO: 10859 - DNA, 203 bp, Homo sapiens
ggcgcgccagtcctcatatcttactggcgctaaaagttttgagcttctcaaaagtctagagccaccgtccagggagcaggtagctgctgggctccggggacactttgcgttcgggctgggagcgtgctttccacgacggtgacacgaagtgacttcacaacagccagactgccttccgggtcactgcccgactcggaccgatg

SEQ ID NO: 10860 - DNA, 203 bp, Homo sapiens
ggcgcgccagtcctccggctgaactgggaaaaatggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggcgactcggaccgatg

SEQ ID NO: 10861 - DNA, 203 bp, Homo sapiens
ggcgcgccagtcctacatactcactggggacctccgcgcctgggaaaaggagttggctgaaggacttggggagcccagaagctgccaccgaaccaagaaccacctctgtgcagaaaagcaaccaccttgttctctattctgctgcccgagacaaccacatcctcctcctcctacacccaaaggctccccgactcggaccgatg

SEQ ID NO: 10862 - DNA, 203 bp, Homo sapiens
ggcgcgccagtcctgagcattgactggggacctcgctcaggaccgtggggagttggctgaaggacttggggagcccagaagctgccaccgaaccaagaaccacctctgtgcagaaaagagtaacgtgcccggtctattctgctgcccgagacaaccacatcctcctcctcctacacccaaaggctccccgactcggaccgatg

SEQ ID NO: 10863 - DNA, 203 bp, Homo sapiens
ggcgcgccagtcctggcacggaactggggacctcgctcaggaccgtggggagttggctgaaggacttggggagcccagaagctgccaccgaaccaagaaccacctctgtgcagaaaagcaaccaccttgttctctattctgctgccatgcttttatcacgcctcctcctcctacacccaaaggctccccgactcggaccgatg

SEQ ID NO: 10864 - DNA, 203 bp, Homo sapiens
ggcgcgccagtccttgtaagagactggggacctcgctcaggaccgtggggagttggctgaaggacttggggagcccagaagctgccaccggcaacccttttcggtctgtgcagaaaagcaaccaccttgttctctattctgctgcccgagacaaccacatcctcctcctcctacacccaaaggctccccgactcggaccgatg

SEQ ID NO: 10865 - DNA, 203 bp, Homo sapiens
ggcgcgccagtcctagcgaaacactggggacctcgctcaggaccgtggtcttgctcacccttgacttggggagcccagaagctgccaccgaaccaagaaccacctctgtgcagaaaagcaaccaccttgttctctattctgctgcccgagacaaccacatcctcctcctcctacacccaaaggctccccgactcggaccgatg

SEQ ID NO: 10866 - DNA, 203 bp, Homo sapiens
ggcgcgccagtcctcgctgtagacttccggtgacgtatttccgcttccctagaatatccgcctacgtatttccgcttccgggacacgtccgcttaaaagcggaagtgacgccctttcccaaccacacctacctcgcctataagaatcagtgtcagttcctctgactcactctgttcgtagaggtcacccgactcggaccgatg

SEQ ID NO: 10867 - DNA, 203 bp, Homo sapiens
ggcgcgccagtcctagctacaaacttccggtgacgtatttccgcttccggtcccgcgaaaattacgtatttccgcttccgggacacgtccgcttaaaagcggaagtgacgccctttcccaaccacacctacctcgcctataagaatcagtgtcagttcctctgactcactctgtgatcgcctcagtttcgactcggaccgatg

SEQ ID NO: 10868 - DNA, 203 bp, Homo sapiens
ggcgcgccagtccttccactccacttcgcaagatcaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 10869 - DNA, 203 bp, Homo sapiens
ggcgcgccagtcctacaatacaacttggctgactgtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatcgactcggaccgatg

SEQ ID NO: 10870 - DNA, 203 bp, Homo sapiens
ggcgcgccagtcctagactcacactttccaaggcgcccgccgactggcatggcgcaccgacccggggccggggccccgggagagggaatgagtgtgagctcgtgagtgggcgccgccgccaccgcccccgccgccgtcgtctcggtagcagccttcgccacgccggggtcttcagctccactggggcccgactcggaccgatg

SEQ ID NO: 10871 - DNA, 203 bp, Homo sapiens
ggcgcgccagtccttccaaacgactttccaaggcgcccgccgactggctgtattggggagggacatatacttctgtcgggagagggaatgagtgtgagctcgtgagtgggcgccgccgccaccgcccccgccgccgtcgtctcggtagcagccttcgccacgccggggtcttcagctccactggggcccgactcggaccgatg

SEQ ID NO: 10872 - DNA, 203 bp, Homo sapiens
ggcgcgccagtcctagtagttcactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcacacatcagatctgacgactcggaccgatg

SEQ ID NO: 10873 - DNA, 203 bp, Homo sapiens
ggcgcgccagtcctgttacaatactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcagctccactggggcccgactcggaccgatg

SEQ ID NO: 10874 - DNA, 203 bp, Homo sapiens
ggcgcgccagtccttaagtctaactttgcccatagcagcgggcgggcactttgcactggaaccccgcggggttcgtcaaggacgcgactctcccgacgcggggaggctattctgcccatttggggacacttccccgccgctgccaggacccgcttctctgaaaggctctccttgcagctgcttagacgcgactcggaccgatg

SEQ ID NO: 10875 - DNA, 203 bp, Homo sapiens
ggcgcgccagtcctcacggatgactttgcccatagcagcgggcgggcactttgcactggaacttacaacacccgagcaaggacgcgactcggggcttcttaaagggctattctgcccatttggggacacttccccgccgctgccaggacccgcttctctgaaaggctctccttgcagctgcttagacgcgactcggaccgatg

SEQ ID NO: 10876 - DNA, 203 bp, Homo sapiens
ggcgcgccagtccttaaagtaaactttgcccatagcagcgggcgggcactttgcactggaacttacaacacccgagcaaggacgcgactctcccgacgcggggactgacacggctgagtttggggacacttccccgccgctgccaggacccgcttctctgaaaggctctccttgcagctgcttagacgcgactcggaccgatg

SEQ ID NO: 10877 - DNA, 203 bp, Homo sapiens
ggcgcgccagtcctttgacgcaactttgcccatagcagcgggcgggcactttgcactggaacttacaacacccgagcaaggacgcgactctcccgacgcggggaggctattctgcccacccctctgttacgacccgccgctgccaggacccgcttctctgaaaggctctccttgcagctgcttagacgcgactcggaccgatg

SEQ ID NO: 10878 - DNA, 203 bp, Homo sapiens
ggcgcgccagtcctacttgggtactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgcgactcggaccgatg

SEQ ID NO: 10879 - DNA, 203 bp, Homo sapiens
ggcgcgccagtcctcgacatttactttgcccatagcagcgggcgggcactttgcactggaacttacaacacccgagcaaggacgcgactctcccgacgcggggaggctattctgcccatttggggacacttccccgccgctgccagtcttataccgatataaaggctctccttgcagctgcttagacgcgactcggaccgatg

SEQ ID NO: 10880 - DNA, 203 bp, Homo sapiens
ggcgcgccagtcctgcgcccagactttgcccatagcagcgggcgggcactttgcactggaacttacaacacccgagggtatgtcgcctgatcccgacgcggggaggctattctgcccatttggggacacttccccgccgctgccaggacccgcttctctgaaaggctctccttgcagctgcttagacgcgactcggaccgatg

SEQ ID NO: 10881 - DNA, 203 bp, Homo sapiens
ggcgcgccagtcctacttatacagaaaggggcggaaaaccactattcggtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgacgactcggaccgatg

SEQ ID NO: 10882 - DNA, 203 bp, Homo sapiens
ggcgcgccagtcctggattatcagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgacgactcggaccgatg

SEQ ID NO: 10883 - DNA, 203 bp, Homo sapiens
ggcgcgccagtcctctgggtcgagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggctagtgagtagtacccgactcggaccgatg

SEQ ID NO: 10884 - DNA, 203 bp, Homo sapiens
ggcgcgccagtccttcaggacgagaaaggggcggggccggcgggcagcgtgcggcagtgcggagctcctgagaccggcgggcacacgggggtctgtggcccccggttgccggagtcaggccgccgtcgcttggttcccgtcggtctgcgggaggcgggttatggcggcggcggcagtgagagctgtgacgactcggaccgatg

SEQ ID NO: 10885 - DNA, 203 bp, Homo sapiens
ggcgcgccagtcctagattaaaagaaaggggcggggccggcgggcagcgtgcggcagtgcggagctcctgagaccggcgggcacacggggtagcccttataggcccgtagcagtggctgccgccgtcgcttggttcccgtcggtctgcgggaggcgggttatggcggcggcggcagtgagagctgtgacgactcggaccgatg

SEQ ID NO: 10886 - DNA, 203 bp, Homo sapiens
ggcgcgccagtcctcggttaatagaactagttaatgcggcccagtccgagacagcagatgaggagactgtccttcctgtttcgcagatgaggaaactgaggcttagagaagtttggcaaattggctaagttcctacagctaattgtgggattagtgatatgcttttctaaagagtagaaaagtcgaagcgactcggaccgatg

SEQ ID NO: 10887 - DNA, 203 bp, Homo sapiens
ggcgcgccagtcctttctcggcagaatgatatctgtcaaaagaaacacttggagagcactgagtttagtaataggtgactgccggaaaaaagggaactttgaatattgtcaagaacaggaggcatgagcccggaacgcgcttgcttttaggagacagccactttctgtgtggtacgctggattcaaggcgactcggaccgatg

SEQ ID NO: 10888 - DNA, 203 bp, Homo sapiens
ggcgcgccagtcctgtgcgaatagaatgatatctgtcaaaagaaacacttggagagcactgagtttagtaataggtgactgccggaaaaaagggaactttgaatcgaagttgtttgctgaggcatgagcccggaacgcgcttgcttttaggagacagccactttctgtgtggtacgctggattcaaggcgactcggaccgatg

SEQ ID NO: 10889 - DNA, 203 bp, Homo sapiens
ggcgcgccagtccttagagcgcagaatgatatctgtcaaaagaaacacttggagagcactgagtttagtaataggtgactgccggaaaaagaaaggtgacatcgattgtcaagaacaggaggcatgagcccggaacgcgcttgcttttaggagacagccactttctgtgtggtacgctggattcaaggcgactcggaccgatg

SEQ ID NO: 10890 - DNA, 203 bp, Homo sapiens
ggcgcgccagtcctatgtgagaagacagccttgtctcgtctgaaggaacagaaatctctgggccaggtggaacccagggtcagagagggatgggagagagattccccaggctctcagagaagatcagcagaaagtctgcaagaccctaagaaccatcagccctcagctgcacctcctcccctccaaggcgactcggaccgatg

SEQ ID NO: 10891 - DNA, 203 bp, Homo sapiens
ggcgcgccagtcctcagtatttagacagccttgttctacagaaatgatgagaaatctctgggccaggtggaacccagggtcagagagggatgggagagagattccccaggctctcagagaagatcagcagaaagtctgcaagaccctaagaaccatcagccctcagctgcacctcctcccctccaaggcgactcggaccgatg

SEQ ID NO: 10892 - DNA, 203 bp, Homo sapiens
ggcgcgccagtcctctttggcgagacagccttgttctacagatcctccagaggtaacggaaaccaggtggaacccagggtcagagagggatgggagagagattccccaggctctcagagaagatcagcagaaagtctgcaagaccctaagaaccatcagccctcagctgcacctcctcccctccaaggcgactcggaccgatg

SEQ ID NO: 10893 - DNA, 203 bp, Homo sapiens
ggcgcgccagtcctaagagacaagacagccttgttctacagatcctcccagaaatctctgggccaggtggaacccagggtcagagagggatgggagagagattccccaggctctcagagaagatcagcagaaagtctgcaagaccctaagaaccatcagccctcagctgcacctaggttataagtccacgactcggaccgatg

SEQ ID NO: 10894 - DNA, 203 bp, Homo sapiens
ggcgcgccagtcctagggctttagacctctctgtgcttagggcaaacatcatttggccttaaatgggattctgtgaacttactcaaaagaattgacagctggactgttctttggggccttatgtggtgtttgcctctgaggtactcaggggcatttaggtttttcctcattcttaaataataatgaaccgactcggaccgatg

SEQ ID NO: 10895 - DNA, 203 bp, Homo sapiens
ggcgcgccagtcctggtgtttcagacctctctgtgcttagggcaaacatcatttggccttaaatgggattctgtgagaggggatccctccattgacagctggactgttctttggggccttatgtggtgtttgcctctgaggtactcaggggcatttaggtttttcctcattctttttaggatggtttacgactcggaccgatg

SEQ ID NO: 10896 - DNA, 203 bp, Homo sapiens
ggcgcgccagtccttaagattgagacctctctgtgcttagggcaaacatcatttggccttaaatgggattctgtgagaggggatccctccattgacagctggactgttctttggggccttatgtggtgtttgcctctgaggtactcgatacgggcatcccttttcctcattcttaaataataatgaaccgactcggaccgatg

SEQ ID NO: 10897 - DNA, 203 bp, Homo sapiens
ggcgcgccagtcctatagtgctagacgccatagttccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctacccgactcggaccgatg

SEQ ID NO: 10898 - DNA, 203 bp, Homo sapiens
ggcgcgccagtcctagcaatatagactctgtcttcagccaggcactccctccctccctcccaatcgatatgggcgtaacttctgcctgcccagcctgagctgccgcaccagctgctcctcccggccctgcgtgccccccagctgccacagctgcaccctgcccggggcctgcaacatccccgccaatgcgactcggaccgatg

SEQ ID NO: 10899 - DNA, 203 bp, Homo sapiens
ggcgcgccagtcctatcgggtcagactctgtcttcagccaggcactccctccctccctcccagcactatgccctacaacttctgcctgcccagcctgagctgccgcaccagctgcatactggggccctgcgtgccccccagctgccacagctgcaccctgcccggggcctgcaacatccccgccaatgcgactcggaccgatg

SEQ ID NO: 10900 - DNA, 203 bp, Homo sapiens
ggcgcgccagtcctattcccatagactctgtcttcagccaggcactccctccctccctcccagcactatgccctacaacttctgcctgcccagcctgagctgccgcaccagctgctccctggaatttacgcagccccccagctgccacagctgcaccctgcccggggcctgcaacatccccgccaatgcgactcggaccgatg

SEQ ID NO: 10901 - DNA, 203 bp, Homo sapiens
ggcgcgccagtcctcctgctcgagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgcgactcggaccgatg

SEQ ID NO: 10902 - DNA, 203 bp, Homo sapiens
ggcgcgccagtcctcactgtgaagactctgtcttcagccaggcactccctccctccctcccagcactatgccctacaacttctgcctgcccagcctgagctgccgcaccagctgctcctcccggccctgcgtgccccccagctgccgagttgttctaaaccccggggcctgcaacatccccgccaatgcgactcggaccgatg

SEQ ID NO: 10903 - DNA, 203 bp, Homo sapiens
ggcgcgccagtcctgttgtggtagactctgtcttcagccaggcactccctccctccctcccagcactatgccctacaacttctgcctgcctgatgcaccggttggcaccagctgctcctcccggccctgcgtgccccccagctgccacagctgcaccctgcccggggcctgcaacatccccgccaatgcgactcggaccgatg

SEQ ID NO: 10904 - DNA, 203 bp, Homo sapiens
ggcgcgccagtcctgcggatctagactctgtcttcagccaggcactccctccctccctcccagcactatgccctacgtgcgtccagacagcagcctgagctgccgcaccagctgctcctcccggccctgcgtgccccccagctgccacagctgcaccctgcccggggcctgcaacatccccgccaatgcgactcggaccgatg

SEQ ID NO: 10905 - DNA, 203 bp, Homo sapiens
ggcgcgccagtcctattgtcttagactctgtcttcagccaggcactcctgggacagaggtaggcactatgccctacaacttctgcctgcccagcctgagctgccgcaccagctgctcctcccggccctgcgtgccccccagctgccacagctgcaccctgcccggggcctgcaacatccccgccaatgcgactcggaccgatg

SEQ ID NO: 10906 - DNA, 203 bp, Homo sapiens
ggcgcgccagtcctgttgtaacagactggagagaagcaggcctgagcccaaatggccaggtgtcctggggactcccaggaccacaggctgagacgagacgcagggtggctggaggaagtgagaggtgaactcagcctgggactggctgggcgagactctccacctgctccctgggaccatcgcccacccgactcggaccgatg

SEQ ID NO: 10907 - DNA, 203 bp, Homo sapiens
ggcgcgccagtcctatggtgagagactggagagaagcaggcctgagcctccccaaaggcagctcctggggactcccaggaccacaggctgagacgagacgcagggtggctggaggaaggccatttgattaaaagcctgggactggctgggcgagactctccacctgctccctgggaccatcgcccacccgactcggaccgatg

SEQ ID NO: 10908 - DNA, 203 bp, Homo sapiens
ggcgcgccagtcctttgtagtaagactgtgcagtccacggcctgaacaatgagcatcctcctctaaacgcgtgtcaagacaaaagatgcttcagctttggaaacttgttctcctgtgcggcgtgctcactgggacctcagagtctcttcttgacaatcttggcaatgacctaagcaatgtcgtggatacgactcggaccgatg

SEQ ID NO: 10909 - DNA, 203 bp, Homo sapiens
ggcgcgccagtcctgggtaaggagactgtgcagtggggcaaggatttcatgagcatcctcctctaaacgcgtgtcaagacaaaagatgcttcagctttggaaacaaccctctagaacaggcgtgctcactgggacctcagagtctcttcttgacaatcttggcaatgacctaagcaatgtcgtggatacgactcggaccgatg

SEQ ID NO: 10910 - DNA, 203 bp, Homo sapiens
ggcgcgccagtcctatgagcccagactgtgcagtggggcaaggatttcatgagcatcctcctctaaacgcgtgtcaagacaaaagatgcttcagctttggaaacttgttctcctgtgcggcgtgctcactggcgagcatatacgatttcttgacaatcttggcaatgacctaagcaatgtcgtggatacgactcggaccgatg

SEQ ID NO: 10911 - DNA, 203 bp, Homo sapiens
ggcgcgccagtccttgcttgtgagactgtgcagtggggcaaggatttcatgagcatcctcctctaaacgcgtgtcaagacaaaagatgcttcagctttggaaacttgttctcctgtgcggcgtgctcactgggacctcagagtctcttcttgacaatcttaatccctttacctccaatgtcgtggatacgactcggaccgatg

SEQ ID NO: 10912 - DNA, 203 bp, Homo sapiens
ggcgcgccagtcctcgctgacaagactgtgcagtggggcaaggatttcatgagcatcctcctctaaacgcgtgtcaagacaaaagatgcttcagctttggaaacttgttctcctgtgcggcgtgctcactgggacctcagagtctcttcttgacaatcttggcaatgacctaagcaatgtcgtggatacgactcggaccgatg

SEQ ID NO: 10913 - DNA, 203 bp, Homo sapiens
ggcgcgccagtcctgttaagccagactgtgcagtggggcaaggatttcatgagcatcctcctctaaacgcgtgtcaagacaaaagatgcttcagctttggaaacttgttctcctgtgcggcgtgctcactgggacctcagagtctcttcttgacaatcttggcaatgacctaaggtcgagatctttcccgactcggaccgatg

SEQ ID NO: 10914 - DNA, 203 bp, Homo sapiens
ggcgcgccagtcctgcccgcttagactgtgcagtggggcaaggatttcatgagcatcctcctctaaacgcgtgtcaagacaaaagatgcttcagctttggaaacttgttctcctgtgcttttcctcgcgaccgacctcagagtctcttcttgacaatcttggcaatgacctaagcaatgtcgtggatacgactcggaccgatg

SEQ ID NO: 10915 - DNA, 203 bp, Homo sapiens
ggcgcgccagtcctcgcaatcgagactgtgcagtggggcaaggatttcggtgctgcggatgcctaaacgcgtgtcaagacaaaagatgcttcagctttggaaacttgttctcctgtgcggcgtgctcactgggacctcagagtctcttcttgacaatcttggcaatgacctaagcaatgtcgtggatacgactcggaccgatg

SEQ ID NO: 10916 - DNA, 203 bp, Homo sapiens
ggcgcgccagtccttcaacctaagagaaagaaaggactctcagactgttggagcagaactactgagaaaaaccaggcattgtatcttcagttgtcatcaagttcgcaatcagattggaaaagctcaacttgaagctttcttgcctgcagtgaagcagagactgttcggccggatacgtaataaaaaaccgactcggaccgatg

SEQ ID NO: 10917 - DNA, 203 bp, Homo sapiens
ggcgcgccagtcctcttccctgagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaaccgactcggaccgatg

SEQ ID NO: 10918 - DNA, 203 bp, Homo sapiens
ggcgcgccagtcctcaagttgaagagaagagacttgtttggaaatatactgggcgtcactggttaacttaggattaaagacattgactagaaggtcaagaaaagggaactctataatttcaaaaatgttgagcctatttgatacatttaatgcacgtaggcaagaaaacataacaaaatcagccggtgcgactcggaccgatg

SEQ ID NO: 10919 - DNA, 203 bp, Homo sapiens
ggcgcgccagtcctatgacctaagagaccacagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaaataggcatgttggcgactcggaccgatg

SEQ ID NO: 10920 - DNA, 203 bp, Homo sapiens
ggcgcgccagtcctgtctgagtagagaccacagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaggacctagcaacaccgactcggaccgatg

SEQ ID NO: 10921 - DNA, 203 bp, Homo sapiens
ggcgcgccagtccttgtcccagagagaccacagactttgagggaagctcactcaggatctgctctccggcaaagtagtaagtgaggtgctgagagcagaatgagctactttgtggattctgctgggagcagccccgtcccttactcagcgcctcgtcctgggtactgcctcttcggacctagcaacaccgactcggaccgatg

SEQ ID NO: 10922 - DNA, 203 bp, Homo sapiens
ggcgcgccagtcctgcatgtcgagagaccacagactttgagggaagctcactcaggatctgctctccggcaaagtagtaagtgaggtgctgagagcagaatgagctactttgtggattctgctgggagcagccccgtcccttactctatatacacaagaacagtggtgaggcaaggacctagcaacaccgactcggaccgatg

SEQ ID NO: 10923 - DNA, 203 bp, Homo sapiens
ggcgcgccagtcctatctaacaagagaccacagactttgagggaagctcactcaggatctgctctccggcaaagtagtaagtgaggtgctttcgctgactgagactactttgtggattctgctgggagcagccccgtcccttactcagcgcctcgtcctgcagtggtgaggcaaggacctagcaacaccgactcggaccgatg

SEQ ID NO: 10924 - DNA, 203 bp, Homo sapiens
ggcgcgccagtcctttcgcgcgagagaccacagactttgagggaagctcactcaggatctgctctccggcaaagtatatttgacacgctggagagcagaatgagctactttgtggattctgctgggagcagccccgtcccttactcagcgcctcgtcctgcagtggtgaggcaaggacctagcaacaccgactcggaccgatg

SEQ ID NO: 10925 - DNA, 203 bp, Homo sapiens
ggcgcgccagtcctgcccttagagagaccacagactttgagggaagctttagacaacatatttctccggcaaagtagtaagtgaggtgctgagagcagaatgagctactttgtggattctgctgggagcagccccgtcccttactcagcgcctcgtcctgcagtggtgaggcaaggacctagcaacaccgactcggaccgatg

SEQ ID NO: 10926 - DNA, 203 bp, Homo sapiens
ggcgcgccagtcctgtctgcccagagaccacagatacctttcctcagacactcaggatctgctctccggcaaagtagtaagtgaggtgctgagagcagaatgagctactttgtggattctgctgggagcagccccgtcccttactcagcgcctcgtcctgcagtggtgaggcaaggacctagcaacaccgactcggaccgatg

SEQ ID NO: 10927 - DNA, 203 bp, Homo sapiens
ggcgcgccagtcctctgaagtcagagagaaaaaatactgttggcagcagcacaatgtttgggctaagacctggtcttgaaagcgccacaagcagcagctgctgagccatggctgaaggggaaatcaccaccttcacagccctgaccgagaagtttaatcttgggagccttccggacaagaagcccaaacgactcggaccgatg

SEQ ID NO: 10928 - DNA, 203 bp, Homo sapiens
ggcgcgccagtcctaacattggagagagaaaaaatactgttggcagcagcacaatgtttgggtatcagggaaaaagtgaaagcgccacaagcagcagctgctgagccatggctgaaggggaaatcaccaccttcacagccctgaccgagaagtttaatctgcctccagggaattacaagaagcccaaacgactcggaccgatg

SEQ ID NO: 10929 - DNA, 203 bp, Homo sapiens
ggcgcgccagtcctttattcggagagcgggagaacgcgtcctcgcccgaaccagcaatatggccggagctggcccatggggagcaggcgcccggtgccggccacgacgaccgccaccgcccgcgccgcgaccggccggtgaagcccagggacccccctctgggagagccccatgagggcaggagagtgcgactcggaccgatg

SEQ ID NO: 10930 - DNA, 203 bp, Homo sapiens
ggcgcgccagtcctctggataaagagctgggagaaggcagtgagcgagatacgcaactatggggtccgtgcggagcaggcgagcgagcgggaagacgcagccaccttcctcaccagccagcccacagcggtttgttccccttctcgggagtgcgccaatgcctgggccgacccaaaccctgtccccaacgactcggaccgatg

SEQ ID NO: 10931 - DNA, 203 bp, Homo sapiens
ggcgcgccagtccttctagcacagagctgggagaaggcagtgagcgagcaggcggcaggcagggtccgtgcggagcaggcgagcgagcgggaagacgcagccaccttcctcaccagccagcccacagcggttgcactgttcaagatggagtgcgccaatgcctgggccgacccaaaccctgtccccaacgactcggaccgatg

SEQ ID NO: 10932 - DNA, 203 bp, Homo sapiens
ggcgcgccagtcctgagcggcaagagctgggagaaggcagtgagcgagcaggcggcaggcagggtccgtgcggagcaggcgagcgagcgggaagacgcagccaccttcctcaccagccagcccacagcggtttgttccccttctcgggagtgcgccaatgcctgggccgacccattattaactatatgcgactcggaccgatg

SEQ ID NO: 10933 - DNA, 203 bp, Homo sapiens
ggcgcgccagtcctggcatgtcagagctgggagaaggcagtgagcgagcaggcggcaggcagggtccgtgcggagcaggcgagcgagcgggaagacgcagccaccttcctcaccagccagcccacagcggtttgttccccttctcgggagtgcgccaatgtaccacgtctgtagaaccctgtccccaacgactcggaccgatg

SEQ ID NO: 10934 - DNA, 203 bp, Homo sapiens
ggcgcgccagtcctttctaaacagagctgggagaaggcagtgagcgagcaggcggcaggcagggtccgtgcggagcaggcgagcgagcgggaagacgcagccaccttcctcaccagcctagagggtatctgatgttccccttctcgggagtgcgccaatgcctgggccgacccaaaccctgtccccaacgactcggaccgatg

SEQ ID NO: 10935 - DNA, 203 bp, Homo sapiens
ggcgcgccagtcctcttcatcaagagctgggagaaggcagtgagcgagcaggcggcaggcagggtccgtgcggagctcagacaaatagacgaagacgcagccaccttcctcaccagccagcccacagcggtttgttccccttctcgggagtgcgccaatgcctgggccgacccaaaccctgtccccaacgactcggaccgatg

SEQ ID NO: 10936 - DNA, 203 bp, Homo sapiens
ggcgcgccagtccttgtaattaagaggagcggcgctcaggttattccaggatctttggagacccgaggaaagccgtgttgaccaaaagcatccggcggacgcgccagagaaaaaagatggcagaaccaagggcaactaaagccgtcaggttctgaacagctggtagatgggctggcttactgaaggaccgactcggaccgatg

SEQ ID NO: 10937 - DNA, 203 bp, Homo sapiens
ggcgcgccagtccttcatagtgagaggagggaactgaatgacatcccaggattacataaactgtcagaggcagccgaagagttcacaagttacgcaagctctgtccggcgggtgccgctgtgtaggaaagaagctaaagcacttccagagcctgtccggagctcagaggttcggaagacttatcgacccgactcggaccgatg

SEQ ID NO: 10938 - DNA, 203 bp, Homo sapiens
ggcgcgccagtccttaacgcccagaggagggaactgaatgacatcccaggattacataaactgtcagaggcagccgttccagctttgctagtgaagcctggaagccggcgggtgccgctgtgtaggaaagaagctaaagcacttccagagcctgtccggagctcagaggttcggaagacttatcgacccgactcggaccgatg

SEQ ID NO: 10939 - DNA, 203 bp, Homo sapiens
ggcgcgccagtccttccgtaatagaggtctgaggtttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacgactcggaccgatg

SEQ ID NO: 10940 - DNA, 203 bp, Homo sapiens
ggcgcgccagtcctgcgggtggagagtaccggaaatccagattagagagcttaattagctctgtattaataataacactactattccaataactggaatcaccagcttgatttatctccaaaatgattcaaagaaaacaaatcatattaagactatcctaagcacgaacccatatcgtccttcaaatccgactcggaccgatg

SEQ ID NO: 10941 - DNA, 203 bp, Homo sapiens
ggcgcgccagtcctagtaaaccagatcagcgaattaaaatagtgattcaaaaatattttttaccgaaaggcctgcgctacgtgaaagtagtattcaaaataaaatcccgtgcggtcggaaacaaaaattaatttaaattttttaattccgaaacttaaaaccaagtttaaagaaaacttaaaatcaagcgactcggaccgatg

SEQ ID NO: 10942 - DNA, 203 bp, Homo sapiens
ggcgcgccagtcctttctggaaagcaacctatgagaatttcccctattccccctgatgcttccaggagaatcaacaatcagtccgattttaccggtggtaacttgattgaaattatagaaaaaataagcctagaaggatatcttacggtgatgtgcgggcacttcgaaaatagaattgatcagtaatccgactcggaccgatg

SEQ ID NO: 10943 - DNA, 203 bp, Homo sapiens
ggcgcgccagtcctcgtgtgccagcaacctatgagaatttcccctattccccctgatgcttccaggagaatcaacaatcagtccgattttaccggtggtaacttgattgaaattatagtttcttattctaaggaaggatatcttacttctcgacttcccaacttcgaaaatagaattgatcagtaatccgactcggaccgatg

SEQ ID NO: 10944 - DNA, 203 bp, Homo sapiens
ggcgcgccagtcctcggcagcgagcaatgaacgagattgctggtattactggccttggagaagaagcactatctctccaaagacaaacagaaagtttggccatattatgtaatcacacttttggaagtaatataatgagaccccaccgcatccttatcggaaaaggagttgaaggcagagttggagagcgactcggaccgatg

SEQ ID NO: 10945 - DNA, 203 bp, Homo sapiens
ggcgcgccagtccttcgtatgtagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaaatcacgcccgtaaacgactcggaccgatg

SEQ ID NO: 10946 - DNA, 203 bp, Homo sapiens
ggcgcgccagtccttcataaatagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagttcctgcgactcggaccgatg

SEQ ID NO: 10947 - DNA, 203 bp, Homo sapiens
ggcgcgccagtcctccttagagagcagctgatacccagggaggtgtcaggacctgcccggggcgcggggtcgccggaagccaggcgggagccccggctgctttcaaatggcagcacaccataagtgaccctccctgggctgctttctttcgattatcatcagtgaccctaccccggctgctcttcccacgactcggaccgatg

SEQ ID NO: 10948 - DNA, 203 bp, Homo sapiens
ggcgcgccagtcctcactttccagcagctgatacccagggaggtgtcaggacctgcccggggcgcggggtcgccggaagccaggcgggagccccggctgctttctggcaatctagtctcataagtgaccctccctgggctgctttctttcgattatcatcagtgaccctaccccggctgctcttcccacgactcggaccgatg

SEQ ID NO: 10949 - DNA, 203 bp, Homo sapiens
ggcgcgccagtccttggccctaagcagctgatacccagggaggtgtcaggacctgcccggggcgcggggtcgccggaagccaggcgggagccccggctgctttctggcaatctagtctcataagtgaccctcgagacatacaggcatttcgattatcatcagtgaccctaccccggctgctcttcccacgactcggaccgatg

SEQ ID NO: 10950 - DNA, 203 bp, Homo sapiens
ggcgcgccagtcctctggaaggagcagctgatacccagggaggtgtcaggacctgcccggggcgcggggtcgccggcccttttaaactgcccccggctgctttctggcaatctagtctcataagtgaccctccctgggctgctttctttcgattatcatcagtgaccctaccccggctgctcttcccacgactcggaccgatg

SEQ ID NO: 10951 - DNA, 203 bp, Homo sapiens
ggcgcgccagtccttttgagtgagcatgacgtaccaaacaggcacgagataagtcccggacatgatggcacatggaatgacaatcagctacaagaaatggcccaactgaggattaagcaccaagaggaactgactgaattacacaaccgtacctaccgtatcaactggtgattgacctgaataaccaacgactcggaccgatg

SEQ ID NO: 10952 - DNA, 203 bp, Homo sapiens
ggcgcgccagtcctgaattaatagccagagggcagtgtgtcgtaacggtacggatcaacctcgaaccgactactttgggtgtccgtgtttcattttattcctatactggctgcttatggtgacaattgagagattgttaccatatagctattggattggccatccggtgaccaatagagctattatatcgactcggaccgatg

SEQ ID NO: 10953 - DNA, 203 bp, Homo sapiens
ggcgcgccagtcctccgtccgcagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgcgactcggaccgatg

SEQ ID NO: 10954 - DNA, 203 bp, Homo sapiens
ggcgcgccagtcctgtataagaagccagccactggagtcgcagcccgcctcggccgccgcggtgtgaaagtcgagagggagacggccggaagccagtaaaagaagagaaaatggaagaaagggacctgctgtccgacttacaggacatcagcgacagcgagaggaagaccagctcggccgagtcctcgcgactcggaccgatg

SEQ ID NO: 10955 - DNA, 203 bp, Homo sapiens
ggcgcgccagtccttggtggttagccagccactggagtcgcagcccgcgagccaataaatttgagcggttcgagttgggagacggccggaagccagtaaaagaagagaaaatggaagaaagggacctgctgtccgacttacaggacatcagcgacagcgagaggaagaccagctcggccgagtcctcgcgactcggaccgatg

SEQ ID NO: 10956 - DNA, 203 bp, Homo sapiens
ggcgcgccagtcctaacgttcaagcccaaccggctaaccgatgacagaccgtggcaaggaggtgtacagccctgactttcatagcctcggaggagaaggtcttggtggccgacaagtctggagacgtctactccttttcggtgctggagccacacgggtgtggccgtctagagctggggcacctgtctcgactcggaccgatg

SEQ ID NO: 10957 - DNA, 203 bp, Homo sapiens
ggcgcgccagtcctcagacgtgagcccgatcgtagttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 10958 - DNA, 203 bp, Homo sapiens
ggcgcgccagtcctagtaaggtagccggcgcatcaatcatgcaaaatcactattttgtactactaactcattaagaaaaacttaggatccaagagatttactctaggatctcctattaagcttagcagtcattagttgagagttcaacttgcaaaactctaaccttcactctaataacaattcatccacgactcggaccgatg

SEQ ID NO: 10959 - DNA, 203 bp, Homo sapiens
ggcgcgccagtcctgagacgaaagcgccactctgctggctgaggctgcggagagtgtgcggcgaggccgcccacagcgcggtcgtgatgtctcgggagtcggatgttgaggctcagcagtctcatggcagcagtgcctgttcacagccccatggcagcgttacccagtcccaaggctcctcctcacagcgactcggaccgatg

SEQ ID NO: 10960 - DNA, 203 bp, Homo sapiens
ggcgcgccagtcctaagcctcgagcgccactctgctggctgaggctgcggagagtgtgcggctccaggtgggctcacgcggtcgtgatgtctcgggagtcggataggatattggctatgtctcatggcagcagtgcctgttcacagccccatggcagcgttacccagtcccaaggctcctcctcacagcgactcggaccgatg

SEQ ID NO: 10961 - DNA, 203 bp, Homo sapiens
ggcgcgccagtcctcgtagggcagcgccactctgctggctgaggctgcggagagtgtgcggctccaggtgggctcacgcggtcgtgatgtctcgggagtcggatgttgaggctcagcagtctcatggcagcagtgcctgttcacagattataattgttcgtacccagtcccaaggctcctcctcacagcgactcggaccgatg

SEQ ID NO: 10962 - DNA, 203 bp, Homo sapiens
ggcgcgccagtcctagggagtcagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgtccaagtcgagatgagctcctcctcacagcgactcggaccgatg

SEQ ID NO: 10963 - DNA, 203 bp, Homo sapiens
ggcgcgccagtcctgttggcatagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagcgactcggaccgatg

SEQ ID NO: 10964 - DNA, 203 bp, Homo sapiens
ggcgcgccagtccttctggagcagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaagttctggtactcggtcgactcggaccgatg

SEQ ID NO: 10965 - DNA, 203 bp, Homo sapiens
ggcgcgccagtcctgtaagacaagcgccactctgctggctgaggctgcggagagtgtgcggctccaggtgggctcacgcggtcgtgatgtgcattctactcagggttgaggctcagcagtctcatggcagcagtgcctgttcacagccccatggcagcgttacccagtcccaaggctcctcctcacagcgactcggaccgatg

SEQ ID NO: 10966 - DNA, 203 bp, Homo sapiens
ggcgcgccagtccttccgcgaaagcgccagtttcgcgctgagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagacgactcggaccgatg

SEQ ID NO: 10967 - DNA, 203 bp, Homo sapiens
ggcgcgccagtcctacagccaaagcgcggccgttcttacgctccgatggtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtacgactcggaccgatg

SEQ ID NO: 10968 - DNA, 203 bp, Homo sapiens
ggcgcgccagtcctgaagttacagcgcggccgttgggggtgaggccgcagacacaacatcagacaaagggccgcgggcggcgggcagtggtgtcccagtctcccggtgcttccctgaggctgaggcgcccggcctcccgcccgccgcgctccagatgaagtgtgagcactgcacgcgcaaggaatgtacgactcggaccgatg

SEQ ID NO: 10969 - DNA, 203 bp, Homo sapiens
ggcgcgccagtccttagaactaagcgcggccgttgggggtgaggccgcgtcgggggaggacaacaaagggccgcgggcggcgggcagtgggccgagcaggcggtggtgcttccctgaggctgaggcgcccggcctcccgcccgccgcgctccagatgaagtgtgagcactgcacgcgcaaggaatgtacgactcggaccgatg

SEQ ID NO: 10970 - DNA, 203 bp, Homo sapiens
ggcgcgccagtcctcttaccgtagcgcggccgttgggggtgaggccgcgtcgggggaggacaacaaagggccgcgggcggcgggcagtggtgtcccagtctcccaccctaattaccctgctgaggcgcccggcctcccgcccgccgcgctccagatgaagtgtgagcactgcacgcgcaaggaatgtacgactcggaccgatg

SEQ ID NO: 10971 - DNA, 203 bp, Homo sapiens
ggcgcgccagtcctataagttgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcactaatttacccacatcgactcggaccgatg

SEQ ID NO: 10972 - DNA, 203 bp, Homo sapiens
ggcgcgccagtccttgagtgatagcgcggccgttgggggtgaggccgcgtcgggggaggacactcgcctaggatccgcggcgggcagtggtgtcccagtctcccggtgcttccctgaggctgaggcgcccggcctcccgcccgccgcgctccagatgaagtgtgagcactgcacgcgcaaggaatgtacgactcggaccgatg

SEQ ID NO: 10973 - DNA, 203 bp, Homo sapiens
ggcgcgccagtcctaccatcaaagcggagcctggaggccaggtctctgcctcggaagtgagtctggtctgtgggagcccctgcctgtcccctcctgggtcactggtgtttgaggattttgctaacctgacgccctttgtcaaggaagagctgaggtttgccatccagaacaagcacctctgccaccggcgactcggaccgatg

SEQ ID NO: 10974 - DNA, 203 bp, Homo sapiens
ggcgcgccagtcctggagactaagcggagcctggaggccaggtctctgcctcggaagtgagtgcttctgccatcgtcccctgcctgtcccctcctgggtcactgcgaaccttttcgcgtgctaacctgacgccctttgtcaaggaagagctgaggtttgccatccagaacaagcacctctgccaccggcgactcggaccgatg

SEQ ID NO: 10975 - DNA, 203 bp, Homo sapiens
ggcgcgccagtcctcttatgtgagcggagcctggaggccaggtctctgcctcggaagtgagtgcttctgccatcgtcccctgcctgtcccctcctgggtcactggtgtttgaggattttgctaacctgacgcaaaggtggggtcctgagctgaggtttgccatccagaacaagcacctctgccaccggcgactcggaccgatg

SEQ ID NO: 10976 - DNA, 203 bp, Homo sapiens
ggcgcgccagtccttaaacaatagcggagcctggaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggcgactcggaccgatg

SEQ ID NO: 10977 - DNA, 203 bp, Homo sapiens
ggcgcgccagtcctaatcgtgtagcggagcctggaggccaggtctctgcctcggaagtgagtgcttctgccatcgtcccctgcctgtcccctcctgggtcactggtgtttgaggattttgctaacctgacgccctttgtcaaggaagagctgaggtttgctcagtgaccagcttacctctgccaccggcgactcggaccgatg

SEQ ID NO: 10978 - DNA, 203 bp, Homo sapiens
ggcgcgccagtcctcctaaaggagcggagcctggaggccaggtctctgttgattgcaatcacgcttctgccatcgtcccctgcctgtcccctcctgggtcactggtgtttgaggattttgctaacctgacgccctttgtcaaggaagagctgaggtttgccatccagaacaagcacctctgccaccggcgactcggaccgatg

SEQ ID NO: 10979 - DNA, 203 bp, Homo sapiens
ggcgcgccagtcctagcccagaagcggagcctgggtagatcaggctctcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggcgactcggaccgatg

SEQ ID NO: 10980 - DNA, 203 bp, Homo sapiens
ggcgcgccagtcctggagtagtagcggccacatcgtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggccgactcggaccgatg

SEQ ID NO: 10981 - DNA, 203 bp, Homo sapiens
ggcgcgccagtcctctgtgaagagcggcgggtcacgtgacgcggtgccacagtgatgataggccaagatggcggtgtgcatcgcggtgattgccaaggagaattaccccctctacattcgcagcacccctacggagaacgagctgaagttccactacatggtgcacacatctctggacgtggtggatgcgactcggaccgatg

SEQ ID NO: 10982 - DNA, 203 bp, Homo sapiens
ggcgcgccagtcctagtgctgcagcggcgggtcacgtgacgcggtgcctggcgccgagcctcccaagatggcggtgtgcatcgcggtgattgccaaggagaattaccccctctacattcgcagcacccctacaccacgacgtgaacagttccactacatggtgcacacatctctggacgtggtggatgcgactcggaccgatg

SEQ ID NO: 10983 - DNA, 203 bp, Homo sapiens
ggcgcgccagtcctattcacccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgcgactcggaccgatg

SEQ ID NO: 10984 - DNA, 203 bp, Homo sapiens
ggcgcgccagtcctcttccactagcggcgggtcacgtgacgcggtgcctggcgccgagcctcccaagatggcggtgtgcatcgcggtgattgccaaggagaattaccccctctacattcgcagcacccctacggagaacgagctgagagaaactacaccagtgcacacatctctggacgtggtggatgcgactcggaccgatg

SEQ ID NO: 10985 - DNA, 203 bp, Homo sapiens
ggcgcgccagtcctaggtattgagcggcgggtcacgtgacgcggtgcctggcgccgagcctcccaagatggcggtgtgcatcgcggtgattgccaaggagaattaccccctctacattgtacctgatttacaggagaacgagctgaagttccactacatggtgcacacatctctggacgtggtggatgcgactcggaccgatg

SEQ ID NO: 10986 - DNA, 203 bp, Homo sapiens
ggcgcgccagtcctacatggagagctgcaacccagcagccagcctgtcgtaacgcgcaagtccgtggcggaaccgaaagaggatacccctcgtgtttccttttattcttgaatggctgcttatggtgacaatcatagattgttatcataaagcgagttggattggccatccagtgtgaatcagattaacgactcggaccgatg

SEQ ID NO: 10987 - DNA, 203 bp, Homo sapiens
ggcgcgccagtcctacggattaagctgcaacccagcagccagcctgtcgtaacgcgcaagtccgtggcggaaccgactactttgggtgtccgtgtttccttttattcttgaatggctgcttatggtgacaatcatagattgttatcataaagcgagttggattggccatccagtcgattcttagcattcgactcggaccgatg

SEQ ID NO: 10988 - DNA, 203 bp, Homo sapiens
ggcgcgccagtcctagctggatagctgcaacccagcagccagcctgtcgtaacgcgcaagtccgtggcggaaccgactactttgggtgtccgtgtttccttttattcttgaatggctgcttatggtgacaatttgtctagtaccggataaagcgagttggattggccatccagtgtgaatcagattaacgactcggaccgatg

SEQ ID NO: 10989 - DNA, 203 bp, Homo sapiens
ggcgcgccagtcctgacagaagagctgcaacccagcagccagcctgtcgtaacgcgcaagtccgtggcggaaccgactactttgggtgtctcatcacgaaggggttcttgaatggctgcttatggtgacaatcatagattgttatcataaagcgagttggattggccatccagtgtgaatcagattaacgactcggaccgatg

SEQ ID NO: 10990 - DNA, 203 bp, Homo sapiens
ggcgcgccagtcctcgtagcctagctggtgtctgagggattacgactcgcgtggtcggacagcacatgttagtcatgtattatggtgtttcccaacacgtatctttgctctagtattgaactttagtgatgacatcctacttgtgctacacctgattagttagcccttgtggatacgccactgccgctcgactcggaccgatg

SEQ ID NO: 10991 - DNA, 203 bp, Homo sapiens
ggcgcgccagtcctaccggcagagctggtgtctgagggattacgactcgcgtggtcggacagcacatgttagtcatgtattatggtgtttcccaacacgtatctttgctctagtattgaactttagtgatgagtgtacttggcatgtacacctgattagtatatagagtaatcgacgccactgccgctcgactcggaccgatg

SEQ ID NO: 10992 - DNA, 203 bp, Homo sapiens
ggcgcgccagtcctagtgggacagctggtgtctgagggattacgactcgcgtggtcggacagcacatgttagtcatgtattatggtgtttcccaacacgtatctttgctctagtattgaactttagtgatgagtgtacttggcatgtacacctgattagttagcccttgtggatggtgattactgtaccgactcggaccgatg

SEQ ID NO: 10993 - DNA, 203 bp, Homo sapiens
ggcgcgccagtccttatacgtaagctggtgtctgccatgaacacttctgcgtggtcggacagcacatgttagtcatgtattatggtgtttcccaacacgtatctttgctctagtattgaactttagtgatgagtgtacttggcatgtacacctgattagttagcccttgtggatacgccactgccgctcgactcggaccgatg

SEQ ID NO: 10994 - DNA, 203 bp, Homo sapiens
ggcgcgccagtcctacaagaatagctttttttccccgtcctgcagcaagtccggaagaaggtccgggggctggagtcctgggacctagctcgggaccggcctggagatggagttcgactgcgagggcctgagacggctgcttggcaagtacaagttcagggacctaactgtggaagaactaaggaatgcgactcggaccgatg

SEQ ID NO: 10995 - DNA, 203 bp, Homo sapiens
ggcgcgccagtcctcgccggtcaggacacaacataccgatatgttataagaatccttgtgtgtagatctttggtggcagtttgaaaattgcaaggagggactttaagactacttctgatttgcaaagattgtctgtgctctgagcaggctgaagtgactggacgagacgcactgttggagaaataaaacgactcggaccgatg

SEQ ID NO: 10996 - DNA, 203 bp, Homo sapiens
ggcgcgccagtcctgactagggaggacacaacatcagagggacggcagagaatccttgtgtgcgatgggagatgctcagtttgaaaattgcaaggagggactttaagactacttctgatttgcaaagattgtctgtgctctgagcaggctgaagtgactggacgagacgcactgttggagaaataaaacgactcggaccgatg

SEQ ID NO: 10997 - DNA, 203 bp, Homo sapiens
ggcgcgccagtcctggctcctgaggacacaacatcagagggacggcagagaatccttgtgtgtagatctttggtggcagtttgaaaattgcaaggagggactttaagactacttctgagaacagccacgctgctgtgctctgagcaggctgaagtgactggacgagacgcactgttggagaaataaaacgactcggaccgatg

SEQ ID NO: 10998 - DNA, 203 bp, Homo sapiens
ggcgcgccagtcctcgtcgtcgaggacacaacatcagagggacggcagagaatccttgtgtgtagatctttggtggcagtttgaaaattgcaaggagggactttaagactacttctgatttgcaaagattgtctgtgctctgagcaggctgaagtgactggacgagacgcactgcacctaggtccgttcgactcggaccgatg

SEQ ID NO: 10999 - DNA, 203 bp, Homo sapiens
ggcgcgccagtcctccttatctaggacacaacatcagagggacggcaggatgatgcccgcaatagatctttggtggcagtttgaaaattgcaaggagggactttaagactacttctgatttgcaaagattgtctgtgctctgagcaggctgaagtgactggacgagacgcactgttggagaaataaaacgactcggaccgatg

SEQ ID NO: 11000 - DNA, 203 bp, Homo sapiens
ggcgcgccagtcctatccgcgtaggacagtcagaacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 11001 - DNA, 203 bp, Homo sapiens
ggcgcgccagtcctgggtagaaaggacgaccgggtcctttccattggatcaaacccgctcaagatacttgttcaaaggcgtgcccccgcaagactgctagccgagtagcgttgggttgcgaaaggccttgtggtactgcctgatagggtgcttgcgagtgccccgggaggtctcgtagaccgtgcaaccgactcggaccgatg

SEQ ID NO: 11002 - DNA, 203 bp, Homo sapiens
ggcgcgccagtcctgaggttcgaggacgaccgggtcctttccattggatcaaacccgctcaatgcctggagatttgaaacgttaaaacgcagactgctagccgagtagcgttgggttgcgaaaggccttgtggtactgcctgatagggtgcttgcgagtgccccgggaggtctcgtagaccgtgcaaccgactcggaccgatg

SEQ ID NO: 11003 - DNA, 203 bp, Homo sapiens
ggcgcgccagtcctgggctgataggacgaccgggtcctttccattggatcaaacccgctcaatgcctggagatttgggcgtgcccccgcaagactgctagccgagtagcgttgggttgcgaaaggccttgtgaatggtgaaccattggtgcttgcgagtgccccgggaggtctcgtagaccgtgcaaccgactcggaccgatg

SEQ ID NO: 11004 - DNA, 203 bp, Homo sapiens
ggcgcgccagtcctaagatcacaggacgaccgggtcctttccattggatcaaacccgctcaatgcctggagatttgggcgtgcccccgcaagactgctagccgagtagcgttgggttggtctgactaaccacgtactgcctgatagggtgcttgcgagtgccccgggaggtctcgtagaccgtgcaaccgactcggaccgatg

SEQ ID NO: 11005 - DNA, 203 bp, Homo sapiens
ggcgcgccagtccttgaccattaggactcactctcgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcgactcggaccgatg

SEQ ID NO: 11006 - DNA, 203 bp, Homo sapiens
ggcgcgccagtcctctcgaattaggaggctgactccccaagtcctgcaaaggggtgcaagcctagttccaaccctgccgggctgaggcatgagtaggggctgtagcctacgcggttgcggcccccaaagcttccactcgctgccttaaaacgccaacccagcctctcagacaatgctgccctcccactcgactcggaccgatg

SEQ ID NO: 11007 - DNA, 203 bp, Homo sapiens
ggcgcgccagtcctttgcgtgtaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccaatgctaggcgactagctgccctcccactcgactcggaccgatg

SEQ ID NO: 11008 - DNA, 203 bp, Homo sapiens
ggcgcgccagtcctaggatagaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 11009 - DNA, 203 bp, Homo sapiens
ggcgcgccagtcctccttcctaaggaggctgactccccaagtcctgcaaaggggtgcaagcctagttccaaccctgccgggctgaggcatgagtaggggctgtatttgcgtgcaggcgggcccccaaagcttgtcagataacggggaaaacgccaacccagcctctcagacaatgctgccctcccactcgactcggaccgatg

SEQ ID NO: 11010 - DNA, 203 bp, Homo sapiens
ggcgcgccagtcctatatgaacaggaggctgactccccaagtcctgcaaaggggtgcaagcctagttccaaccctgccgggctgaggcatgagtaggggctgtatttgcgtgcaggcgtcttgttcttatagccactcgctgccttaaaacgccaacccagcctctcagacaatgctgccctcccactcgactcggaccgatg

SEQ ID NO: 11011 - DNA, 203 bp, Homo sapiens
ggcgcgccagtcctcgtgacgaaggaggctgactccccaagtcctgcactcccagttggcggtagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 11012 - DNA, 203 bp, Homo sapiens
ggcgcgccagtcctctgtttgaaggaggctgacttgtgcgactactggaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 11013 - DNA, 203 bp, Homo sapiens
ggcgcgccagtcctactgtcgcaggatgctctcgcaaaagacaactcacaatctccctaaaacagcaacgacaccatgtcagctttgctcaaatctctctgggagaaacttttgcccacatactaacaacatcacaaccatctcaagaaaagaaactgggcaaaacagcatccaagagacaaatagcacgactcggaccgatg

SEQ ID NO: 11014 - DNA, 203 bp, Homo sapiens
ggcgcgccagtcctgcctaagcaggatggcgcggcacgggccgtgcggggcccgaaccagtaagggaaccgccggctcgcgccctccgttctttcccggagccggcttcacgcagggccgggaacggccgtgcctctgggatccgccttcgctgacgccgggcacctacctggacgcgagcgagcgagcgactcggaccgatg

SEQ ID NO: 11015 - DNA, 203 bp, Homo sapiens
ggcgcgccagtccttcaactggaggcaaaatttgcacagtataaaatcatgggtcgaacggcttgttggaatcaccgtacctatttaggtttacgctccaagatcggtggatagcagccctatcaatatctaggagaactgtgctatgtttagaagattaggtagtctctaaacagaacaatttacctcgactcggaccgatg

SEQ ID NO: 11016 - DNA, 203 bp, Homo sapiens
ggcgcgccagtcctccaaccagaggcaaaatttgcacagtataaaatctgcaagtagtgctattgttggaatcaccgtacctatttaggtttacgctccaagatcggtggatagcagccctatcaatatctaggagaactgtgctatgtttagaagattaaagtcgagggcgcgagaacaatttacctcgactcggaccgatg

SEQ ID NO: 11017 - DNA, 203 bp, Homo sapiens
ggcgcgccagtcctctgtcagtaggcaaaatttgtcttcgtgggccgatgcaagtagtgctattgttggaatcaccgtacctatttaggtttacgctccaagatcggtggatagcagccctatcaatatctaggagaactgtgctatgtttagaagattaggtagtctctaaacagaacaatttacctcgactcggaccgatg

SEQ ID NO: 11018 - DNA, 203 bp, Homo sapiens
ggcgcgccagtcctaagaggataggcgaaggtttctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagcccgactcggaccgatg

SEQ ID NO: 11019 - DNA, 203 bp, Homo sapiens
ggcgcgccagtcctgagcgcacaggcgcaagcgcgcacagactgtagccatccgaggacacccccgcccccccggcgtcatgaacctactccgcgcagaatcgcctccggatcccctgcagtcggcgggagtgttggaggtcggcgccggcccccgccttccgcgccccccacgggaaggaagcaccccgactcggaccgatg

SEQ ID NO: 11020 - DNA, 203 bp, Homo sapiens
ggcgcgccagtcctccaggctaaggcgcaagcgcgcacagactgtagccatccgaggacaccgttaaaaaagactgccacccggagacacccgcgcagaatcgcctccggatcccctgcagtcggcgggagtgttggaggtcggcgccggcccccgccttccgcgccccccacgggaaggaagcaccccgactcggaccgatg

SEQ ID NO: 11021 - DNA, 203 bp, Homo sapiens
ggcgcgccagtcctacgtcaggaggcgcaagcgcgcacagactgtagctgaggccatttttgcccgcccccccggcccacccggagacacccgcgcagaatcgcctccggatcccctgcagtcggcgggagtgttggaggtcggcgccggcccccgccttccgcgccccccacgggaaggaagcaccccgactcggaccgatg

SEQ ID NO: 11022 - DNA, 203 bp, Homo sapiens
ggcgcgccagtcctcgtggaagaggcgccgggaagtcgacggcgccggataggatgctgtagggccactgtctgcagctcccgtgaagatgtccactccagacccacccctgggcggaactcctcggccaggtccttccccgggccctggcccttcccctggagccatgctgggccctagcccgggtccgactcggaccgatg

SEQ ID NO: 11023 - DNA, 203 bp, Homo sapiens
ggcgcgccagtcctctcagctgaggcgccgggaagtcgacggcgccggcggctcctgcaggaggccactgtctgcagctcccgtgaagatgtccactccagacccacccctgggcggaactcctcggccagggttcggagtcaaaactggcccttcccctggagccatgctgggccctagcccgggtccgactcggaccgatg

SEQ ID NO: 11024 - DNA, 203 bp, Homo sapiens
ggcgcgccagtcctgagaccggaggcgccgggaagtcgacggcgccggcggctcctgcaggaggccactgtctgcagctcccgtgaagatgtccactccagacccacccctgggcggaactcctcggccaggtccttccccgggcctacattgaatagaaggagccatgctgggccctagcccgggtccgactcggaccgatg

SEQ ID NO: 11025 - DNA, 203 bp, Homo sapiens
ggcgcgccagtcctggcggctcaggcgtaattgcccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 11026 - DNA, 203 bp, Homo sapiens
ggcgcgccagtcctattcgtagagggaccgtccacaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttacgactcggaccgatg

SEQ ID NO: 11027 - DNA, 203 bp, Homo sapiens
ggcgcgccagtcctgtaccgttagggagaatatggatacgttaaaatatataacgtatttttaaaacttaggaaccaagacaaacacttttggtcttggtattgcgagacgcgcgctaatatcatcatgagtgatatctttgaagaggcggctagttttaggagttatcaatctaagttagggagagacgactcggaccgatg

SEQ ID NO: 11028 - DNA, 203 bp, Homo sapiens
ggcgcgccagtcctaaagacgaagggagcaggagagagaggacaagtggatccaacagccttcgctccaggggaatacttttgcatatcacttttctgggaggacactcccttctgatggtgaatgggaactcccttcctcctgcagcagcctgcctgcagctgtcctggtagaacagtgtggacattcgactcggaccgatg

SEQ ID NO: 11029 - DNA, 203 bp, Homo sapiens
ggcgcgccagtcctgctattggagggagcaggagagagaggacaagtggatccaacagccttcgctccaggggaatcagggcatcgcctccttttctgggaggacactcccttctgatacgcctcaaatgagcccttcctcctgcagcagcctgcctgcagctgtcctggtagaacagtgtggacattcgactcggaccgatg

SEQ ID NO: 11030 - DNA, 203 bp, Homo sapiens
ggcgcgccagtcctcgcaagttagggagcaggagagagaggacaagtggatccaacagccttcgctccaggggaatcagggcatcgcctccttttctgggaggacactcccttctgatggtgaatgggaactcccttcctcctgcagcagcctgcctgcacgacgagactgcttacagtgtggacattcgactcggaccgatg

SEQ ID NO: 11031 - DNA, 203 bp, Homo sapiens
ggcgcgccagtcctctgccgggagggagcaggagagagaggacaagtggatccaacagccttcgctccaggggaatcagggcatcgcctccttttctgggaggacactcccttctgatggtgaatgggaactcccttcctcctgcatgctaactatgtatgctgtcctggtagaacagtgtggacattcgactcggaccgatg

SEQ ID NO: 11032 - DNA, 203 bp, Homo sapiens
ggcgcgccagtcctctgctcctagggagcaggagagagaggacaagtggatccaacagccttcgctccaggggaatcagggcatcgcctccttttctgggaggaggtaaaaagaaagcggtgaatgggaactcccttcctcctgcagcagcctgcctgcagctgtcctggtagaacagtgtggacattcgactcggaccgatg

SEQ ID NO: 11033 - DNA, 203 bp, Homo sapiens
ggcgcgccagtccttagctctgagggagcaggagagagaggacaagtggatccaacagccttcgctccaggggaatcagggcatcgcctctaaggaatatgaaccactcccttctgatggtgaatgggaactcccttcctcctgcagcagcctgcctgcagctgtcctggtagaacagtgtggacattcgactcggaccgatg

SEQ ID NO: 11034 - DNA, 203 bp, Homo sapiens
ggcgcgccagtcctccagtggtagggagcaggagagagaggacaagtggatccaacagccttgataatcactcgcgcagggcatcgcctccttttctgggaggacactcccttctgatggtgaatgggaactcccttcctcctgcagcagcctgcctgcagctgtcctggtagaacagtgtggacattcgactcggaccgatg

SEQ ID NO: 11035 - DNA, 203 bp, Homo sapiens
ggcgcgccagtcctcttataccagggagcaggagccttgatgagctacgatccaacagccttcgctccaggggaatcagggcatcgcctccttttctgggaggacactcccttctgatggtgaatgggaactcccttcctcctgcagcagcctgcctgcagctgtcctggtagaacagtgtggacattcgactcggaccgatg

SEQ ID NO: 11036 - DNA, 203 bp, Homo sapiens
ggcgcgccagtccttaacacgtagggaggagctccctccaggctctatttagagccgggtaggggagcgcagcggccagatacctcagcgagctggtcaccggatggatttctctcccgcctgccggcctgcctgccacagccggactccgccactccggtagcctcatggctgcaacctgtgagattcgactcggaccgatg

SEQ ID NO: 11037 - DNA, 203 bp, Homo sapiens
ggcgcgccagtcctagcgtgttagggaggagctccctccaggctctatttagagccgggtaggggagcgcagcggccagatacctcagcgctacctggcggaactggatttctctcccgcctgccggcctgcaaaggcttaaaaagctccgccactccggtagcctcatggctgcaacctgtgagattcgactcggaccgatg

SEQ ID NO: 11038 - DNA, 203 bp, Homo sapiens
ggcgcgccagtccttacaggcaagggaggagctccctccaggctctatttagagccgggtaggggagcgcagcggccagatacctcagcgctacctggcggaactggatttctctcccgcctgccggcctgcctgccacagccggagcttcagcgggttttagcctcatggctgcaacctgtgagattcgactcggaccgatg

SEQ ID NO: 11039 - DNA, 203 bp, Homo sapiens
ggcgcgccagtcctatttatgtagggaggagctccctccaggctctatttagagccgggtaggggagcgcagcggccagatacctcagcgctacctggcggaactggatttctctccctaactttcagtgatctgccacagccggactccgccactccggtagcctcatggctgcaacctgtgagattcgactcggaccgatg

SEQ ID NO: 11040 - DNA, 203 bp, Homo sapiens
ggcgcgccagtcctcacgcctcagggaggagctcgagagcctacaacattagagccgggtaggggagcgcagcggccagatacctcagcgctacctggcggaactggatttctctcccgcctgccggcctgcctgccacagccggactccgccactccggtagcctcatggctgcaacctgtgagattcgactcggaccgatg

SEQ ID NO: 11041 - DNA, 203 bp, Homo sapiens
ggcgcgccagtcctatcggtataggggaccctgtacagctggatgttaatcgcagcgtcggatgttcagagcagcagaagccggcgtcgtcggatgttgtgttgcccgccaccatgagctacacaggctttgtccagggatctgaaaccactttgcagtcgacatactcggataccagcgctcagccccgactcggaccgatg

SEQ ID NO: 11042 - DNA, 203 bp, Homo sapiens
ggcgcgccagtcctattcagggaggggaccctgtggttagcagcagctatcgcagcgtcggatgttcagagcagcaactaattctccttgcggatgttgtgttgcccgccaccatgagctacacaggctttgtccagggatctgaaaccactttgcagtcgacatactcggataccagcgctcagccccgactcggaccgatg

SEQ ID NO: 11043 - DNA, 203 bp, Homo sapiens
ggcgcgccagtcctctcgtgacaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcaggtccggttcccgccagcgctcagccccgactcggaccgatg

SEQ ID NO: 11044 - DNA, 203 bp, Homo sapiens
ggcgcgccagtcctctgctgaaaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataattaaatggtcgggcgactcggaccgatg

SEQ ID NO: 11045 - DNA, 203 bp, Homo sapiens
ggcgcgccagtcctgtaactgcaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagccccgactcggaccgatg

SEQ ID NO: 11046 - DNA, 203 bp, Homo sapiens
ggcgcgccagtcctggttgaccaggggaccctgtggttagcagcagctatcgcagcgtcggatgttcagagcagcagaagccggcgtcgtttacctggagaggccccgccaccatgagctacacaggctttgtccagggatctgaaaccactttgcagtcgacatactcggataccagcgctcagccccgactcggaccgatg

SEQ ID NO: 11047 - DNA, 203 bp, Homo sapiens
ggcgcgccagtcctcgggcgcaaggggaccctgtggttagcagcagcttcattgcaactaattgttcagagcagcagaagccggcgtcgtcggatgttgtgttgcccgccaccatgagctacacaggctttgtccagggatctgaaaccactttgcagtcgacatactcggataccagcgctcagccccgactcggaccgatg

SEQ ID NO: 11048 - DNA, 203 bp, Homo sapiens
ggcgcgccagtccttctagttgagggggtggggcatgtgccctcttttaatgaccggccgtccctgcggtcccgccccctccccgcccccggagccgcggcctcgctgagtgcccagccgcccggcgcccaggcctggggcaccgcgagtgccgaaccttcggctgctccccgcctcaggacaccaagcgactcggaccgatg

SEQ ID NO: 11049 - DNA, 203 bp, Homo sapiens
ggcgcgccagtcctccacaccaagggggtggggctatatgttcggaccaatgaccggccgtccctgcggtcccgccccctccccgcccccggagccgcggcctcgctgagtgcccagctcagatttagtattgcctggggcaccgcgagtgccgaaccttcggctgctccccgcctcaggacaccaagcgactcggaccgatg

SEQ ID NO: 11050 - DNA, 203 bp, Homo sapiens
ggcgcgccagtcctttaaactcagggggtggggctatatgttcggaccaatgaccggccgtccctgcggtcccgcctggcgtagctagtaggagccgcggcctcgctgagtgcccagccgcccggcgcccaggcctggggcaccgcgagtgccgaaccttcggctgctccccgcctcaggacaccaagcgactcggaccgatg

SEQ ID NO: 11051 - DNA, 203 bp, Homo sapiens
ggcgcgccagtcctctttattgaggggttcttgtgccgaaaggcagccacggggccaccaaggcggcgcagcgctgcatgcggcaaggggaaaaatccttcgggtgacccctggtggcaatcccttcccttaggagcatgagtgtggtcgacacattcaccatggcttggctgtggttgctggtttgccgactcggaccgatg

SEQ ID NO: 11052 - DNA, 203 bp, Homo sapiens
ggcgcgccagtcctggtatagcagggtcaagcgattcccctgcctcagcttcctgagtagctaacgacctgatgcttgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 11053 - DNA, 203 bp, Homo sapiens
ggcgcgccagtcctgatcttatagggtcaagcgattcccctgcctcagcttcctgagtagctgggattacaggctcacgagttggaatcttggagcaggtgtgcagagggtgagaacccagctctgggaccaagtcacttgcttccttacttagcaagactatcgacttgagcaaacttggacctgggcgactcggaccgatg

SEQ ID NO: 11054 - DNA, 203 bp, Homo sapiens
ggcgcgccagtccttttcgtccagggtcaagcgattcccctgcctcagcttcctgagtagctgggattacaggctctgtgtgctccgggatggagcaggtgtgcagagggtgagaacccagctctgggaccaagtcacttgcttccactgcgtcggcctttatcgacttgagcaaacttggacctgggcgactcggaccgatg

SEQ ID NO: 11055 - DNA, 203 bp, Homo sapiens
ggcgcgccagtcctacgccgacagggtcaagcgattcccctgcctcagcttcctgagtagctgggattacaggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 11056 - DNA, 203 bp, Homo sapiens
ggcgcgccagtcctctcaattaaggtaggtgatagaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagccgactcggaccgatg

SEQ ID NO: 11057 - DNA, 203 bp, Homo sapiens
ggcgcgccagtccttagtttctaggtctcgagataagtacatactaccggcatgcccaaagcacatcttaacctgagcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11058 - DNA, 203 bp, Homo sapiens
ggcgcgccagtcctggccaaataggtctcgagatgccacgtggacgagctatccgtatcgtgacatcttaacctgagcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11059 - DNA, 203 bp, Homo sapiens
ggcgcgccagtcctcttgacagaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgcatgcgccgcataacgctgtacatggcaccgactcggaccgatg

SEQ ID NO: 11060 - DNA, 203 bp, Homo sapiens
ggcgcgccagtcctcgagtaacaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgcctagttgctcagtcgctgtacatggcaccgactcggaccgatg

SEQ ID NO: 11061 - DNA, 203 bp, Homo sapiens
ggcgcgccagtccttacgccctaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgctactaaaaatctctcacaggggcatgttcgactcggaccgatg

SEQ ID NO: 11062 - DNA, 203 bp, Homo sapiens
ggcgcgccagtcctcccggaacaggtctcgagatgccacgtggacgagggcatgcccaaagcacatcttaacctgagcgggggtcgcccaggtaaaagcagttttaaccgactgttacgaatacagcctgatcaaaattgtgtatcgcccactgtattgctactaaaaatctctgctgtacatggcaccgactcggaccgatg

SEQ ID NO: 11063 - DNA, 203 bp, Homo sapiens
ggcgcgccagtcctgcgcaacgaggtctcgagatgccacgtggacgagggcatgcccaaagccatagaggtagcacgcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11064 - DNA, 203 bp, Homo sapiens
ggcgcgccagtcctcaacgaagaggtctcgagatgccacgtggacgagggcatgcccaaagcttcatggctgtaacgcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11065 - DNA, 203 bp, Homo sapiens
ggcgcgccagtcctattacggaaggtgtatctcgcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtcgactcggaccgatg

SEQ ID NO: 11066 - DNA, 203 bp, Homo sapiens
ggcgcgccagtcctgtttgtctagtaagaaaattcctagttataatatttttaatactgctacatttttaagacccttagttatttagctttaccgcccaggatggggtgcagcgttcctgcaatatccagggcacctaggtgcagccttgtagttttagcacttcgggtttgcaagaatttcactagcgactcggaccgatg

SEQ ID NO: 11067 - DNA, 203 bp, Homo sapiens
ggcgcgccagtccttgcgttagagtaagtctgtctgatctaggatgtcttgcttaccacccaggtagggggttatacgtcagggatagacctgattccattgtaactcttgccgaaatccgggtgaacggaagtagtctctttaagaactggtatgggcaggcccaagttgtcaaggcttcggaggtacgactcggaccgatg

SEQ ID NO: 11068 - DNA, 203 bp, Homo sapiens
ggcgcgccagtcctcgaggtatagtaagtctgtctgatctaggatgtcttgcttaccacccaggtagggggttatatactcccagcctttctgattccattgtaactcttgccgaaatccgggtgaacggaaaactgaatcacctaaactggtatgggcaggcccaagttgtcaaggcttcggaggtacgactcggaccgatg

SEQ ID NO: 11069 - DNA, 203 bp, Homo sapiens
ggcgcgccagtccttattgtgcagtaagtctgtctgatctaggatgtcttgcttaccacccaggtagggggttatatactcccagcctttctgattccattgtaactcttgccgaaatccgggtgaacggaagtagtctctttaagaactggtatgggcacatgacccccacgcaggcttcggaggtacgactcggaccgatg

SEQ ID NO: 11070 - DNA, 203 bp, Homo sapiens
ggcgcgccagtcctcattgactagtaatgattttgtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 11071 - DNA, 203 bp, Homo sapiens
ggcgcgccagtcctagatcgggagtacggtgtgtggagctggagcaccgtgaggaagaagcgctaagagaggcccaagttcagctgcgagatatcaaacaaagaattactctgtacaaagccagaacacatatatcaaagtaatcctgaagtatcagaacaaaataataggctgtaacagaggaggaacgactcggaccgatg

SEQ ID NO: 11072 - DNA, 203 bp, Homo sapiens
ggcgcgccagtcctcgcattacagtaggtcagcccaaatacgaatgtgcagcggtgctggggtcatgatggctcggtgggcagcgaggggccgggccggctggaggagcacagtgcggattctattctgaaagtcaagaagacatcatccggaatattgccaggcacctcgcccaggtcggggacagccgactcggaccgatg

SEQ ID NO: 11073 - DNA, 203 bp, Homo sapiens
ggcgcgccagtccttacgaaagagtagttaggatggctgaaggggagtacattcggctgaaggccgactgtgattcccccggttgatacaaggcgattttgaccccctgagggctgctctagaggactcaggccccgaagctgtcccagggaggtccccgctgcatcccaccacccaagctgtgcctccgactcggaccgatg

SEQ ID NO: 11074 - DNA, 203 bp, Homo sapiens
ggcgcgccagtccttcacccgcagtagttaggatggctgaaggggatactcaccggctgaaggccgactgtgattcccccggttgatacaaggcgattttgaccccctgagggctgctctagaggactcaggccccgaagctgtcccagggaggtccccgctgcatcccaccacccaagctgtgcctccgactcggaccgatg

SEQ ID NO: 11075 - DNA, 203 bp, Homo sapiens
ggcgcgccagtcctcataaataagtagttaggatggctgaaggggatactcaccggctgaaggccgactgtgattccccctacccccacaaggcgattttgaccccctgagggctgctaattttctaagcacccccgaagctgtcccagggaggtccccgctgcatcccaccacccaagctgtgcctccgactcggaccgatg

SEQ ID NO: 11076 - DNA, 203 bp, Homo sapiens
ggcgcgccagtcctgagctagtagtagttaggatggctgaaggggatactcaccggctgaaggccgactgtgattccccctacccccacaaggcgattttgaccccctgagggctgctctagaggactcaggatagctgatcaggacagggaggtccccgctgcatcccaccacccaagctgtgcctccgactcggaccgatg

SEQ ID NO: 11077 - DNA, 203 bp, Homo sapiens
ggcgcgccagtcctacgcgcctagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctccgactcggaccgatg

SEQ ID NO: 11078 - DNA, 203 bp, Homo sapiens
ggcgcgccagtcctagagtttaagtagttaggatggctgaaggggatactcaccggctgaagtgtactacgctggacccctacccccacaaggcgattttgaccccctgagggctgctctagaggactcaggccccgaagctgtcccagggaggtccccgctgcatcccaccacccaagctgtgcctccgactcggaccgatg

SEQ ID NO: 11079 - DNA, 203 bp, Homo sapiens
ggcgcgccagtcctaatacccgagtagttaggatggctgaaggggatatcacagtatgcggcgccgactgtgattccccctacccccacaaggcgattttgaccccctgagggctgctctagaggactcaggccccgaagctgtcccagggaggtccccgctgcatcccaccacccaagctgtgcctccgactcggaccgatg

SEQ ID NO: 11080 - DNA, 203 bp, Homo sapiens
ggcgcgccagtccttgaaaccaagtagttaggattctgcctaatagatctcaccggctgaaggccgactgtgattccccctacccccacaaggcgattttgaccccctgagggctgctctagaggactcaggccccgaagctgtcccagggaggtccccgctgcatcccaccacccaagctgtgcctccgactcggaccgatg

SEQ ID NO: 11081 - DNA, 203 bp, Homo sapiens
ggcgcgccagtcctgcccgtgaagtcaataagactgtggtgagagagttcgtcgtcctcggcccgcatattgactacaggctgcagcagctgctctttgttatcttcctgctcctctacctgttcactctgggcaccaatgcaatcatcatttccaccattgtgctggacagagcccttcatactccccgactcggaccgatg

SEQ ID NO: 11082 - DNA, 203 bp, Homo sapiens
ggcgcgccagtcctaaacatacagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactccccgactcggaccgatg

SEQ ID NO: 11083 - DNA, 203 bp, Homo sapiens
ggcgcgccagtccttgacgggcagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagaggaaccgtattggatcgactcggaccgatg

SEQ ID NO: 11084 - DNA, 203 bp, Homo sapiens
ggcgcgccagtcctgacaaaccagtcaataagactgtggtgagagagttcgtcgtcctcggcttctcatccctggccaggctgcagcagctgctctttgttatcttcctgctcctctattgcgaattcgctagcaccaatgcaatcatcatttccaccattgtgctggacagagcccttcatactccccgactcggaccgatg

SEQ ID NO: 11085 - DNA, 203 bp, Homo sapiens
ggcgcgccagtcctctcgttgtagtcaataagactgtggtgagagagttcgtcgtcctcggcttctcatccctggctgacggttcaagcgtgctctttgttatcttcctgctcctctacctgttcactctgggcaccaatgcaatcatcatttccaccattgtgctggacagagcccttcatactccccgactcggaccgatg

SEQ ID NO: 11086 - DNA, 203 bp, Homo sapiens
ggcgcgccagtccttcagaagaagtcaggctattaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 11087 - DNA, 203 bp, Homo sapiens
ggcgcgccagtcctgtttggacagtcaggtggagcgaggctagctggcccgatttctcctccgggtgatgcttttcctagattattctctgatttggtcgtattgggcgcctggtcaccagggctgcttttaactctggtaaagtgagggcacagttatccaatgaccccttcattgacctcaactaccgactcggaccgatg

SEQ ID NO: 11088 - DNA, 203 bp, Homo sapiens
ggcgcgccagtcctatggacgcagtcaggtggagcgaggctagctggcccgatttctcctccgggtgatgcttttcctagattattctctgatttggtcgtattgggcgcctggtcaccagggctgcttttaactctggtaaagtggatattgttgccatcaatgaccccttcacatctacgccggtgcgactcggaccgatg

SEQ ID NO: 11089 - DNA, 203 bp, Homo sapiens
ggcgcgccagtcctggctttcaagtcaggtggagcgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactaccgactcggaccgatg

SEQ ID NO: 11090 - DNA, 203 bp, Homo sapiens
ggcgcgccagtcctggcggtgtagtcaggtggagcgaggctagctggcccgatttctcctccgggtgatgcttttcctagattattctctgatttggtcgtattgggcgcctggtcaccagggctgcttttaactctggtaaagtgttcggaaacagtcccaatgaccccttcattgacctcaactaccgactcggaccgatg

SEQ ID NO: 11091 - DNA, 203 bp, Homo sapiens
ggcgcgccagtcctgtttccaaagtcaggtggagcgaggctagctggcccgatttctcctccgggtgatgcttttcctagattattctctgatttggtcgtattgggcgcctggtcaccagggctgcttttaggaggctgtctccagatattgttgccatcaatgaccccttcattgacctcaactaccgactcggaccgatg

SEQ ID NO: 11092 - DNA, 203 bp, Homo sapiens
ggcgcgccagtccttgcgtatcagtcaggtggagcgaggctagctggcccgatttctcctccgggtgatgcttttcctagattattctctgatttggtcgtattgggcgcctggtcaccagggctgcttttatgcactaagcttgagatattgttgccatcaatgaccccttcattgacctcaactaccgactcggaccgatg

SEQ ID NO: 11093 - DNA, 203 bp, Homo sapiens
ggcgcgccagtcctttgctttaagtcaggtggagcgaggctagctggcccgatttctcctccgggtgatgcttttcctagattattctctgatttggtcgtattgggcgcctggtcacggtaaagcagccgcactctggtaaagtggatattgttgccatcaatgaccccttcattgacctcaactaccgactcggaccgatg

SEQ ID NO: 11094 - DNA, 203 bp, Homo sapiens
ggcgcgccagtcctactaatcgagtcaggtggagcgaggctagctggcccgatttctcctcctaaacgccggaagtctagattattctctgatttggtcgtattgggcgcctggtcaccagggctgcttttaactctggtaaagtggatattgttgccatcaatgaccccttcattgacctcaactaccgactcggaccgatg

SEQ ID NO: 11095 - DNA, 203 bp, Homo sapiens
ggcgcgccagtccttcggatacagtcagttccaagacgaggtaaacaacaaactcattcgccgagtttctaaacaagacatattcgagtgactcataagaagttgaataacaaaatgccggaaatctacggattgtgtatatccatcatgaaaaaaactaacacccctcctttcgaaccaccccaaaccgactcggaccgatg

SEQ ID NO: 11096 - DNA, 203 bp, Homo sapiens
ggcgcgccagtcctgcgttaccagtcagttccaatcatcaagctcgtccaaactcattcgccgagtttctaaacaaagtcagaatcgtccactcataagaagttgaataacaaaatgccggaaatctacggattgtgtatatccatcatgaaaaaaactaacacccctcctttcgaaccaccccaaaccgactcggaccgatg

SEQ ID NO: 11097 - DNA, 203 bp, Homo sapiens
ggcgcgccagtcctaactatcgagtcagttccaatcatcaagctcgtccaaactcattcgccgagtttctaaacaagacatattcgagtgactcataagaagttcttacgagcctacgcggaaatctacggattgtgtatatccatcatgaaaaaaactaacacccctcctttcgaaccaccccaaaccgactcggaccgatg

SEQ ID NO: 11098 - DNA, 203 bp, Homo sapiens
ggcgcgccagtcctgcctggtcagtcagttccaatcatcaagctcgtccaaactcattcgccgagtttctaaacaagacatattcgagtgactcataagaagttgaataacaaaatgcaatcttgagctctgttgtgtatatccatcatgaaaaaaactaacacccctcctttcgaaccaccccaaaccgactcggaccgatg

SEQ ID NO: 11099 - DNA, 203 bp, Homo sapiens
ggcgcgccagtcctaagtctgaagtcagttccaatcatcaagctcgtccaaactcattcgccgagtttctaaacaagacatattcgagtgactcataagaagttgaataacaaaatgccggaaatctacggattgtgtatatccatatcctggttcctgcacacccctcctttcgaaccaccccaaaccgactcggaccgatg

SEQ ID NO: 11100 - DNA, 203 bp, Homo sapiens
ggcgcgccagtcctatcaagagagtcagttccaatcatcaagctcgtccaaactcattcgccgagtttctaaacaagacatattcgagtgcacgccggatccaagaataacaaaatgccggaaatctacggattgtgtatatccatcatgaaaaaaactaacacccctcctttcgaaccaccccaaaccgactcggaccgatg

SEQ ID NO: 11101 - DNA, 203 bp, Homo sapiens
ggcgcgccagtcctctgcaataagtccgattggggctgcgcgcttcgcttctgcggctcagcctccagcccaggtggcgctgtggaccctgcagccgcggagcgaggcagcggggcggctccgtgaccacggcgggcggagcctagtggacctacgacgtgctgctgtggccgtggctgttcgcgaggcgactcggaccgatg

SEQ ID NO: 11102 - DNA, 203 bp, Homo sapiens
ggcgcgccagtcctacttcgaaagtccgattggggctgcgcgcttcgcttctgcggctcagcgagagtgttcttccgcgctgtggaccctgcagccgcggagcgaggcagcggggcggctccgtgaccacggcgggcggagcctaggactgagggcgatggctgctgtggccgtggctgttcgcgaggcgactcggaccgatg

SEQ ID NO: 11103 - DNA, 203 bp, Homo sapiens
ggcgcgccagtccttcttcacgagtccgtaagttaagctaggccagctcctcccactgcctcccttcctctttctcctcctcttactcctttccagccagaccttggctgtctacaggatgggggacaccctgagccccggacatggcaaccacagagagagcagcccttttctttcccccttggaggcgactcggaccgatg

SEQ ID NO: 11104 - DNA, 203 bp, Homo sapiens
ggcgcgccagtccttgcaggacagtcggagctctatggaggtggcagcaacagagagaactaggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 11105 - DNA, 203 bp, Homo sapiens
ggcgcgccagtcctcaatgggtagtcggagctctatggaggtggcagcgggtaccgagtggcggctgcagcagcgaaggtatacgatgctgtttgaggccgtccccgactccttcctcccccttccctcccccttttttttgttttccgttcccctttcccctcccttccctatccccgacgaccggacgactcggaccgatg

SEQ ID NO: 11106 - DNA, 203 bp, Homo sapiens
ggcgcgccagtcctgattcgccagtcggagctctatggaggtggcagcgggtaccgagtggcggctgcagcagcgactcctctgagctgagtttgaggccgtccatagtcagagatggccccttccctcccccttttttttgttttccgttcccctttcccctcccttccctatccccgacgaccggacgactcggaccgatg

SEQ ID NO: 11107 - DNA, 203 bp, Homo sapiens
ggcgcgccagtcctcgatagatagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctattatgtcaatgtactcgactcggaccgatg

SEQ ID NO: 11108 - DNA, 203 bp, Homo sapiens
ggcgcgccagtcctttcatcgcagtcggagctctatggaggtggcagcgggtaccgagtggcggctgcagcagcgactcctctgagctgagtttgaggccgtccccgactccttcctcccccttccctcccccttttttttgttttggacattgagccaacctcccttccctatccccgacgaccggacgactcggaccgatg

SEQ ID NO: 11109 - DNA, 203 bp, Homo sapiens
ggcgcgccagtcctaccaactgagtcggagctctatggaggtggcagcgggtaccgagtggcggctgcagcagcgactcctctgagctgagtttgaggccgtccccgactccttcctcccccttccctccccgcgggaacgcacacccgttcccctttcccctcccttccctatccccgacgaccggacgactcggaccgatg

SEQ ID NO: 11110 - DNA, 203 bp, Homo sapiens
ggcgcgccagtcctaggtaactagtcggagctctccatgccaccattagggtaccgagtggcggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 11111 - DNA, 203 bp, Homo sapiens
ggcgcgccagtcctaatcacttagtctgacagagtgctgtgatatctggggctcctgctgctatagctggatttgcagctttactgcaaactgtgactggtgtgagcgctgttgctcaagtggggtatagattttttagtgactgggatcacaaagtttctactgttggtttatatcaacaaccaggacgactcggaccgatg

SEQ ID NO: 11112 - DNA, 203 bp, Homo sapiens
ggcgcgccagtccttgtttaacagtgacgtcataccggttttacacacgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgcgactcggaccgatg

SEQ ID NO: 11113 - DNA, 203 bp, Homo sapiens
ggcgcgccagtccttgaaccacagtgacgtcataggtaaacaggctctgtatccgtggcagcggccgtggcaggctggctgggtaccggctgtcgctgacccaggagaagctgcctgtctacatcagcctggcaaaactttgctctccgccgcggggccggcagccatggccaaggacatcctgggtgcgactcggaccgatg

SEQ ID NO: 11114 - DNA, 203 bp, Homo sapiens
ggcgcgccagtcctttaccacaagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaaccttattactaaccgactcggaccgatg

SEQ ID NO: 11115 - DNA, 203 bp, Homo sapiens
ggcgcgccagtccttagccgccagtgacgtcataggtaaacaggctctgtatccgtggcagcggccgtggcaggctggctgggtaccggctgtcgctgacccaggagaagctgcctgtctacatcagcctgggctgcagcgcgctgttcggtatactggagcagccatggccaaggacatcctgggtgcgactcggaccgatg

SEQ ID NO: 11116 - DNA, 203 bp, Homo sapiens
ggcgcgccagtcctcttactagagtgacgtcataggtaaacaggctctgtatccgtggcagcggccgtggcaggctggctgggtaccggctgtcgctgacccagtttgtataaagctcctacatcagcctgggctgcagcgcgctgccgccgcggggccggcagccatggccaaggacatcctgggtgcgactcggaccgatg

SEQ ID NO: 11117 - DNA, 203 bp, Homo sapiens
ggcgcgccagtcctagttcctcagtgacgtcataggtaaacaggctctgtatccgtggcagcggccgtggcaggctggctgggtcagcatgtgcgctgacccaggagaagctgcctgtctacatcagcctgggctgcagcgcgctgccgccgcggggccggcagccatggccaaggacatcctgggtgcgactcggaccgatg

SEQ ID NO: 11118 - DNA, 203 bp, Homo sapiens
ggcgcgccagtcctagattcgtagtgacgtcataggtaaacaggctctgtatccgtggctaattgataggcaggctggctgggtaccggctgtcgctgacccaggagaagctgcctgtctacatcagcctgggctgcagcgcgctgccgccgcggggccggcagccatggccaaggacatcctgggtgcgactcggaccgatg

SEQ ID NO: 11119 - DNA, 203 bp, Homo sapiens
ggcgcgccagtcctcataagcgagtgactagctatttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagcccgactcggaccgatg

SEQ ID NO: 11120 - DNA, 203 bp, Homo sapiens
ggcgcgccagtcctcaggtacaagtgactcccgtgccattggactcggccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 11121 - DNA, 203 bp, Homo sapiens
ggcgcgccagtccttggagtagagtgagcgacacactctgcgtcctcgcctcaccagatggagaggagaaaacctatggtggctgtgaagagatactatggtactatgtcaaattgatatcatctgatggccatgaatttattgtaaaaagagaacatgcattaacatcaggcacgataaaagccatgcgactcggaccgatg

SEQ ID NO: 11122 - DNA, 203 bp, Homo sapiens
ggcgcgccagtcctgtcgtcaaagtgagcgacacactctgcgtcctcgcctcaccagatggagaggagaaaacctatggtggctgtgaaggacctgatgccatgtatgtcaaattgatatcatctgatggccatgaatttattgtaaaaagagaacatgccacgttgaacactgcgataaaagccatgcgactcggaccgatg

SEQ ID NO: 11123 - DNA, 203 bp, Homo sapiens
ggcgcgccagtcctcagacccaagtgagcgacacactctgcgtcctcgcctcaccagatggagaggagaaaacctatggtggctgtgaaggacctgatgccatgtatgtcaaattgatatcatctgatggcctgtctcagtcatcgaaaagagaacatgcattaacatcaggcacgataaaagccatgcgactcggaccgatg

SEQ ID NO: 11124 - DNA, 203 bp, Homo sapiens
ggcgcgccagtcctctactgcgagtgagcgacacactctgcgtcctcgtgcatgtcctgtaggaggagaaaacctatggtggctgtgaaggacctgatgccatgtatgtcaaattgatatcatctgatggccatgaatttattgtaaaaagagaacatgcattaacatcaggcacgataaaagccatgcgactcggaccgatg

SEQ ID NO: 11125 - DNA, 203 bp, Homo sapiens
ggcgcgccagtccttacataacagtgagcgacacctcaaaatgttcttcctcaccagatggagaggagaaaacctatggtggctgtgaaggacctgatgccatgtatgtcaaattgatatcatctgatggccatgaatttattgtaaaaagagaacatgcattaacatcaggcacgataaaagccatgcgactcggaccgatg

SEQ ID NO: 11126 - DNA, 203 bp, Homo sapiens
ggcgcgccagtcctacgcgggaagtggcggcttcgatgacctctggtacagccgcttccctgtgctgtgagtgtttccaccactccaggagacagcattcagagttgaccttgtgagagctggccataatttaattccatctctaggttttctgtcttattgtttcagaggcacatcgagaaccaacccgactcggaccgatg

SEQ ID NO: 11127 - DNA, 203 bp, Homo sapiens
ggcgcgccagtcctccgccatgagtggcggcttctccatgggtccagccagccgcttccctgccacagataaagacccaccactccaggagacagcattcagagttgaccttgtgagagctggccataatttaattccatctctaggttttctgtcttattgtttcagaggcacatcgagaaccaacccgactcggaccgatg

SEQ ID NO: 11128 - DNA, 203 bp, Homo sapiens
ggcgcgccagtcctaatggtcgagtggcggcttctccatgggtccagccagccgcttccctgtgctgtgagtgtttaagggggaggctccgacagcattcagagttgaccttgtgagagctggccataatttaattccatctctaggttttctgtcttattgtttcagaggcacatcgagaaccaacccgactcggaccgatg

SEQ ID NO: 11129 - DNA, 203 bp, Homo sapiens
ggcgcgccagtcctgaatgttaagtggcggcttctccatgggtccagccagccgcttccctgtgctgtgagtgtttccaccactccaggagacagcattcagaggaagaagcagtctcgctggccataatttaattccatctctaggttttctgtcttattgtttcagaggcacatcgagaaccaacccgactcggaccgatg

SEQ ID NO: 11130 - DNA, 203 bp, Homo sapiens
ggcgcgccagtccttgggcaacagtggcggcttctccatgggtccagccagccgcttccctgtgctgtgagtgtttccaccactccaggagacagcattcagagttgaccttgtgagagctggccataatttaattccatctctaggttttctgtcttattgtttcagaggcaccagctcctattgtacgactcggaccgatg

SEQ ID NO: 11131 - DNA, 203 bp, Homo sapiens
ggcgcgccagtccttggtgtccagtggcggcttctccatgggtccagccagccgcttccctgtgctgtgagtgtttccaccactccaggattacattacgtcctttgaccttgtgagagctggccataatttaattccatctctaggttttctgtcttattgtttcagaggcacatcgagaaccaacccgactcggaccgatg

SEQ ID NO: 11132 - DNA, 203 bp, Homo sapiens
ggcgcgccagtcctactccagcagtggcttactcagttacttgacacgttggagctgtgaggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 11133 - DNA, 203 bp, Homo sapiens
ggcgcgccagtcctgcacgatgagtggcttactcccggtgccaggttcttggagctgtgaggtgttcagcattattagctgcgcttacgacatcatctgaagccacagtcccaggtcatcttcatcaccttccccagtggaatgcctcctgtgttaaagcccacaacaacccctgtggaggaacaacccgactcggaccgatg

SEQ ID NO: 11134 - DNA, 203 bp, Homo sapiens
ggcgcgccagtcctaccacatcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 11135 - DNA, 203 bp, Homo sapiens
ggcgcgccagtcctcgtttgttagttcagataggcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagccgactcggaccgatg

SEQ ID NO: 11136 - DNA, 203 bp, Homo sapiens
ggcgcgccagtcctaaatggcaagttcagctgagagatataaaagagcagtctttccagcacaccaggcaaagccacggcgggcactgacgggcacttgcaccgtgtggacagactctccggttctggggaaatccagtccctgttactccattttggccagaaattcaaggatactgtcatgaagcacgactcggaccgatg

SEQ ID NO: 11137 - DNA, 203 bp, Homo sapiens
ggcgcgccagtcctactctgttagttcagctgagagatataaaagagcagtctttccagcacctgcaaatccagagcggcgggcactgacgggcacttgcaccggaccccgctggcagccggttctggggaaatccagtccctgttactccattttggccagaaattcaaggatactgtcatgaagcacgactcggaccgatg

SEQ ID NO: 11138 - DNA, 203 bp, Homo sapiens
ggcgcgccagtcctctcttctaagttcagctgagagatataaaagagcagtctttccagcacctgcaaatccagagcggcgggcactgacgggcacttgcaccgtgtggacagactctccgggaagacaaccttccagtccctgttactccattttggccagaaattcaaggatactgtcatgaagcacgactcggaccgatg

SEQ ID NO: 11139 - DNA, 203 bp, Homo sapiens
ggcgcgccagtcctccaattaaagttcagctgagagatataaaagagcagtctttccagcacctgcaaatccagagcggcgggcactgacgggcacttgcaccgtgtggacagactctccggttctggggaaatccagtccctgttactccattttggccttctgcaacgattgactgtcatgaagcacgactcggaccgatg

SEQ ID NO: 11140 - DNA, 203 bp, Homo sapiens
ggcgcgccagtcctaatattctagttcagctgagagatataaaagagcagtctttccagcacctgcaaatccagagcggcgggcactgacgggcacttgcaccgtgtggacagactctgaatccacttcacgatccagtccctgttactccattttggccagaaattcaaggatactgtcatgaagcacgactcggaccgatg

SEQ ID NO: 11141 - DNA, 203 bp, Homo sapiens
ggcgcgccagtcctggcacggaagttcatccacaaacggagctttgtaatctcggattgtaaaaaatttctagacagactttagtgacttctgatctaagaacctccaccagggctgagggagctcaagtttcagcctgaggcatgggccaggaggccatggtgacctgagacccgtggattctgtcccgactcggaccgatg

SEQ ID NO: 11142 - DNA, 203 bp, Homo sapiens
ggcgcgccagtcctactggtttagttcatccacaaacggagctttgtaatctcggattgtaagggccaagcttgtgcctcccgtctggccctgatctaagaacctccaccagggctgagggagctcaagtttcagcctgaggcatgggccaggaggccatggtgacctgagacccgtggattctgtcccgactcggaccgatg

SEQ ID NO: 11143 - DNA, 203 bp, Homo sapiens
ggcgcgccagtccttgtaagagagttcatccacaaacggagctttgtaatctcggattgtaagggccaagcttgtggactttagtgacttctgatctaagaacctccaccagggctgagggagctcaagtttcagcctgaggcatgggccaggaggccataacagtaatgtcttcgtggattctgtcccgactcggaccgatg

SEQ ID NO: 11144 - DNA, 203 bp, Homo sapiens
ggcgcgccagtcctccacccttagttcatccacaaacggagctttgtaatctcggattgtaagggccaagcttgtggactttagtgactttcccctgctaggagtccaccagggctgagggagctcaagtttcagcctgaggcatgggccaggaggccatggtgacctgagacccgtggattctgtcccgactcggaccgatg

SEQ ID NO: 11145 - DNA, 203 bp, Homo sapiens
ggcgcgccagtccttaataggcagttcatccacaaacggagctttgtagcaggacgcctgcggggccaagcttgtggactttagtgacttctgatctaagaacctccaccagggctgagggagctcaagtttcagcctgaggcatgggccaggaggccatggtgacctgagacccgtggattctgtcccgactcggaccgatg

SEQ ID NO: 11146 - DNA, 203 bp, Homo sapiens
ggcgcgccagtcctggtgtacgagttctcggtctagctctagtgcccacaagaaaacagctggtttactggtcactaggcagcggaacccccctcctggtaacaggagcctctgcggccaaaagccacgtggataagatccacctttgtgtgcggtgcaaccccagcaccctggtttcttggtgacaccgactcggaccgatg

SEQ ID NO: 11147 - DNA, 203 bp, Homo sapiens
ggcgcgccagtcctgtggcgatagttctcggtctagctctagtgcccacaagaaaacagctgtagcgaccacacaaaggcagcggaacccccctcctggtaacaggagcctctgcggccaaaagccacgtggataagatccacctttgtgtgcggtgcaaccccagcaccctggagggaatacaggttcgactcggaccgatg

SEQ ID NO: 11148 - DNA, 203 bp, Homo sapiens
ggcgcgccagtcctcgctgtagagttctcggtctagctctagtgcccacaagaaaacagctgtagcgaccacacaataaggtttcccgttccctcctggtaacaggagcctctgcggccaaaagccacgtggataagatccacctttgtgtgcggtgcaaccccagcaccctggtttcttggtgacaccgactcggaccgatg

SEQ ID NO: 11149 - DNA, 203 bp, Homo sapiens
ggcgcgccagtcctacccaagtagttctcggtctgcgcgatcccagaccaagaaaacagctgtagcgaccacacaaaggcagcggaacccccctcctggtaacaggagcctctgcggccaaaagccacgtggataagatccacctttgtgtgcggtgcaaccccagcaccctggtttcttggtgacaccgactcggaccgatg

SEQ ID NO: 11150 - DNA, 203 bp, Homo sapiens
ggcgcgccagtccttatgtactagttgtgaacagacatctcgagtaagattgagctacatgagagtcctccggcccctgaatgcggctaatcctaaccatggagcaggcagctgcaacccagcagccagcctgtcgtaacgcgcaagtccgtggcggaaccgactactttgggtgtccgtgtttccttcgactcggaccgatg

SEQ ID NO: 11151 - DNA, 203 bp, Homo sapiens
ggcgcgccagtcctggaagaacagttgtgaacagggtgtgaagagcctattgagctacatgagagtcctccggcccctgaatgcggctaaaaggtggagatacccaggcagctgcaacccagcagccagcctgtcgtaacgcgcaagtccgtggcggaaccgactactttgggtgtccgtgtttccttcgactcggaccgatg

SEQ ID NO: 11152 - DNA, 203 bp, Homo sapiens
ggcgcgccagtcctagctacaaagttgtgaacagggtgtgaagagcctattgagctacatgagagtcctccggcccctgaatgcggctaatcctaaccatggagcaggcagctgcaacccagcagccagcctagaccctatatggggtccgtggcggaaccgactactttgggtgtccgtgtttccttcgactcggaccgatg

SEQ ID NO: 11153 - DNA, 203 bp, Homo sapiens
ggcgcgccagtcctgaaacataagttgtgaacagggtgtgaagagcctattgagctacatgagagtcctccggcccctgaatgcggctaatcctaaccatggagcaggcagctgcaacccagcagccagcctgtcgtaacgcgcaagtccgtggcggaaccgactactttgggtgtccgtgtttccttcgactcggaccgatg

SEQ ID NO: 11154 - DNA, 203 bp, Homo sapiens
ggcgcgccagtcctacaatacaagttgtgaacagggtgtgaagagccttcgttcggctccccgagtcctccggcccctgaatgcggctaatcctaaccatggagcaggcagctgcaacccagcagccagcctgtcgtaacgcgcaagtccgtggcggaaccgactactttgggtgtccgtgtttccttcgactcggaccgatg

SEQ ID NO: 11155 - DNA, 203 bp, Homo sapiens
ggcgcgccagtcctagtagttcataaaaaacccagtctttgctgaccagacaaagcataccagatctcaccagagagtcctaggggactacagaaggaaaaagaattccaagctcttaatatctgtgtgtcctcccgctgaccacacttcctttagtgacccgattgcctcctcaagtcgcagacactcgactcggaccgatg

SEQ ID NO: 11156 - DNA, 203 bp, Homo sapiens
ggcgcgccagtcctccggtgtaataaaaaacccagtctttgctgaccagacaaagcataccagatctcaccagagagtcctaggggactacagaaggaaaaagacaagaggcagtaggatatctgtgtgtcctcccgctgaccacacttcctttagtgactgagcatatgttagaagtcgcagacactcgactcggaccgatg

SEQ ID NO: 11157 - DNA, 203 bp, Homo sapiens
ggcgcgccagtcctgcgacagcataaactatgtgattccaagtgaagtcctactgactcgcctcttgatcgggctatacaacatctgcagagacttactatccaagaactccccgacccgccgactgatctcccagagtctaacagcaatcagggactggctgagacttaaggcggcccaactgcaatcgactcggaccgatg

SEQ ID NO: 11158 - DNA, 203 bp, Homo sapiens
ggcgcgccagtcctcacggatgataaactatgtgcagttcctgatccacctactgactcgcctcttgatcgggctagttgcagctactccagacttactatccaagaactccccgacccgccgactgatctcccagagtctaacagcaatcagggactggctgagacttaaggcggcccaactgcaatcgactcggaccgatg

SEQ ID NO: 11159 - DNA, 203 bp, Homo sapiens
ggcgcgccagtcctacttgggtataaactatgtgcagttcctgatccacctactgactcgcctcttgatcgggctatacaacatctgcagagacttactatccaagaactccccgacccgccgactgatctcccagagtctaacagcaatcagggactggagtttgggggtacgggcccaactgcaatcgactcggaccgatg

SEQ ID NO: 11160 - DNA, 203 bp, Homo sapiens
ggcgcgccagtcctcgacacagataaactatgtgcagttcctgatccacctactgactcgcctcttgatcgggctatacaacatctgcagagacttactatccaagaactccccgacccgccgactgatctcccagagtctaacagcaatcagggactggctgagacttaaggcaaggggctatgttgcgactcggaccgatg

SEQ ID NO: 11161 - DNA, 203 bp, Homo sapiens
ggcgcgccagtcctcgacatttataaactatgtgcagttcctgatccacctactgactcgcctcttgatcgggctatacaacatctgcagagacttactatccaagaactccccgacccgccgactgatctcccagagtctaacagcaatcagggactggctgagacttaaggcggcccaactgcaatcgactcggaccgatg

SEQ ID NO: 11162 - DNA, 203 bp, Homo sapiens
ggcgcgccagtccttcaccgctataaactatgtgcagttcctgatccagggtaccgtaatattcttgatcgggctatacaacatctgcagagacttactatccaagaactccccgacccgccgactgatctcccagagtctaacagcaatcagggactggctgagacttaaggcggcccaactgcaatcgactcggaccgatg

SEQ ID NO: 11163 - DNA, 203 bp, Homo sapiens
ggcgcgccagtcctcgaacactataaatgccccttggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttcgactcggaccgatg

SEQ ID NO: 11164 - DNA, 203 bp, Homo sapiens
ggcgcgccagtcctcaaagtcgataagtaagccgtgccgaaacgttaagtacgtatacagcacgtaacaactgttagtttaattttccaaaatttatttttcacaatttttagttaagattttagcttgccttaagcagtctttatatcttctgtatattattttaaagtttataggagcaaagttcgcgactcggaccgatg

SEQ ID NO: 11165 - DNA, 203 bp, Homo sapiens
ggcgcgccagtcctcgcgtggaataagtaagccgtgccgaaacgttaatcggtcgctagttgcgtaacaactgttagtttaattttccaaaatttatttttcacaatttttagttaagattttagcttgcctgtccactcgacctgatcttctgtatattattttaaagtttataggagcaaagttcgcgactcggaccgatg

SEQ ID NO: 11166 - DNA, 203 bp, Homo sapiens
ggcgcgccagtccttcaggacgataagtaagccgtgccgaaacgttaatcggtcgctagttgcgtaacaactgttagtttaattttccaaaatttatttttcacggccgcccaacggaattttagcttgccttaagcagtctttatatcttctgtatattattttaaagtttataggagcaaagttcgcgactcggaccgatg

SEQ ID NO: 11167 - DNA, 203 bp, Homo sapiens
ggcgcgccagtcctagcctgggataatgggctgtgtgcaatgtaaggataaagaagcaacaaaactgacggaggagagggacggcagcctgaaccagagctctgccaggttaatacaaacagaccccacccctcagcactaccccagcttcggtgtgacctccatccccaactacaacaacttccacgcgactcggaccgatg

SEQ ID NO: 11168 - DNA, 203 bp, Homo sapiens
ggcgcgccagtcctaggagtgtataatgggctgtgtgcaatgtaaggataaagaagcaacaaaactgacggaggagagggacggcagcctgaaccagagctctgggtaccgctatggcacagaccccaccccgtgcactaggatatgcttcggtgtgacctccatccccaactacaacaacttccacgcgactcggaccgatg

SEQ ID NO: 11169 - DNA, 203 bp, Homo sapiens
ggcgcgccagtcctctccaaccataatgggctgtgtgcaatgtaaggataaagaagcaacaaaactgacggaggagagggacggcagcctgaaccagagctctgggtaccgctatggccgttctagtttggttcagcactaccccagcttcggtgtgacctccatccccaactacaacaacttccacgcgactcggaccgatg

SEQ ID NO: 11170 - DNA, 203 bp, Homo sapiens
ggcgcgccagtccttagagcgcataatgggctgtgtgcaatgtaaggataaagaagcaacaatctgagacacatgtagggacggcagcctgaaccagagctctgggtaccgctatggcacagaccccacccctcagcactaccccagcttcggtgtgacctccatccccaactacaacaacttccacgcgactcggaccgatg

SEQ ID NO: 11171 - DNA, 203 bp, Homo sapiens
ggcgcgccagtcctggtccgtgatacacggtttgtcccccccttccccttccccggggtctgggggtgacattgcaccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 11172 - DNA, 203 bp, Homo sapiens
ggcgcgccagtccttcacgcatatacttggaaaaacccacatagcattaaaaacaaagtactactgaacaaagtgataaatacattttctccgtcacgatggccctaaccacaggaacatttaaacttacaatagaattcactgaagaatatccaaataaaccacctacagttagatttgtctctaagcgactcggaccgatg

SEQ ID NO: 11173 - DNA, 203 bp, Homo sapiens
ggcgcgccagtcctttagccgaatatcaggctcttgaagagcctattgagctagctggtagtcctccggcccctgaatgcggctaatcctaactgcggagcacatgctcacaaaccagtgggtggtgtgtcgtaacgggcaactctgcagcggaaccgactactttgggtgtccgtgtttccttttatcgactcggaccgatg

SEQ ID NO: 11174 - DNA, 203 bp, Homo sapiens
ggcgcgccagtcctgcgcatgcatattttaggccagaggttaataagaaggaagtagtgctatcttaataattaggttaactatttagttttactgttcaggatgcctattggcagccccataatatccaggacaccctctctgcttcttatatgattaggttgtcatttagaataagaaaataacctcgactcggaccgatg

SEQ ID NO: 11175 - DNA, 203 bp, Homo sapiens
ggcgcgccagtcctaccagttaatcacccctaaatgtattccaaagaataagaacattgttttatacatagcacacttaacaaaatcaagaaatttaacattaatacagtactgttacctaatccgtagtcgattttcaaattttgtcagttgttccaataatgtcctttatatgactttgaggtgttcgactcggaccgatg

SEQ ID NO: 11176 - DNA, 203 bp, Homo sapiens
ggcgcgccagtcctgtgtttagatcacccctaaatgtattccaaagaataagaacattgttttatacatagcacacttaacaaaatcaagaaatttaacattaatacagtactgttacctaatccgtagtcgattttcaaattttgtcagttgttccaatgccaggtggggacgattccccgcccagccgactcggaccgatg

SEQ ID NO: 11177 - DNA, 203 bp, Homo sapiens
ggcgcgccagtcctctcggccaatcacccctaaatgtattccaaagaataagaacattgttttatacatagcacacttaacaaaatcaagtttcgactgtcccttacagtactgttacctaatccgtagtcgattttcaaattttgtcagttgttccaataatgtcctttatatattccccgcccagccgactcggaccgatg

SEQ ID NO: 11178 - DNA, 203 bp, Homo sapiens
ggcgcgccagtccttccaccatatcaggctcaggttctgaggaagaagaggaggaggaggaagaggaggaggaggaagggagcaccagtgaagaatcagaggaggaagaggaagaggaggaggaggagaccggcagcaactctgagagactcatgagaacgtctgccgaagaagtaagtgaggaagaacgactcggaccgatg

SEQ ID NO: 11179 - DNA, 203 bp, Homo sapiens
ggcgcgccagtcctgttaagccatcaggctcaggttctgaggaagaagaggaggaggaggaagaggaggaggaggaagggagcaccagtgaagaatcagaggaggaagaggaagaggaggaggaggagaccggcagcaactctgaggaggcatcagagcatgagcaacgcagcttaagtgaggaagaacgactcggaccgatg

SEQ ID NO: 11180 - DNA, 203 bp, Homo sapiens
ggcgcgccagtccttgaccgaaatcaggctcaggttctgaggaagaagaggaggaggaggaagaggaggaggaggatactgtacttgcacaagaatcagaggaggaagaggaagaggaggaggaggagaccggcagcaactctgaggaggcatcagagcagtctgccgaagaagtaagtgaggaagaacgactcggaccgatg

SEQ ID NO: 11181 - DNA, 203 bp, Homo sapiens
ggcgcgccagtcctggaggcagatcaggctcaggttctgaggaagaaggacttataagactggaggaggaggaggaagggagcaccagtgaagaatcagaggaggaagaggaagaggaggaggaggagaccggcagcaactctgaggaggcatcagagcagtctgccgaagaagtaagtgaggaagaacgactcggaccgatg

SEQ ID NO: 11182 - DNA, 203 bp, Homo sapiens
ggcgcgccagtcctcttccctgatcagttcaatagtttagttattttaaaatatttgagaataggtaagtttctatggcacttcatagcaataggtaataattaacagcttaattatacactccgttccccataaaatcgtaactatttaatttacaaagtaaaaacaaaaatatgggacaagtagttcgactcggaccgatg

SEQ ID NO: 11183 - DNA, 203 bp, Homo sapiens
ggcgcgccagtcctgtgatacgatcattacattgtccgaggacgtggtgaaggagctgaagaaggctctgtgcaatcctcacattcaagctgataggctgcgctaccggaatgtcatccagcgagtgattagatctggctctcctggccatcaatacgctgtgcaaagactgctcagaccccaatccacgactcggaccgatg

SEQ ID NO: 11184 - DNA, 203 bp, Homo sapiens
ggcgcgccagtcctgacggcggatccacaacatccttcaggtctccggcccacccagccagggcagcgccagcactagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 11185 - DNA, 203 bp, Homo sapiens
ggcgcgccagtcctcaggaaatatccacaacatctccacatcgctgtccccacccagccaggaatataagctatgcagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 11186 - DNA, 203 bp, Homo sapiens
ggcgcgccagtccttatgcttcatccacaacatctccacatcgctgtccccacccagccagggcagcgccagcactagctcagacgcaaggacggaaccgctggactccaggttccttgcctgggagtaggagaaatccacctgctgggggctgagtgtgcttgcgttagtcttccctgggtcccgggcgactcggaccgatg

SEQ ID NO: 11187 - DNA, 203 bp, Homo sapiens
ggcgcgccagtcctgtgtgctaatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 11188 - DNA, 203 bp, Homo sapiens
ggcgcgccagtcctacttaatgatccacaacatctccacatcgctgtccccacccagccagggcagcgccagcactctgcaccgtatcctgacggaaccgctggactccaggttccttgcctgggagtaggagaaatccacctgctgggggctgagtgtggcctgagggacaggccctgggtcccgggcgactcggaccgatg

SEQ ID NO: 11189 - DNA, 203 bp, Homo sapiens
ggcgcgccagtcctaactcctaatccagacaggactcaccgagtatcaaatgataagaactgtcgcgcaacttcctaataatacttgcactgggagcactaagaaaagattgatctctgggctggtgaacataatctctgtcccagtcagaaaaggagagaggaaattagcagagcgattggtggagacgactcggaccgatg

SEQ ID NO: 11190 - DNA, 203 bp, Homo sapiens
ggcgcgccagtccttattaagtatccatgctctcaggctccgatttgtgaataggtttttatattcgaagtaggtagtattgcgcatactattaattccacaatacgtggtcttcgtcttagcaaatttacctttcgtccctatggaaatggctcttcggacctgagtacagtgggacaaccccaacgcgactcggaccgatg

SEQ ID NO: 11191 - DNA, 203 bp, Homo sapiens
ggcgcgccagtcctgccgccacatccgcagtttaggagagaggaagtaagaagacgcctccgggtaagggacgcccgcctttggggaaaaaccaatgcgcgtactgtaaggaggagggacattggaagaagaactgtccaaaactcgtaagcggggcaaccccagtgttggtagaagaattacaatagcgactcggaccgatg

SEQ ID NO: 11192 - DNA, 203 bp, Homo sapiens
ggcgcgccagtcctatgcgcaaatccgcccaggtagccggctcggacccaggtcctgcgcccaggtcctcccctgccccccagcgacggagccggggccgggggtaattttatgaaacggccatgcgggtgagccgcggctgcagaggcctgagcgcctgatcgccgcggacccgagccgagcccacccgactcggaccgatg

SEQ ID NO: 11193 - DNA, 203 bp, Homo sapiens
ggcgcgccagtcctgaaagctgatccggagtaactaagttggctggtactgccgtaataaatttaagagcagaccagattaatgatatggtttattcccttcttgaaaagggtaaactacttattagagatacaaataaagaagttttcgttggtgacagtttggttaatgtaatctaaactttaaaacgactcggaccgatg

SEQ ID NO: 11194 - DNA, 203 bp, Homo sapiens
ggcgcgccagtcctaatcgaacatctagtctcataagtgaccctccctgggctgctttctttcgattatcatcagtagggaaggtttcagtgctcttcccagcacaactccggtgcaaaggcttgggcatcctggtgctttgcctctagcccatgctccacagcgaggagagagaaaaccctgaggcacgactcggaccgatg

SEQ ID NO: 11195 - DNA, 203 bp, Homo sapiens
ggcgcgccagtcctgggaaatcatctagtctcataagtgaccctccctgggctgctttctttcgattatcatcagtgaccctaccccggctgctcttcccagcacaactccggtgcaaaggcttgggcatcctggtgctttgcctctagcccatgctccacagcgaggagagagaaaaccctgaggcacgactcggaccgatg

SEQ ID NO: 11196 - DNA, 203 bp, Homo sapiens
ggcgcgccagtcctcgaagatgatctagtctcataagtgaccctccctgggctgctttctttcgattatcatcagtgaccctaccccggctgctcttcccagcatcgtggaccacaggaggcttgggcatcctggtgctttgcctctagcccatgctccacagcgaggagagagaaaaccctgaggcacgactcggaccgatg

SEQ ID NO: 11197 - DNA, 203 bp, Homo sapiens
ggcgcgccagtccttcctcttaatctagtctcataagtgaccctcccttacagttacaacagcgattatcatcagtgaccctaccccggctgctcttcccagcacaactccggtgcaaaggcttgggcatcctggtgctttgcctctagcccatgctccacagcgaggagagagaaaaccctgaggcacgactcggaccgatg

SEQ ID NO: 11198 - DNA, 203 bp, Homo sapiens
ggcgcgccagtccttgatggcgatctagtctcatcctgcctatagaaagggctgctttctttcgattatcatcagtgaccctaccccggctgctcttcccagcacaactccggtgcaaaggcttgggcatcctggtgctttgcctctagcccatgctccacagcgaggagagagaaaaccctgaggcacgactcggaccgatg

SEQ ID NO: 11199 - DNA, 203 bp, Homo sapiens
ggcgcgccagtcctggcatgtcatctagtttccttaaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgcccgactcggaccgatg

SEQ ID NO: 11200 - DNA, 203 bp, Homo sapiens
ggcgcgccagtcctcttcatcaatctatgcactgtcggcctgttgttgtgaatcgccagacctttgtaacacccggaagtctgaagcatgtgtttgatgatctcagaggctcagtatccttgtcctgggttggagatagcactggggtcattctagtcttgactaccttccatgtaccactggtaattcgactcggaccgatg

SEQ ID NO: 11201 - DNA, 203 bp, Homo sapiens
ggcgcgccagtccttgcgagtaatctcagttctaaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 11202 - DNA, 203 bp, Homo sapiens
ggcgcgccagtcctgttgcctcatctctagcagtggcgcccgaacagggacctgaaagcgaattcatggggtctaaagctctctcgacgcaggactcggcttgctgaagcgcgcacggcaagaggcgaggggcggcgactggtgagtacgccaaaaattttgactagcggaggctagaaggagagagacgactcggaccgatg

SEQ ID NO: 11203 - DNA, 203 bp, Homo sapiens
ggcgcgccagtcctcggattcaatctctgtgcaccaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcagaccctgagagcgactcggaccgatg

SEQ ID NO: 11204 - DNA, 203 bp, Homo sapiens
ggcgcgccagtcctatgcatttatctgagaatagaaccacaatcaagtcatactactagtcactatacaataatcaacaattttagtcaactgattaccaagatgttatcataggtccgaactgatcaatctaacaaaaaaactaaacgttccacaataagctgcacactgctacaaaatattcagcccgactcggaccgatg

SEQ ID NO: 11205 - DNA, 203 bp, Homo sapiens
ggcgcgccagtcctcacagttcatctgagaatagaaccacaatcaagtcatactactagtcactatacaataatcaacaattttagtcaatctggacgtttttagttatcataggtccgaactgatcaatctaacaaaaaaactaaacgttccacaataaatcaacgttcaggccaaaatattcagcccgactcggaccgatg

SEQ ID NO: 11206 - DNA, 203 bp, Homo sapiens
ggcgcgccagtcctatgcttggatctgagaatagtcggggtgctggtacatactactagtcactatacaataatcaacaattttagtcaactgattaccaagatgttatcataggtccgaactgatcaatctaacaaaaaaactaaacgttccacaataaatcaacgttcaggccaaaatattcagcccgactcggaccgatg

SEQ ID NO: 11207 - DNA, 203 bp, Homo sapiens
ggcgcgccagtcctaagaatgcatctgatctcagacgtgttctcgtcactgcaactcttggaacaagataagacagtcatccattagtaatttttaagaaaaaaacgataggaccgaacctagtattgaaagaaccgtctcggtcaatctaggtaatcgagctgataccgtctcggaaagctcaaatccgactcggaccgatg

SEQ ID NO: 11208 - DNA, 203 bp, Homo sapiens
ggcgcgccagtcctcgcagaatatctgatctcagtgagaaaaatcaacctgcaactcttggaacaagataagacagtcatccattagtaaaacccccatcgtcgacgataggaccgaacctagtattgaaagaaccgtctcggtcaatctaggtaatcgagctgataccgtctcggaaagctcaaatccgactcggaccgatg

SEQ ID NO: 11209 - DNA, 203 bp, Homo sapiens
ggcgcgccagtcctgggcgcgtatctgatctcagtgagaaaaatcaacctgcaactcttggaacaagataagacagtcatccattagtaatttttaagaaaaaaacgataggaccgaaagccaatcattgtcaaccgtctcggtcaatctaggtaatcgagctgataccgtctcggaaagctcaaatccgactcggaccgatg

SEQ ID NO: 11210 - DNA, 203 bp, Homo sapiens
ggcgcgccagtccttcatagtgatctgatctcagtgagaaaaatcaacctgcaactcttggaacaagataagacagtcatccattagtaatttttaagaaaaaaacgataggaccgaacctagtattgaaagtcgttggctccgacatctaggtaatcgagctgataccgtctcggaaagctcaaatccgactcggaccgatg

SEQ ID NO: 11211 - DNA, 203 bp, Homo sapiens
ggcgcgccagtccttaacgcccatctgatctcagtgagaaaaatcaacctgcaactcttggaacaagataagacagtcatccattagtaatttttaagaaaaaattctcttatttacccctagtattgaaagaaccgtctcggtcaatctaggtaatcgagctgataccgtctcggaaagctcaaatccgactcggaccgatg

SEQ ID NO: 11212 - DNA, 203 bp, Homo sapiens
ggcgcgccagtcctgaactgctatctgcctacaaactggtttgctactttaccaactggtcccaggaccggcaggaaccaggaaaattcacccctgagaatattgaccccttcctatgctctcatctcatctattcattcgccagcgcgtcgcttgtggtggttatcatcaaggacaagagtgaagtgcgactcggaccgatg

SEQ ID NO: 11213 - DNA, 203 bp, Homo sapiens
ggcgcgccagtccttcctttgcatctggccatccatccgtgggggtctatgggccttcgagatagccgccaggaatttttccagcagctactgcaaggctgtctcctgcctactgcccagcagggccttgaccagatctggctgctccttgccatctgcctcgcctgccgcctcctctggaggctcggcgactcggaccgatg

SEQ ID NO: 11214 - DNA, 203 bp, Homo sapiens
ggcgcgccagtccttttcacaaatctggccatccatccgtgggggtctgcaatggccaccttcctaatgtgttctattttccagcagctactgcaaggctgtctcctgcctactgcccagcagggccttgaccagatctggctgctccttgccatctgcctcgcctgccgcctcctctggaggctcggcgactcggaccgatg

SEQ ID NO: 11215 - DNA, 203 bp, Homo sapiens
ggcgcgccagtcctaattacggatctggccatccatccgtgggggtctgcaatggccacctttagccgccaggaatgcagtattgctaacctgcaaggctgtctcctgcctactgcccagcagggccttgaccagatctggctgctccttgccatctgcctcgcctgccgcctcctctggaggctcggcgactcggaccgatg

SEQ ID NO: 11216 - DNA, 203 bp, Homo sapiens
ggcgcgccagtcctttaggttcatctggccatccatccgtgggggtctgcaatggccacctttagccgccaggaatttttccagcagctactgcaaggctgtctcctgcctactgcccagcagggccttgacatatcaccagccgcccttgccatctgcctcgcctgccgcctcctctggaggctcggcgactcggaccgatg

SEQ ID NO: 11217 - DNA, 203 bp, Homo sapiens
ggcgcgccagtcctaacctcctatctggccatccatccgtgggggtctgcaatggccacctttagccgccaggaatttttccagcagctactgcaaggctgtctcctgcctactgcccagcagggccttgaccagatctggctgctccttgccatctgccggtatcctatgacactctggaggctcggcgactcggaccgatg

SEQ ID NO: 11218 - DNA, 203 bp, Homo sapiens
ggcgcgccagtccttgctgctaatctggccatccatccgtgggggtctgcaatggccacctttagccgccaggaatttttccagcagctactgcaaggctgtctgactggctaaatgaagcagggccttgaccagatctggctgctccttgccatctgcctcgcctgccgcctcctctggaggctcggcgactcggaccgatg

SEQ ID NO: 11219 - DNA, 203 bp, Homo sapiens
ggcgcgccagtcctgctcagctatctggccatccatccgtgggggtctgcaatggccacctttagccgccaggaatttttccagcagctataattgcatccgaacctgcctactgcccagcagggccttgaccagatctggctgctccttgccatctgcctcgcctgccgcctcctctggaggctcggcgactcggaccgatg

SEQ ID NO: 11220 - DNA, 203 bp, Homo sapiens
ggcgcgccagtcctagtaaaccatctggccatcccgtacgaattaggcgcaatggccacctttagccgccaggaatttttccagcagctactgcaaggctgtctcctgcctactgcccagcagggccttgaccagatctggctgctccttgccatctgcctcgcctgccgcctcctctggaggctcggcgactcggaccgatg

SEQ ID NO: 11221 - DNA, 203 bp, Homo sapiens
ggcgcgccagtcctattagcggatcttcctcccggcggttttttggttagtagctcacaatcatctcgtgtttcagcaaagtgtgcataattataaagtgctgggtcatctaagcttttcagtcgagaaaaaaacagtagatcagaagaacaactggcaacacttctcatcctgagacctacttcaagcgactcggaccgatg

SEQ ID NO: 11222 - DNA, 203 bp, Homo sapiens
ggcgcgccagtcctcgaacttaatcttggcgaattaaccttaaccctagagccttatgccacgatccagtggttgtaaggtcgtaatgagcaattccgggacgggaccgactactttgggtgtccgtgtttctcatttttcttcatattgtcttatggtcacagcatatatatacatatactgtgatccgactcggaccgatg

SEQ ID NO: 11223 - DNA, 203 bp, Homo sapiens
ggcgcgccagtcctccggcactatgacagagatcttctagactaggtgcgagaggccgaggaccagaacaacatccgcctaccctccatcattgttataaaaaacttaggaaccaggtccacacagccgccagccaaccaaccatccactcccacgactgaccataggttgtatagagcaggcacgcccgactcggaccgatg

SEQ ID NO: 11224 - DNA, 203 bp, Homo sapiens
ggcgcgccagtcctctatcttcatgacagagatcttctagactaggtgcgagaggccgaggaccagaacaacatccgcctaccctccatcattgttataaaaaacttaggaaccaggtccacacagccgccagccaaccaaccatcgtactgtttcgtgagagccgatggcagaagagcaggcacgcccgactcggaccgatg

SEQ ID NO: 11225 - DNA, 203 bp, Homo sapiens
ggcgcgccagtcctgacatcgaatgacagagatcttctagactaggtggatccacagcgattccagaacaacatccgcctaccctccatcattgttataaaaaacttaggaaccaggtccacacagccgccagccaaccaaccatccactcccacgactggagccgatggcagaagagcaggcacgcccgactcggaccgatg

SEQ ID NO: 11226 - DNA, 203 bp, Homo sapiens
ggcgcgccagtcctcctctccgatgaccaattatatgaatcaattatctgaattacttggatttgatcttaatccataaattataataaagcgacttatcttggtcaatgtcactaacaccattagttaatataaaacttgacagaagataaaaatggggcaaataaatcaattcagccgacccaacccgactcggaccgatg

SEQ ID NO: 11227 - DNA, 203 bp, Homo sapiens
ggcgcgccagtccttcccgaggatgagaagcgaccacccctcgacgacttctccttcacggtcgaacgagtatcatacggccaactctcccccggaatccataacggctcacgcaaatagatttctttccgttcctcctcggagggctctccacatttatctgctcgagacgtggcagctccagaacccgactcggaccgatg

SEQ ID NO: 11228 - DNA, 203 bp, Homo sapiens
ggcgcgccagtcctgtccctatatgagaagcgaccacccctcgacgacttctccttcacggttcccacccaggagcacggccaactctcccccggaatccataacggctcacgcaaatagatttctttccgtaatagacaacctatctctccacatttatctgctcgagacgtggcagctccagaacccgactcggaccgatg

SEQ ID NO: 11229 - DNA, 203 bp, Homo sapiens
ggcgcgccagtcctaaactaggatgagaagcgaccacccctcgacgacttctccttcacggttcccacccaggagcacggccaactctcccccggaatccataacggctcacgcaaatagatttctttccgttcctcctcggagggagtagtcatcccccctgctcgagacgtggcagctccagaacccgactcggaccgatg

SEQ ID NO: 11230 - DNA, 203 bp, Homo sapiens
ggcgcgccagtccttagcaactatgagaagcgaccacccctcgacgacttctccttcacggttcccacccaggagcacggccaactctcccccggaatccataacggctcacgcaaatagatttctttccgttcctcctcggagggctctccacatttatctgctcgagacgtgttgcgatacccctacgactcggaccgatg

SEQ ID NO: 11231 - DNA, 203 bp, Homo sapiens
ggcgcgccagtcctcggcagcgatgagaagcgaccacccctcgacgacttctccttcacggttcccacccaggagcacggccaactctcccccggaatccataattttctcaaatcgaagatttctttccgttcctcctcggagggctctccacatttatctgctcgagacgtggcagctccagaacccgactcggaccgatg

SEQ ID NO: 11232 - DNA, 203 bp, Homo sapiens
ggcgcgccagtcctcaagacttatgagcgcgagcggcgggctcttgggtcttttttagcgccatctgctcgcggcgccgcctcctgctcctcccgctgctgctgccgctgccgccctgagtcactgcctgcgcagctccggccgccaaaggtgtacgttcagtcgccgatatttggagttcttacaaccgactcggaccgatg

SEQ ID NO: 11233 - DNA, 203 bp, Homo sapiens
ggcgcgccagtccttcgtatgtatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaaccgactcggaccgatg

SEQ ID NO: 11234 - DNA, 203 bp, Homo sapiens
ggcgcgccagtccttgtcaagcatgagcgcgagcggcgggctcttgggtcttttttagcgccatctgctcgcggcgccgcctcctgctcctcccgctgctgctgccgctgccgccctgagtcactgcctgcggccggtgacttatatggctccccatactagtcgccgatatttggagttcttacaaccgactcggaccgatg

SEQ ID NO: 11235 - DNA, 203 bp, Homo sapiens
ggcgcgccagtcctactaacatatgagcgcgagcggcgggctcttgggtcttttttagcgcctaactgagcgtcgtccgcctcctgctcctcccgctgctgctgccgctgccgccctgagtcactgcctgcgcagctccggccgcctggctccccatactagtcgccgatatttggagttcttacaaccgactcggaccgatg

SEQ ID NO: 11236 - DNA, 203 bp, Homo sapiens
ggcgcgccagtcctatgacaacatgatctttgaatattaaatgaaaggagactagaataacaactatgaacaggcgcatgaaggagctttagcaggagcattctttcttggtgtgcaaatcacgcctggcagcccctgcccacagtacccgaagatggcaggccttgttcccttcacctaaattcatacgactcggaccgatg

SEQ ID NO: 11237 - DNA, 203 bp, Homo sapiens
ggcgcgccagtccttgcgtcgtatgatctttgaatattaaatgaaaggagactagaataacagtctcttgactattcatgaaggagctttagcaggagcattctgatccctacgaattatcacgcctggcagcccctgcccacagtacccgaagatggcaggccttgttcccttcacctaaattcatacgactcggaccgatg

SEQ ID NO: 11238 - DNA, 203 bp, Homo sapiens
ggcgcgccagtccttggccctaatgatgatgcttggtttaagctatcgagttgaccccgggtcaattcttggttcttccgacatgtctacaggaaaagttttcatttccgtaaggcttgtcaaaatttagattgtaattgtttggggttttatgaatcttcagttgaagaatattaaactcagtgaaacgactcggaccgatg

SEQ ID NO: 11239 - DNA, 203 bp, Homo sapiens
ggcgcgccagtccttttgagtgatgatgatgcttggtttaagctatcgtaccattatgaaaacaattcttggttcttccgacatgtctacaggaaaagttttcatttccgtaaggcttgtcaaaatttagattgtaattgtttggggttttatgaatcttcagttgaagaatattaaactcagtgaaacgactcggaccgatg

SEQ ID NO: 11240 - DNA, 203 bp, Homo sapiens
ggcgcgccagtccttcgggcttatgatgatgcttggtttaagctatcgtaccattatgaaaacaattcttggttcttccgacatgtctacaggaaaagttttcatttccgtaaggcttgtcaaaatttagattgtaattgtttggggttttatgaatcttttccacgccttagataaactcagtgaaacgactcggaccgatg

SEQ ID NO: 11241 - DNA, 203 bp, Homo sapiens
ggcgcgccagtcctaggatgccatgatgatgcttttgcgccctctgtataccattatgaaaacaattcttggttcttccgacatgtctacaggaaaagttttcatttccgtaaggcttgtcaaaatttagattgtaattgtttggggttttatgaatcttcagttgaagaatattaaactcagtgaaacgactcggaccgatg

SEQ ID NO: 11242 - DNA, 203 bp, Homo sapiens
ggcgcgccagtcctcgttacccatgatgcgaggcgaaatgaatcaagtagattctctgggatataagaggcagccgaagagttcacaagtgtgaagcctggaagccggcgggtgccgctgtgtaggaaagaagctaaagcacttccagagcctgtccggagctcagaggttcggaagacttatcgacccgactcggaccgatg

SEQ ID NO: 11243 - DNA, 203 bp, Homo sapiens
ggcgcgccagtccttggaccctatgcaattaagggcgacggagcggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggcgactcggaccgatg

SEQ ID NO: 11244 - DNA, 203 bp, Homo sapiens
ggcgcgccagtcctgacagggtatgcagtggtgtgatcctgcgccagggggtgtgggcctcgctcaccggcggttggttcttcgacccgcaccagagcaccttctccaactgcttccacctctatgtgtggatcttcctgctcatctttcccttcttactgtacatggtcctgcctcccagcttgatgcgactcggaccgatg

SEQ ID NO: 11245 - DNA, 203 bp, Homo sapiens
ggcgcgccagtcctttgcacggatgcatagtatgctacgcgcgcgccaatctccacgacgccgactaacgcccctgtacgtggggcctttaatcttacctactctaaccaggtcatcacccaccgttgtttcgccgcatctggtgggtacccaacttttgccattcgggagagccccagggtgcccgacgactcggaccgatg

SEQ ID NO: 11246 - DNA, 203 bp, Homo sapiens
ggcgcgccagtcctccgtccgcatgcggcggcccaatcggaaggtggaccgaaatcccgcgacagcaagaggcccggtttccagttgacagctaaggaacacagtgctttcaaaagaattggcgtccgctgttcgcctctcctcccgggagtcttctgcctactcccagaagaggagggaagcacagtcgactcggaccgatg

SEQ ID NO: 11247 - DNA, 203 bp, Homo sapiens
ggcgcgccagtcctgtcaccagatgcggcggcccaatcggaaggtggaccgaaatcccgcgacagcaagaggcccgtagcgacccgcggtaaggctagcaggtatgctttcaaaagaattggcgtccgctgttcgcctctcctcccgggagtcttctgcctactcccagaagaggagggaagcacagtcgactcggaccgatg

SEQ ID NO: 11248 - DNA, 203 bp, Homo sapiens
ggcgcgccagtcctgtataagaatgcggcggcccaatcggaaggtggaccgaaatcccgcgacagcaagaggcccgtagcgacccgcggtgctaaggaacacagtgctttcaaaagaattggcgtccgctgttcgcctctcctccctttttcaccacaggtactcccagaagaggagggaagcacagtcgactcggaccgatg

SEQ ID NO: 11249 - DNA, 203 bp, Homo sapiens
ggcgcgccagtcctgctagtatatgctaccagaggtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctccctctccggccgggcgactcggaccgatg

SEQ ID NO: 11250 - DNA, 203 bp, Homo sapiens
ggcgcgccagtcctataccggcatgctactttatgcgccccgcccttgcgctcagcgccctctcaccgcccggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 11251 - DNA, 203 bp, Homo sapiens
ggcgcgccagtcctagtgaattatgctgcaaaagcatatgctgaacaatcgtgttgcgtgtttgtgattaactacagtgtattagacttgacagcagaagaactagaggctatcaaacatcagcttaatccaaaagataatgatgtagagctttgagttaataaaaaaaatggggcaaataaaacatccgactcggaccgatg

SEQ ID NO: 11252 - DNA, 203 bp, Homo sapiens
ggcgcgccagtcctcccttgcaatggagtggtttgctatttagcgtacgtgtaccataggcagccccaaaaacacgtgtgaggagaaagtcccagtcactttgggcaaagtagacagccgcgcttgcgtggtgggacttaattaatgcctgctaacccagagcctcgctgccggtttgatacaacaaccgactcggaccgatg

SEQ ID NO: 11253 - DNA, 203 bp, Homo sapiens
ggcgcgccagtcctttcttactatggagtggtttgctatttagcgtactccggattgctcgcgccccaaaaacacgtgtgaggagaaagtcccagtcactttgggcaaagtagacagccgcgcttgcgtggtgggacttaattaatgcctgctaacccagttgaaattgataattttgatacaacaaccgactcggaccgatg

SEQ ID NO: 11254 - DNA, 203 bp, Homo sapiens
ggcgcgccagtcctaacgatttatggcagggccacgccccagcccatgacaacaatgttggatggcagccttgatcagcgtcagcctctctgggaccttggcaaaccgctgcaagaaggccccagtgaagagctgcacggagtgtgtccgtgtggataaggactgcgcctactgcacagacgagatgtcgactcggaccgatg

SEQ ID NO: 11255 - DNA, 203 bp, Homo sapiens
ggcgcgccagtccttgagtgatatggcagggccacgccccagcccatgggccaggctgctccattgcaatgctcgtagcgtcagcctctctgggaccttggcaaaccgctgcaagaaggccccagtgaagagctgcacggagtgtgtccgtgtggataaggactgcgcctactgcacagacgagatgtcgactcggaccgatg

SEQ ID NO: 11256 - DNA, 203 bp, Homo sapiens
ggcgcgccagtcctaccatcaaatggcagggccacgccccagcccatgggccaggctgctcctggcagccttgatcagcgtcagcctctccacttgtgcctaccaccgctgcaagaaggccccagtgaagagctgcacggagtgtgtccgtgtggataaggactgcgcctactgcacagacgagatgtcgactcggaccgatg

SEQ ID NO: 11257 - DNA, 203 bp, Homo sapiens
ggcgcgccagtcctagctgcggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactggtggagatcacgaccgactcggaccgatg

SEQ ID NO: 11258 - DNA, 203 bp, Homo sapiens
ggcgcgccagtccttcccgttcatggcagggccagctatagtgatcatggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgtcgactcggaccgatg

SEQ ID NO: 11259 - DNA, 203 bp, Homo sapiens
ggcgcgccagtcctcctaaaggatggcatccaacatggtgacaatcatagattgttatcataaagcgagttggattggccatccagtgtgaatcagattaattactcccttgtttgttggatccactcccgaaacgttttactccttaacttattgaaattgtttgaagacaggatttcagtgtcacacgactcggaccgatg

SEQ ID NO: 11260 - DNA, 203 bp, Homo sapiens
ggcgcgccagtcctacggattaatggcggcgcttagttgcatgaaggcggaaactctgtgacttcgggtccgtagtggggcctgcggtgggagtgggaaggaaggcggagggaaccattacgaaacacccccattgcggcgagggtcgcctcgagagacggtttctgagttccttgaactttgtaagacgactcggaccgatg

SEQ ID NO: 11261 - DNA, 203 bp, Homo sapiens
ggcgcgccagtcctagctggatatgtatatttaagcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgcgactcggaccgatg

SEQ ID NO: 11262 - DNA, 203 bp, Homo sapiens
ggcgcgccagtcctcgatgcgcatgtggctaaccttaaccctgcagctagagcacgtaacccaatgtgtatctagttaactcacttgtcggcgggatgggaccaactactttgggtgtccgtgtttcactttttcctttatatttgcttatggtgacaatatatacaatatatatattggcaccatggcgactcggaccgatg

SEQ ID NO: 11263 - DNA, 203 bp, Homo sapiens
ggcgcgccagtcctacaagaatatgttagcttacggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgactcggaccgatg

SEQ ID NO: 11264 - DNA, 203 bp, Homo sapiens
ggcgcgccagtcctgactagggatgtttattatttttaaaaaattaggaatgttcagcaccgaatgtcaagatttaccgtatatccctgtttgtttggatacaccagtgacgtccacttctagaagacaaagttatattacttaaacaaccaaagatggagtctcgctcttcgcccaggctggagtgccgactcggaccgatg

SEQ ID NO: 11265 - DNA, 203 bp, Homo sapiens
ggcgcgccagtcctcgtcgtcgatgtttattatttttaaaaaattagggcctggattttgacaatgtcaagatttaccgtatatccctgtttgtttggatacaccagtgacgtccacttctagaagacaaagttatattacttaaacaaccaaagatggagtctcgctcttcgcccaggctggagtgccgactcggaccgatg

SEQ ID NO: 11266 - DNA, 203 bp, Homo sapiens
ggcgcgccagtcctactatgacatgtttattatttttaaaaaattagggcctggattttgacaatgtcaagatttagacgcatgtttgcattgtttggatacaccagtgacgtccacttctagaagacaaagttatattacttaaacaaccaaagatggagtctcgctcttcgcccaggctggagtgccgactcggaccgatg

SEQ ID NO: 11267 - DNA, 203 bp, Homo sapiens
ggcgcgccagtcctccttatctatgtttattatttttaaaaaattagggcctggattttgactggaatttcggaagccgtatatccctgtttgtttggatacaccagtgacgtccacttctagaagacaaagttatattacttaaacaaccaaagatggagtctcgctcttcgcccaggctggagtgccgactcggaccgatg

SEQ ID NO: 11268 - DNA, 203 bp, Homo sapiens
ggcgcgccagtcctatccgcgtattaccgactagctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagaccgactcggaccgatg

SEQ ID NO: 11269 - DNA, 203 bp, Homo sapiens
ggcgcgccagtcctcttgcgttattatcaagcgtcaataattaaactaattaagctttgtttcacttgccatatgttttgtaatagaacagtttatggccccattaaaaatgtgtaccacatttaccaatcatatatgcacatagaccctttccctaaacgagttattgatttctaaactaaacgacacgactcggaccgatg

SEQ ID NO: 11270 - DNA, 203 bp, Homo sapiens
ggcgcgccagtcctcgtcagtaattattacagagaagaaggaaactcacttcctgtcgtcgcagagcacagcctagttctgatgcagaggggactgttttcagatggagacactagtaagaagaagaaaaatgtcaccatgcgatccatcaagaccacccctactaagcgaagaacatatcagtacaacgactcggaccgatg

SEQ ID NO: 11271 - DNA, 203 bp, Homo sapiens
ggcgcgccagtcctgtatcgcgattattcttttggtaggtgtcctacatcttctattattaaacatccaatttgtgtttatgattttttgcctattattttacaaggtattttattataacattgcaacacatttgttgtttttctattatttttgttatataacgataaatctcattaaatctaaaccgactcggaccgatg

SEQ ID NO: 11272 - DNA, 203 bp, Homo sapiens
ggcgcgccagtccttttgtataattattcttttggtaggtgtcctacatcttctattattaaacatccaatttgtgtttatgattttttgcctattattttacaaggtattttattatgtttagctttactttttgttgtttttctattatttttgttattatgtcggctcggacattaaatctaaaccgactcggaccgatg

SEQ ID NO: 11273 - DNA, 203 bp, Homo sapiens
ggcgcgccagtccttcggcgtcattcagcaattgtccaatttaggaaacattctgtttaagagttgacaaggtctcaatgaataatggacaagcaacaattacaagaaatggaggaaggttcgaaatcaggtgtcgtcacttggaccgtgactacaccatgccactaccaaatgctactagtaatgatcgactcggaccgatg

SEQ ID NO: 11274 - DNA, 203 bp, Homo sapiens
ggcgcgccagtcctccttcctaattcagcaattgtccaatttaggaaacattctgtttaagagttgacaaggtctcaatgaataatggacaagcaacaattacataggtactccagctgttcgaaatcaggtgtcgtcacttggaccgtgactacaccatgccactaccaaatgctactagtaatgatcgactcggaccgatg

SEQ ID NO: 11275 - DNA, 203 bp, Homo sapiens
ggcgcgccagtcctactgtcgcattccagcccccgatgcgccctctctgggcttttgctcgctcagcacaggatctgatcaggagattcatctctggtgctttacaccagagcatggatttaaaaattgcccaaggcctggcaaacaacctaggggactaggttttctctattttaaaagatgtcaatcgactcggaccgatg

SEQ ID NO: 11276 - DNA, 203 bp, Homo sapiens
ggcgcgccagtcctcgagcccgattccagccccctccttttgaggagggggcttttgctcgctcagcacaggatctctctcaatttagtctctctggtgctttacaccagagcatggatttaaaaattgcccaaggcctggcaaacaacctaggggactaggttttctctattttaaaagatgtcaatcgactcggaccgatg

SEQ ID NO: 11277 - DNA, 203 bp, Homo sapiens
ggcgcgccagtcctgccgtcctattccagccccctccttttgaggagggggcttttgctcgctcagcacaggatctgatcaggagattcacgagcaagcgcccccaccagagcatggatttaaaaattgcccaaggcctggcaaacaacctaggggactaggttttctctattttaaaagatgtcaatcgactcggaccgatg

SEQ ID NO: 11278 - DNA, 203 bp, Homo sapiens
ggcgcgccagtccttccacgtgattccagccccctccttttgaggagggggcttttgctcgctcagcacaggatctgatcaggagattcatctctggtgctttacaccagagcatggatttaaaaattgcccaaggcctggcaaacggggcgtcttctatggttttctctattttaaaagatgtcaatcgactcggaccgatg

SEQ ID NO: 11279 - DNA, 203 bp, Homo sapiens
ggcgcgccagtcctcgtcttgcattcctagggccgcggcgcttcccggcatgctccgctgcaggcccgcgcccgcgcccggactttgccatcggcggggcagtcgcgggatgcgcccgggagccacagcctgtatgccgaaatgaaaggaggatgtgaccgggactgagtcaggagccctctggaagccgactcggaccgatg

SEQ ID NO: 11280 - DNA, 203 bp, Homo sapiens
ggcgcgccagtcctacctatgaattctgctgtttttcccatatgaagcaatccttcaacaccgacttaggttcaattttctcatcatttactgttgtaattcaatcttactaaagttattccgatatttaagcgtcggcccggcggatataatgtaacaatactattaagattatgatataggccagacgactcggaccgatg

SEQ ID NO: 11281 - DNA, 203 bp, Homo sapiens
ggcgcgccagtcctcagattagattgagaagaaaatttttggttgcgcaattcaagtgtcctatttaaaatgggacaaatagtgacattcttccaggaagtgcctcatgtaatagaagaggtgatgaacattgttctcattgcactgtctgtactagcagtgctgaaaggtctgtacaattttgcaaccgactcggaccgatg

SEQ ID NO: 11282 - DNA, 203 bp, Homo sapiens
ggcgcgccagtcctgagaccggattgcatactttgacgaaacaaattttcgttgcatacccaataaaagattattatattgcatacccgtttttaataaaatacattgcataccctctagggcgcgtcggccttgcatacgttgacgaaacaaattttcgttgcatacccaataaaagattattatatcgactcggaccgatg

SEQ ID NO: 11283 - DNA, 203 bp, Homo sapiens
ggcgcgccagtcctgtaccgttattgcatactttgacgaaacaaattttcgttgcatacccatccgtctcagggattattgcatacccgtttttaataaaatacattgcataccctcttttaataaaaaatattgcatacgttgacgaaacaaattttcgttgcatacccaataaaagattattatatcgactcggaccgatg

SEQ ID NO: 11284 - DNA, 203 bp, Homo sapiens
ggcgcgccagtccttgggctcgattgctgtccttggctctagcatgatcctagtgagcatcttcattataatcaagtctggtggacggggaacgggagcacctccagagctgagtggtgtcacaaacaatggcttcataccacacagttagttaattaaaaataaaataaaatttgggacaaatcatacgactcggaccgatg

SEQ ID NO: 11285 - DNA, 203 bp, Homo sapiens
ggcgcgccagtcctctgccgggattgggacatttgatgtaaccggaccctcgcaccgcagaaggttgtcctgtattgttacggtgtatccgtcttggcacactgaaagggtatttttgggtaatcctttcctactgcctgatagggtggcgtgcccggccacgagagattaagggtagcaatttaaaccgactcggaccgatg

SEQ ID NO: 11286 - DNA, 203 bp, Homo sapiens
ggcgcgccagtcctctgctcctattgggacatttgatgtaaccggacctggttcagtatccgcagcagatgtgccagttacggtgtatccgtcttggcacactgaaagggtatttttgggtaatcctttcctactgcctgatagggtggcgtgcccggccacgagagattaagggtagcaatttaaaccgactcggaccgatg

SEQ ID NO: 11287 - DNA, 203 bp, Homo sapiens
ggcgcgccagtccttagctctgattgggacatttgatgtaaccggacctggttcagtatccgggttgtcctgtattacgttaaatgcctggtcttggcacactgaaagggtatttttgggtaatcctttcctactgcctgatagggtggcgtgcccggccacgagagattaagggtagcaatttaaaccgactcggaccgatg

SEQ ID NO: 11288 - DNA, 203 bp, Homo sapiens
ggcgcgccagtcctaagccggtattgggacatttgatgtaaccggacctggttcagtatccgggttgtcctgtattgttacggtgtatccgtcttggcacactgaaagggtatttttgggtaatcctttcctactgcctgatagggcccgaaagtaataaacgagagattaagggtagcaatttaaaccgactcggaccgatg

SEQ ID NO: 11289 - DNA, 203 bp, Homo sapiens
ggcgcgccagtcctcttggtacattgggacatttgatgtaaccggacctggttcagtatccgggttgtcctgtattgttacggtgtatccgtcttggcacactgaaagggtatttttgggtaatcctttcctactgcctgatagggtggcgtgcccggccacgagagattaaggtagtttcagggtctcgactcggaccgatg

SEQ ID NO: 11290 - DNA, 203 bp, Homo sapiens
ggcgcgccagtcctagcgtgttattgggacatttgatgtaaccggacctggttcagtatccgggttgtcctgtattgttacggtgtatccgtcttggcacactgaaagggtatttttgggtaatcctttcctactgcctgatagggtggcgtgcccggcctaatcgctggggcagtagcaatttaaaccgactcggaccgatg

SEQ ID NO: 11291 - DNA, 203 bp, Homo sapiens
ggcgcgccagtccttggttcaaattgggacatttgatgtaaccggacctggttcagtatccgggttgtcctgtattgttacggtgtatccgtcttggcacactggcgtcactcacccaggtaatcctttcctactgcctgatagggtggcgtgcccggccacgagagattaagggtagcaatttaaaccgactcggaccgatg

SEQ ID NO: 11292 - DNA, 203 bp, Homo sapiens
ggcgcgccagtcctcataacgcattgggacattttggtgctttactggtggttcagtatccgggttgtcctgtattgttacggtgtatccgtcttggcacactgaaagggtatttttgggtaatcctttcctactgcctgatagggtggcgtgcccggccacgagagattaagggtagcaatttaaaccgactcggaccgatg

SEQ ID NO: 11293 - DNA, 203 bp, Homo sapiens
ggcgcgccagtcctgtcgcagcatttcagattaactcctccctctccgcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggacccgactcggaccgatg

SEQ ID NO: 11294 - DNA, 203 bp, Homo sapiens
ggcgcgccagtcctgcacaggaatttcatttggggatagtgtaccgttaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttcctacgactcggaccgatg

SEQ ID NO: 11295 - DNA, 203 bp, Homo sapiens
ggcgcgccagtcctggtacctaatttcatttgggttgcaacagtttggaagcaagtgctgtgtgtcctagtctaagggtttcgtgttccggacgacttgaattgtctacaaacgccttactcgaggttccgtctcgtgtttgtgtggaagcaaagttctgtctttgtggaaaccagtaactgttcctacgactcggaccgatg

SEQ ID NO: 11296 - DNA, 203 bp, Homo sapiens
ggcgcgccagtcctgtccgtcgatttcatttgggttgcaacagtttggaagcaagtgctgtgtgtcctagtctaagggtttcgtgttccgtcacgagattccatgtccttgggtttcgactcgaggttccgtctcgtgtttgtgtggaagcaaagttctgtctttgtggaaaccagtaactgttcctacgactcggaccgatg

SEQ ID NO: 11297 - DNA, 203 bp, Homo sapiens
ggcgcgccagtcctttactgtcatttcatttgggttgcaacagtttggaagcaagtgctgtgtgtcctagtctaagggtttcgtgttccgtcacgagattccattctacaaacgccttactcgaggttccgtctcgtgtttgtgtggaagcaaagttctgatcggtgtacgtgtagtaactgttcctacgactcggaccgatg

SEQ ID NO: 11298 - DNA, 203 bp, Homo sapiens
ggcgcgccagtcctatcggtatatttcatttgggttgcaacagtttggaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttcctacgactcggaccgatg

SEQ ID NO: 11299 - DNA, 203 bp, Homo sapiens
ggcgcgccagtcctgcttaacaatttcatttgggttgcaacagtttggtctgcgacaacagctgtcctagtctaagggtttcgtgttccgtcacgagattccattctacaaacgccttactcgaggttccgtctcgtgtttgtgtggaagcaaagttctgtctttgtggaaaccagtaactgttcctacgactcggaccgatg

SEQ ID NO: 11300 - DNA, 203 bp, Homo sapiens
ggcgcgccagtcctctcgtgacatttgatctttaggttataatgttagagtccgctcccggtgcttaatgcatttagtaatttaaggcttagttatttaactttacttatcaagatggccgttggcagccccacgaaatctagattagtccgaatgtcctattttgattaggtggtcagataggtcagcgactcggaccgatg

SEQ ID NO: 11301 - DNA, 203 bp, Homo sapiens
ggcgcgccagtcctgatcgccgatttggctagcacctgcctgccacagccggactccgccactccggtaggattccccgcctgtcattccctagcccagctcttgggaaactgcagaggggtccagaggatttgcagttctgaacctgcacactccagtctaggatctccgagcaagagcgtagcctccgactcggaccgatg

SEQ ID NO: 11302 - DNA, 203 bp, Homo sapiens
ggcgcgccagtccttgagcgtgatttggtggagcggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 11303 - DNA, 203 bp, Homo sapiens
ggcgcgccagtcctccacaccacaaaaattgtctaagcagcagcaggaacgcgggagcgtttcttttccttttgtactgacatgatggcgctagacgtacgccttagagtttgcgagcagactctgctggcaggtgccgttcgcatgatggacaaattcttgcaaaagagaactgtttttgtcccccacgactcggaccgatg

SEQ ID NO: 11304 - DNA, 203 bp, Homo sapiens
ggcgcgccagtcctactcgctccaaaaattgtctaagcagcagcaggaacgcgggagcgtttcttttccttttgtactgacatgatggcggcgtctaaggtgtaagttcccgcaatttagactctgctggcaggtgccgttcgcatgatggacaaattcttgcaaaagagaactgtttttgtcccccacgactcggaccgatg

SEQ ID NO: 11305 - DNA, 203 bp, Homo sapiens
ggcgcgccagtcctttaaactccaaaaattgtctaagcagcagcaggaacgcgggagcgtttcttttccttttgtactgacatgatggcggcgtctaaggtgtatagagtttgcgagcagactctgctggcaggtgccgttcgcatgatggacaaattctccacttctgccgtggtttttgtcccccacgactcggaccgatg

SEQ ID NO: 11306 - DNA, 203 bp, Homo sapiens
ggcgcgccagtcctgggaagctcaaaaattgtctaagcagcagcaggaacgcgggagcgtttcttttccttttgtactgacatgatggcggcgtctaaggtgtatagagtttgcgagcagactctgctggcaggtgccgttcgcattggcatgggcgcaatgcaaaagagaactgtttttgtcccccacgactcggaccgatg

SEQ ID NO: 11307 - DNA, 203 bp, Homo sapiens
ggcgcgccagtcctggtatagccaaaaattgtctaagcagcagcaggaacgcgggagcgtttcttttccttttgtactgacatgatggcggcgtctaaggtgtatagagtttgcgagcccgaaggtagctatggtgccgttcgcatgatggacaaattcttgcaaaagagaactgtttttgtcccccacgactcggaccgatg

SEQ ID NO: 11308 - DNA, 203 bp, Homo sapiens
ggcgcgccagtcctgatcttatcaaaaattgtctaagcagcagcaggaacgcgggagcgttttcccagtcggccccctgacatgatggcggcgtctaaggtgtatagagtttgcgagcagactctgctggcaggtgccgttcgcatgatggacaaattcttgcaaaagagaactgtttttgtcccccacgactcggaccgatg

SEQ ID NO: 11309 - DNA, 203 bp, Homo sapiens
ggcgcgccagtcctaatgtagacaaaccacgacggagtgctcctagaaaggcgcgggccgaggtaccaaaggcggcgtgtggagcgggaggagttacacgacgggggtgaaggtaagtacctacaccaaaaactgtagccagaaaaggcttgttatcctacctttagacaggtagaagattgtgggagcgactcggaccgatg

SEQ ID NO: 11310 - DNA, 203 bp, Homo sapiens
ggcgcgccagtccttagtttctcaaaccacgacggagtgctcctagaaaggcgcgggccgaggtaccaaaggcggcgtgtggagcgggagtgaaagaggcctccgggtgaaggtaagtacctacaccaaaaactgtagccagaaaaggcttgttatcctaggcgggagtctagggaagattgtgggagcgactcggaccgatg

SEQ ID NO: 11311 - DNA, 203 bp, Homo sapiens
ggcgcgccagtccttatggctgcaaaccacgacggagtgctcctagaaaggcgcgggccgaggtaccaaaggcggcgtgtggagcgggagtgaaagaggcctccgggtgaaggtaagtgagaggttatttggctgtagccagaaaaggcttgttatcctacctttagacaggtagaagattgtgggagcgactcggaccgatg

SEQ ID NO: 11312 - DNA, 203 bp, Homo sapiens
ggcgcgccagtcctttctgttgcaaaccacgacggagtgctcctagaattagagattatttagtaccaaaggcggcgtgtggagcgggagtgaaagaggcctccgggtgaaggtaagtacctacaccaaaaactgtagccagaaaaggcttgttatcctacctttagacaggtagaagattgtgggagcgactcggaccgatg

SEQ ID NO: 11313 - DNA, 203 bp, Homo sapiens
ggcgcgccagtcctaccgcacacaaaccgcaaaagacatcagtatcccacagcctctccaagtcccccggtctcctcctcttctcgaaggattgctttctagcttccaccacatccgacgacactcaattccccacccccaaaggagacaccgggaatcccagaatcaagactcatccagtgtccatccgactcggaccgatg

SEQ ID NO: 11314 - DNA, 203 bp, Homo sapiens
ggcgcgccagtcctgaggagttcaaaccgcaaaagacatcagtatcccacagcctctccaagtcccccggtctcctcctcttctcgaagggaccaaaagatcaatccaccacatccgacgacactcaattccccacccccaaaggagacaccgggaatccacctgggccctgggatccagtgtccatccgactcggaccgatg

SEQ ID NO: 11315 - DNA, 203 bp, Homo sapiens
ggcgcgccagtccttgaagagtcaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatccgactcggaccgatg

SEQ ID NO: 11316 - DNA, 203 bp, Homo sapiens
ggcgcgccagtcctcttgacagcaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcccttctaacaacgacgactcggaccgatg

SEQ ID NO: 11317 - DNA, 203 bp, Homo sapiens
ggcgcgccagtccttacgccctcaaaccgcaaaagacatcagtatcccacagcctctccaagtcccccggtctcctcctcttctcgaagggaccaaaagatcaatccaccacatccgatagaggcatcaagtccacccccaaaggagacaccgggaatcccagaatcaagactcatccagtgtccatccgactcggaccgatg

SEQ ID NO: 11318 - DNA, 203 bp, Homo sapiens
ggcgcgccagtcctgacctgaacaaaccgcaaaagacatcagtatccctagtaagaaagtgctcccccggtctcctcctcttctcgaagggaccaaaagatcaatccaccacatccgacgacactcaattccccacccccaaaggagacaccgggaatcccagaatcaagactcatccagtgtccatccgactcggaccgatg

SEQ ID NO: 11319 - DNA, 203 bp, Homo sapiens
ggcgcgccagtcctcccggaaccaaagacagaacgatgaagagtatgacaagattcgtggaagatagtctccactttttaatgcactaagcaatcggttgctaggagcccatcctgggtcagaggccgatccgcagaaccagaacgttttcccctcctggactgttagtaacttagtctccctcctcccgactcggaccgatg

SEQ ID NO: 11320 - DNA, 203 bp, Homo sapiens
ggcgcgccagtcctgcgcaacgcaaagacagaacttaacctctgcaagcaagattcgtggaaacatacaagacagatttaatgcactaagcaatcggttgctaggagcccatcctgggtcagaggccgatccgcagaaccagaacgttttcccctcctggactgttagtaacttagtctccctcctcccgactcggaccgatg

SEQ ID NO: 11321 - DNA, 203 bp, Homo sapiens
ggcgcgccagtcctcaacgaagcaaagacagaacttaacctctgcaagcaagattcgtggaagatagtctccacttcagctccacaccctcaatcggttgctaggagcccatcctgggtcagaggccgatccgcagaaccagaacgttttcccctcctggactgttagtaacttagtctccctcctcccgactcggaccgatg

SEQ ID NO: 11322 - DNA, 203 bp, Homo sapiens
ggcgcgccagtccttaggatcacaaagacagaacttaacctctgcaagcaagattcgtggaagatagtctccactttttaatgcactaagcaatcggttgctaggagcccatcctgggcagctacttaccatgcagaaccagaacgttttcccctcctggactgttagtaacttagtctccctcctcccgactcggaccgatg

SEQ ID NO: 11323 - DNA, 203 bp, Homo sapiens
ggcgcgccagtcctcgattccacaaagacagaacttaacctctgcaagcaagattcgtggaagatagtctccactttttaatgcactaaggccagttagcgggagagcccatcctgggtcagaggccgatccgcagaaccagaacgttttcccctcctggactgttagtaacttagtctccctcctcccgactcggaccgatg

SEQ ID NO: 11324 - DNA, 203 bp, Homo sapiens
ggcgcgccagtcctaacactaccaaatcgctatcgccacaaggctagtccaccgctgcctatgggcgaagtcaagccctccaacctaatctccataaacagtgtctaagacgaacctcagcgaaagaaggaagatctctagacctactggaaataacataactctggacctattggaacttatataatcgactcggaccgatg

SEQ ID NO: 11325 - DNA, 203 bp, Homo sapiens
ggcgcgccagtcctcggtcatccaaatcgctatcgccacaaggctagtgataataactaagggggcgaagtcaagccctccaacctaatcaagcacgctgaaacctaagacgaacctcagcgaaagaaggaagatctctagacctactggaaataacataactctggacctattggaacttatataatcgactcggaccgatg

SEQ ID NO: 11326 - DNA, 203 bp, Homo sapiens
ggcgcgccagtcctcgtgcagtcaaatcgctatcgccacaaggctagtgataataactaagggggcgaagtcaagccctccaacctaatctccataaacagtgtctaagacgaacctcagcgaaagaaggaagatctctagacctaggattccgtcatgtactctggacctattggaacttatataatcgactcggaccgatg

SEQ ID NO: 11327 - DNA, 203 bp, Homo sapiens
ggcgcgccagtccttcacccgccaacacccgagcaaggacgcgactctcccgacgcggggaggctattctgcccatttggggacacttccgtaagtgatgagatacccgcttctctgaaaggctctccttgcagctgcttagacgctggatttttttcgggtagtggaaaaccagcagcctcccgcgacgactcggaccgatg

SEQ ID NO: 11328 - DNA, 203 bp, Homo sapiens
ggcgcgccagtcctcataaatacaacacccgagcaaggacgcgactctggatggcaaactccgctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 11329 - DNA, 203 bp, Homo sapiens
ggcgcgccagtcctgagctagtcaacacccgagcgccacaagcgtatccccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 11330 - DNA, 203 bp, Homo sapiens
ggcgcgccagtcctacattattcaaccaccttagatgaactttcagtagactcatgacgctcgcgtgatgacaagcgccaagcttgacttggatggccctgatgggcgttcatgggttcggtggtggtggcgctttaggcagcctccacgcccaccacctcccagatagagcggcggcactgtagggacgactcggaccgatg

SEQ ID NO: 11331 - DNA, 203 bp, Homo sapiens
ggcgcgccagtcctgaacgagccaaccaccttagtatgtaggcggcgggactcatgacgctcgcgtgatgacaagcgccaagcttgacttggatggccctgatgggcgttcatgggttcggtggtggtggcgctttaggcagcctccacgcccaccacctcccagatagagcggcggcactgtagggacgactcggaccgatg

SEQ ID NO: 11332 - DNA, 203 bp, Homo sapiens
ggcgcgccagtcctaatacccgcaaccaccttagtatgtaggcggcgggactcatgacgctcgcgtgatgacaagcgccaagcttgacttggatggccctgatgtctaaggcacatcccggtggtggtggcgctttaggcagcctccacgcccaccacctcccagatagagcggcggcactgtagggacgactcggaccgatg

SEQ ID NO: 11333 - DNA, 203 bp, Homo sapiens
ggcgcgccagtccttgacgggccaaccagatcaaagaaaaaacagacagcgtcaatggcagagcaaaaatgtaacacctctacaatggatgccgacaagattgtattcaaagtcaataatcaggtggtctctttgaagcctgagattatcgtggatcaatcgcgtcgatgaatacctgccatcaaagacgactcggaccgatg

SEQ ID NO: 11334 - DNA, 203 bp, Homo sapiens
ggcgcgccagtcctatcttagccaaccagcagagagggattgagcttcattgaactcaacagagccaacatttcatagcaccatgttcaactttgaacatccaaggcatggcaatggttagagaccctgctgggcgtgaacaccctctggctacctagggacctgtgggcctaccacctggtgccctccgactcggaccgatg

SEQ ID NO: 11335 - DNA, 203 bp, Homo sapiens
ggcgcgccagtccttggactgacaaccagcagagagggattgagcttcattgaactcaacagagccaacatttcatagcaccatgttcaagaggaggttgaagtggcatggcaatggttagagaccctgctgcctcactgggggtcctggctacctagggacctgtgggcctaccacctggtgccctccgactcggaccgatg

SEQ ID NO: 11336 - DNA, 203 bp, Homo sapiens
ggcgcgccagtcctgcaaggttcaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctacattacaacagtactcgactcggaccgatg

SEQ ID NO: 11337 - DNA, 203 bp, Homo sapiens
ggcgcgccagtccttctaacgacaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctccgactcggaccgatg

SEQ ID NO: 11338 - DNA, 203 bp, Homo sapiens
ggcgcgccagtcctgcagattccaaccagcagagagggattgagcttcattgaactcaacagagccaacatttcatagcaccatgttcaagaggaggttgaagtggcatggcaatggttagagaccctgctgggcgtgaacacccttgattggagcgataacctgtgggcctaccacctggtgccctccgactcggaccgatg

SEQ ID NO: 11339 - DNA, 203 bp, Homo sapiens
ggcgcgccagtcctggctttcacaaccagcagagagggattgagcttcattgaactcaacagagccaacatttcatgaacgtgctaaagggaggaggttgaagtggcatggcaatggttagagaccctgctgggcgtgaacaccctctggctacctagggacctgtgggcctaccacctggtgccctccgactcggaccgatg

SEQ ID NO: 11340 - DNA, 203 bp, Homo sapiens
ggcgcgccagtcctgctctatacaaccagcagagagggattgagcttcccccctgaatctgcagccaacatttcatagcaccatgttcaagaggaggttgaagtggcatggcaatggttagagaccctgctgggcgtgaacaccctctggctacctagggacctgtgggcctaccacctggtgccctccgactcggaccgatg

SEQ ID NO: 11341 - DNA, 203 bp, Homo sapiens
ggcgcgccagtcctggcggtgtcaaccagcagagccaccagtcctgaaattgaactcaacagagccaacatttcatagcaccatgttcaagaggaggttgaagtggcatggcaatggttagagaccctgctgggcgtgaacaccctctggctacctagggacctgtgggcctaccacctggtgccctccgactcggaccgatg

SEQ ID NO: 11342 - DNA, 203 bp, Homo sapiens
ggcgcgccagtcctggacccatcaacggccacctcttccaagccaagcgctttaacaggagacgtcgaacttcgttgtgcagcgagaggatatggggcctcgcgaggcaaggctacaggtgcatcaactgcaaactgctggtccataagcgctgccacggcctcgtcccgctgacctgcaggaagcatcgactcggaccgatg

SEQ ID NO: 11343 - DNA, 203 bp, Homo sapiens
ggcgcgccagtcctcacgtagccaacggccacctcttccaagccaagcgctttaacaggagagcgtactgcggtcacgtggaacccccagtatggggcctcgcgaggcaaggctacaggtgcatcaactgcaaactgctggtccataagcgctgccacggcctcgtcccgctgacctgcaggaagcatcgactcggaccgatg

SEQ ID NO: 11344 - DNA, 203 bp, Homo sapiens
ggcgcgccagtcctgaccactccaacggccacctcttccaagccaagcgctttaacaggagagcgtactgcggtcagtgcagcgagaggaaccctcctagtaataggcaaggctacaggtgcatcaactgcaaactgctggtccataagcgctgccacggcctcgtcccgctgacctgcaggaagcatcgactcggaccgatg

SEQ ID NO: 11345 - DNA, 203 bp, Homo sapiens
ggcgcgccagtcctgtcattctcaacggccacctcttccaagccaagcgctttaacaggagagcgtactgcggtcagtgcagcgagaggatatggggcctcgcgaggcaaggctacagcacacggccactggaactgctggtccataagcgctgccacggcctcgtcccgctgacctgcaggaagcatcgactcggaccgatg

SEQ ID NO: 11346 - DNA, 203 bp, Homo sapiens
ggcgcgccagtcctctgcaatacaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatcgactcggaccgatg

SEQ ID NO: 11347 - DNA, 203 bp, Homo sapiens
ggcgcgccagtcctcggatcgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggtgatacgggagactcctgcaggaagcatcgactcggaccgatg

SEQ ID NO: 11348 - DNA, 203 bp, Homo sapiens
ggcgcgccagtccttgcaggaccaacggccacctcttccaagccaagcttaccgggcacgccgcgtactgcggtcagtgcagcgagaggatatggggcctcgcgaggcaaggctacaggtgcatcaactgcaaactgctggtccataagcgctgccacggcctcgtcccgctgacctgcaggaagcatcgactcggaccgatg

SEQ ID NO: 11349 - DNA, 203 bp, Homo sapiens
ggcgcgccagtcctcaatgggtcaactgctgctcctatgtacagaatacccgctcctttgggggctacctgtactacccaggctcctaccccagcagcctggtctacagcactgccctctgctctcccagcacctgccagctgcgttcctctctctacagggactgtcagaagacctgctgggagccccgactcggaccgatg

SEQ ID NO: 11350 - DNA, 203 bp, Homo sapiens
ggcgcgccagtcctatccttcccaactgctgctctagaaacttcagaggtagctcctttgggggctacctggctgcagcaggctcctaccccagcagcctggtctacagcactgccctctgctctcccagcacctgccagctgcgttcctctctctacagggactgtcagaagacctgctgggagccccgactcggaccgatg

SEQ ID NO: 11351 - DNA, 203 bp, Homo sapiens
ggcgcgccagtcctgattcgcccaactgctgctctagaaacttcagaggtagctcctttgggggctacctgtactacccaggctcctaccccagcagcctggtctacagcactgccctctgctctcccagcacctgccagctgcgttcctctctctacagggactgtcagaagacctgctgggagccccgactcggaccgatg

SEQ ID NO: 11352 - DNA, 203 bp, Homo sapiens
ggcgcgccagtcctggatgggacaactgctgctctagaaacttctcctcccgctcctttgggggctacctggctgcagcaggctcctaccccagcagcctggtctacagcactgccctctgctctcccagcacctgccagctgcgttcctctctctacagggactgtcagaagacctgctgggagccccgactcggaccgatg

SEQ ID NO: 11353 - DNA, 203 bp, Homo sapiens
ggcgcgccagtcctatccactacaactgctgctctagaaacttctcctcccgctcctttgggggctacctgtactacccaggctcctaccccagcagcctggtctacagcactgccctagcggtaatatcgtcctgccagctgcgttcctctctctacagggactgtcagaagacctgctgggagccccgactcggaccgatg

SEQ ID NO: 11354 - DNA, 203 bp, Homo sapiens
ggcgcgccagtcctaccaactgcaactgctgctctagaaacttctcctcccgctcctttgggggctacctgtactacccaggctcctaccccagcagcctggtctacagcactgccctctgctctcccagcacctgccagctgcgttcctctctctacagaagaccggtacttccctgctgggagccccgactcggaccgatg

SEQ ID NO: 11355 - DNA, 203 bp, Homo sapiens
ggcgcgccagtcctagccagcacaactgctgctctagaaacttctcctcccgctcctttgggggctacctgtactacccaggctcctaccccagcagcctggtctacagcactgccctctgctctcccagcacctgccagctgcgttcctctctctacagggactgtcagaagatactgctatccttacgactcggaccgatg

SEQ ID NO: 11356 - DNA, 203 bp, Homo sapiens
ggcgcgccagtcctaggtaactcaactgctgctctagaaacttctcctcccgctcctttgggggctacctgtactacccaggctcctaccccagcagcctggtctacagcactgccctctgctctcccagcagtatatccgcagagtcctctctctacagggactgtcagaagacctgctgggagccccgactcggaccgatg

SEQ ID NO: 11357 - DNA, 203 bp, Homo sapiens
ggcgcgccagtcctaatcacttcaactgctgctctagaaacttctcctcccgctcctttgggttgccatcagcgctcccaggctcctaccccagcagcctggtctacagcactgccctctgctctcccagcacctgccagctgcgttcctctctctacagggactgtcagaagacctgctgggagccccgactcggaccgatg

SEQ ID NO: 11358 - DNA, 203 bp, Homo sapiens
ggcgcgccagtccttaagggttcaactgctgctgtggaaacttcggaatggattcctgtgagggctacctgtgctactcaggcactggaagtggtggctcctcgtaccccagcaacctggtctacagcactgaacctttgatctcccagcacctgccagctgggttcctctctctgcaagggctttcacgactcggaccgatg

SEQ ID NO: 11359 - DNA, 203 bp, Homo sapiens
ggcgcgccagtcctacaagcgccaactgctgctgtggaaacttcggaatggattcctgtgagggctacctgtgctactcaggctactcccgtggtggctcctcgtaccccagcaacctggtctacagcactgaacctttgatctcccagcacctgccagctgggttcctctctctgcaagggctttcacgactcggaccgatg

SEQ ID NO: 11360 - DNA, 203 bp, Homo sapiens
ggcgcgccagtcctttaccacacaactgctgctgtggaaacttctcctcccattcctgtgagactgcagccctggtctcaggctactcccgtggtggctcctcgtaccccagcaacctggtctacagcactgaacctttgatctcccagcacctgccagctgggttcctctctctgcaagggctttcacgactcggaccgatg

SEQ ID NO: 11361 - DNA, 203 bp, Homo sapiens
ggcgcgccagtcctttgtcctgcaactgctgctgtggaaacttctcctcccattcctgtgagggctacctgtgctactcaggcactggaagtggtggctcctcgtaccccagcaacctggtctacagcactgaacctttgatctcccagcacctgccagctgggttcctctctctgcaagggctttcacgactcggaccgatg

SEQ ID NO: 11362 - DNA, 203 bp, Homo sapiens
ggcgcgccagtccttctctgagcaactgctgctgtggaaacttctcctcccattcctgtgagggctacctgtgctactcaggctactcccgtggtggctcctcgagaatttaggtggcggtctacagcactgaacctttgatctcccagcacctgccagctgggttcctctctctgcaagggctttcacgactcggaccgatg

SEQ ID NO: 11363 - DNA, 203 bp, Homo sapiens
ggcgcgccagtcctcttactagcaactgctgctgtggaaacttctcctcccattcctgtgagggctacctgtgctactcaggctactcccgtggtggctcctcgtaccccagcaacctggtctacagcactgaacctttgatctcccagcacctgccagctgggttcctctctccttgttcttggatccgactcggaccgatg

SEQ ID NO: 11364 - DNA, 203 bp, Homo sapiens
ggcgcgccagtcctagttcctccaactgctgctgtggaaacttctcctcccattcctgtgagggctacctgtgctactcaggctactcccgtggtggctcctcgtaccccagcaacctggtctacagcactgaacctttgatctcccagcacctgccagctgggttcctctctctgcaagggctttcacgactcggaccgatg

SEQ ID NO: 11365 - DNA, 203 bp, Homo sapiens
ggcgcgccagtcctcctggacacaactgctgctgtggaaacttctcctcccattcctgtgagggctacctgtgctactcaggctactcccgtggtggctcctcgtaccccagcaacctggtctacagcactgaacctttgatctcctttactggaaagcatgggttcctctctctgcaagggctttcacgactcggaccgatg

SEQ ID NO: 11366 - DNA, 203 bp, Homo sapiens
ggcgcgccagtcctaactgattcaactgctgctgtggaaacttctcctcccattcctgtgagggctacctgtgctactcaggctactcccgtggtggctcctcgtaccccagcaaccttacgactgaggactaacctttgatctcccagcacctgccagctgggttcctctctctgcaagggctttcacgactcggaccgatg

SEQ ID NO: 11367 - DNA, 203 bp, Homo sapiens
ggcgcgccagtcctttacctaccaactgctgctgtggaaacttctcctcccattcctgtgagggctacctgtgctactcaggctactccctcacctttcgaggataccccagcaacctggtctacagcactgaacctttgatctcccagcacctgccagctgggttcctctctctgcaagggctttcacgactcggaccgatg

SEQ ID NO: 11368 - DNA, 203 bp, Homo sapiens
ggcgcgccagtcctcaggtacacaagagacggcccaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttcgactcggaccgatg

SEQ ID NO: 11369 - DNA, 203 bp, Homo sapiens
ggcgcgccagtcctctatacaacaagcggcttctaacaggttggaataccgtcgcagatgacaacaccgtccacttcaattccaccctcatggctctgatccgcacagccctggacatcaagattgccaagggaggagccgacaaacagcagatggacgctgagctgcggaaggagatgatggcgattcgactcggaccgatg

SEQ ID NO: 11370 - DNA, 203 bp, Homo sapiens
ggcgcgccagtcctcccatttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgattcgactcggaccgatg

SEQ ID NO: 11371 - DNA, 203 bp, Homo sapiens
ggcgcgccagtcctataatatccaagcggcttctgcggatggacctgcccgtcgcagatgacaacaccgtccacttcaattccaccctcatggctctgatccgcacagccctggacatgcctgcgaatccatgaggagccgacaaacagcagatggacgctgagctgcggaaggagatgatggcgattcgactcggaccgatg

SEQ ID NO: 11372 - DNA, 203 bp, Homo sapiens
ggcgcgccagtcctgggccggccaagcggcttctgcggatggacctgcccgtcgcagatgacaacaccgtccacttcaattccaccctcatggctctgatccgccgttaatactgatacaagattgccaagggaggagccgacaaacagcagatggacgctgagctgcggaaggagatgatggcgattcgactcggaccgatg

SEQ ID NO: 11373 - DNA, 203 bp, Homo sapiens
ggcgcgccagtccttttacgaccaagtacgtaatgacgacagacgttcaactggatgattccctactgcgagaatgaagactattctcagcaatcagactgtcgacattccagaaaatgtcgacattactctgaagggacgcacagttatcgtgaagggccccagaggaaccctgcggagggacttcacgactcggaccgatg

SEQ ID NO: 11374 - DNA, 203 bp, Homo sapiens
ggcgcgccagtcctccgccatgcaagttcagatcaggcaaggaacaaaaaaatctgagtgccacaagaccaaagaagagtacacttaagttgaagacacaacacttgatctgaaacaagaagtttgtgcctactcaacagctttgaaagagcacttcccaacgctgctagtagtctttgttttcttcacgactcggaccgatg

SEQ ID NO: 11375 - DNA, 203 bp, Homo sapiens
ggcgcgccagtcctcccaggcccaagttcagatcaggcaaggaacaaacctcgtaacaactaacaagaccaaagaagagtacacttaagttgaagacacaacacagatgtgtggtgtggaagtttgtgcctactcaacagctttgaaagagcacttcccaacgctgctagtagtctttgttttcttcacgactcggaccgatg

SEQ ID NO: 11376 - DNA, 203 bp, Homo sapiens
ggcgcgccagtcctggtgatatcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccagacagagacaagtgctttgttttcttcacgactcggaccgatg

SEQ ID NO: 11377 - DNA, 203 bp, Homo sapiens
ggcgcgccagtcctgcacgatgcaagttcctggtgcaaaggtggctctgcagcataatttaggcattggaggagctgtggttgtaacactctacaagatgggttttccggaagccgccagttcttttagaaccaggagtgcgattactgttccaaccagctctgcaagtgatggatttaaggcaaatccgactcggaccgatg

SEQ ID NO: 11378 - DNA, 203 bp, Homo sapiens
ggcgcgccagtcctatcccgtgcaagttcctggtgcaaaggtggctctgcagcataatttaggcattggaggagctgtggttgtaacactctacaagatgggttttccggaagccgccagttcttttagaactcatcaaattgaagctgttccaaccagccacttggtcatcatatttaaggcaaatccgactcggaccgatg

SEQ ID NO: 11379 - DNA, 203 bp, Homo sapiens
ggcgcgccagtcctcatatcttcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggccacttctaggggtcgactcggaccgatg

SEQ ID NO: 11380 - DNA, 203 bp, Homo sapiens
ggcgcgccagtcctatgttccacaagttcctggtgcaaaggtggctctgcagcataatttaggcattggaggagctgtggttgtaacactctacaagatgggttttccggaagccgccttcgtgcacctttttcatcaaattgaagctgttccaaccagctctgcaagtgatggatttaaggcaaatccgactcggaccgatg

SEQ ID NO: 11381 - DNA, 203 bp, Homo sapiens
ggcgcgccagtcctaccacatccaagttcctggtgcaaaggtggctctgcagcataatttaggcattggaggagcttgaccccattgcagctacaagatgggttttccggaagccgccagttcttttagaactcatcaaattgaagctgttccaaccagctctgcaagtgatggatttaaggcaaatccgactcggaccgatg

SEQ ID NO: 11382 - DNA, 203 bp, Homo sapiens
ggcgcgccagtcctaatgctatcaagttcctggtgcaaaggtggctcttttcgtcctaaactgcattggaggagctgtggttgtaacactctacaagatgggttttccggaagccgccagttcttttagaactcatcaaattgaagctgttccaaccagctctgcaagtgatggatttaaggcaaatccgactcggaccgatg

SEQ ID NO: 11383 - DNA, 203 bp, Homo sapiens
ggcgcgccagtcctcgtttgttcaagttcctggttacggccctagctcgcagcataatttaggcattggaggagctgtggttgtaacactctacaagatgggttttccggaagccgccagttcttttagaactcatcaaattgaagctgttccaaccagctctgcaagtgatggatttaaggcaaatccgactcggaccgatg

SEQ ID NO: 11384 - DNA, 203 bp, Homo sapiens
ggcgcgccagtcctctcttctacaataagtctgcttccaccttccagcttactggcttcccactgcctagttcataacatcactggatattcatcccattattggcagcctacatctccatacttcttggcaatggcactcttctctttctcatcaggaatgatcataacctccatgagcccatgtaccgactcggaccgatg

SEQ ID NO: 11385 - DNA, 203 bp, Homo sapiens
ggcgcgccagtcctagacaatacaataagtctgcttccaccttccagcttactggcttcccaggcatggagaaggcacatcactggatatcgcgtgacaagcgagcagcctacatctccatacttcttggcaatggcactcttctctttctcatcaggaatgatcataacctccatgagcccatgtaccgactcggaccgatg

SEQ ID NO: 11386 - DNA, 203 bp, Homo sapiens
ggcgcgccagtcctccacttggcaataagtctgcttccaccttccagcttactggcttcccaggcatggagaaggcacatcactggatattcatcccattattggcagcctacatctccatacttcttggcaatggcactcttctctttctcatcaggaatgatcataacctccatgagcccatgtaccgactcggaccgatg

SEQ ID NO: 11387 - DNA, 203 bp, Homo sapiens
ggcgcgccagtcctgagcattgcaataagtctgcttccaccttccagcttactggcttcccaggcatggagaaggcacatcactggatattcatcccattattggcagcctacatctccatacttcttggcataactgaaacctcgtttctcatcaggaatgatcataacctccatgagcccatgtaccgactcggaccgatg

SEQ ID NO: 11388 - DNA, 203 bp, Homo sapiens
ggcgcgccagtcctacgtcgctcaatcaagaaaccaaaagacaactcacaatctccctaaaacagcaacgacaccatgtcagctttgctcaaatctctctgggagaaacttttgcccaatggtctcttgatacacaaccatctcaagaaaagaaactgggcaaaacagcatccaagagacaaatagcacgactcggaccgatg

SEQ ID NO: 11389 - DNA, 203 bp, Homo sapiens
ggcgcgccagtcctcctagtgacaatcaagaaaccaaaagacaactcacaatctccctaaaacagcaacgacaccatgtcagctttgctcctggaatgtgccacgaaacttttgcccacatactaacaacatcacaaccatctcaagaaaagaaactgggcaaaacagcatccaagagacaaatagcacgactcggaccgatg

SEQ ID NO: 11390 - DNA, 203 bp, Homo sapiens
ggcgcgccagtcctgctgaagtcaatcgggtgtcaattttggatctccccccccccacccccctttggatcttgtcgggctttccacgttagcaccggtgtttcttcttgtaacgtccaaggcaagctccccacgacccgaacacgcccagaggaaccttggggcctctggggacttggctagcaggtcgactcggaccgatg

SEQ ID NO: 11391 - DNA, 203 bp, Homo sapiens
ggcgcgccagtccttaaacgcgcaatcgggtgtcaattttggatctccccccccccacccccctttggatcttgtcgggctttccacgtttcacttaaaaaaaattcttgtaacgtccaaggcaagctccccacgacccgaacacgagttccccgtagcgggggcctctggggacttggctagcaggtcgactcggaccgatg

SEQ ID NO: 11392 - DNA, 203 bp, Homo sapiens
ggcgcgccagtcctgccaagatcaatcgggtgtcaattttggatctccccccccccacccccctttggatcttgtcgggctttccacgtttcacttaaaaaaaattcttgtaacgtcctttcgcttggtttgacgacccgaacacgcccagaggaaccttggggcctctggggacttggctagcaggtcgactcggaccgatg

SEQ ID NO: 11393 - DNA, 203 bp, Homo sapiens
ggcgcgccagtcctacccaagtcaatcgggtgtctccgaactcatatgccccccccacccccctttggatcttgtcgggctttccacgtttcacttaaaaaaaattcttgtaacgtccaaggcaagctccccacgacccgaacacgcccagaggaaccttggggcctctggggacttggctagcaggtcgactcggaccgatg

SEQ ID NO: 11394 - DNA, 203 bp, Homo sapiens
ggcgcgccagtccttatgtactcaatgagcgcgcctgctaaaaactcgcggctggtgcgcgagacgccgccgagaggggcactatggcagacaaagttaggaggcagaggccgaggaggcgagtctgttgggccttggtggctgtgctcttggcagacctgttggcactgagtgatacactggcagtgcgactcggaccgatg

SEQ ID NO: 11395 - DNA, 203 bp, Homo sapiens
ggcgcgccagtcctacgggaaacaatgagcgcgcgccgcgtccggggccggctggtgcgcgagacgccgccgagaggggcactatggcagacaaagttaggaggggttatttagaccagcgagtctgttgggccttggtggctgtgctcttggcagacctgttggcactgagtgatacactggcagtgcgactcggaccgatg

SEQ ID NO: 11396 - DNA, 203 bp, Homo sapiens
ggcgcgccagtcctagtagttccaatgcaggcattagtttctcagttaaaaaacaaggagagacagtagctgatgttaggacactacccaatgcctcaaccgtgcggctctgcgtaagcatctttggaaatgctgttagtcgagaactgatagaaattggatgtgaggataaaaccctagccttcaaacgactcggaccgatg

SEQ ID NO: 11397 - DNA, 203 bp, Homo sapiens
ggcgcgccagtcctgttacaatcaatgcaggcattagtttctcagttaaaaaacaaggagagacagtagctgatgttaggacactacccaatgcctcaaccgtggacaatattcgctccatctttggaaatgaaagggcagagcgtctgatagaaattggatgtgaggataaaaccctagccttcaaacgactcggaccgatg

SEQ ID NO: 11398 - DNA, 203 bp, Homo sapiens
ggcgcgccagtcctgggcatcacaatgcaggcattagtttctcagttaaaaaacaaggagagacagtagctgatgttaggacactacccaatgcctcaaccgtggacaatattcgctctggaagcaattcatctgttagtcgagaactgatagaaattggatgtgaggataaaaccctagccttcaaacgactcggaccgatg

SEQ ID NO: 11399 - DNA, 203 bp, Homo sapiens
ggcgcgccagtccttaccgcagcaatgcaggcattagtttctcagttaaaaaacaaggagagacagtagctgatgttaggacactacccatccttcgctattaagacaatattcgctccatctttggaaatgctgttagtcgagaactgatagaaattggatgtgaggataaaaccctagccttcaaacgactcggaccgatg

SEQ ID NO: 11400 - DNA, 203 bp, Homo sapiens
ggcgcgccagtcctgcgacagccaatgcaggcattagtttctcagttaaaaaacaaggagagcattagaaaatgtctaggacactacccaatgcctcaaccgtggacaatattcgctccatctttggaaatgctgttagtcgagaactgatagaaattggatgtgaggataaaaccctagccttcaaacgactcggaccgatg

SEQ ID NO: 11401 - DNA, 203 bp, Homo sapiens
ggcgcgccagtcctttgacgcacacactaatattatccagattagagagcttaattagctctgtattaataataacactactattccaataactggaatcaccaagagttcgacatggcaaaatgattcaaagaaaacaaatcatattaagactatcctaagcacgaacccatatcgtccttcaaatccgactcggaccgatg

SEQ ID NO: 11402 - DNA, 203 bp, Homo sapiens
ggcgcgccagtccttgcaccggcacactaatattatccagattagagagcttaattagctctgtattaataataacactactattccaataactggaatcaccagcttgatttatctccaaaatgattcaaagaaaacaaatcataagggtggaggagagagcacgaacccatatcgtccttcaaatccgactcggaccgatg

SEQ ID NO: 11403 - DNA, 203 bp, Homo sapiens
ggcgcgccagtcctggttagtccacactaatattatccagattagagagcttaattagctctgtattaataataacactactattccaataactggaatcaccagcttgatttatctccaaaatgattcaaatcgcctgggctcgcttaagactatcctaagcacgaacccatatcgtccttcaaatccgactcggaccgatg

SEQ ID NO: 11404 - DNA, 203 bp, Homo sapiens
ggcgcgccagtcctgatgccagcacagatcagctcaaccagacaccaccagcatacacgaaaccaaccttcacagtggatacctcagcatccaaaactctccttcccgaatggatcaggatgccttcttttttgagagggatcctgaagccgaaggagaggcaccacgaaaacaagaatcactctcagcgactcggaccgatg

SEQ ID NO: 11405 - DNA, 203 bp, Homo sapiens
ggcgcgccagtcctggattatccacagatcagctcaaccagacaccaccagcatacacgaaaccaaccttcacagtggatacctcagcatccaaaactctccttcccgaatggatcaggatgccttcttttttgagagggatcctgaagccgaaggagagtataggacccggagagaatcactctcagcgactcggaccgatg

SEQ ID NO: 11406 - DNA, 203 bp, Homo sapiens
ggcgcgccagtcctgataatcacacatctctctggccacgtggacgagggcatgcccaaagcacatcttaacctgagcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11407 - DNA, 203 bp, Homo sapiens
ggcgcgccagtcctcggttaatcacccgccatagcaatggagaccccgaaaggacaatgcaataattaatccttcttttttgcttcacaataaaaatagcatggctcttctgattgtaaaaagtgatatacactccttatttaacgaaaaattcaaagaatttgataaatgacaggcgaaaagtcaaacgactcggaccgatg

SEQ ID NO: 11408 - DNA, 203 bp, Homo sapiens
ggcgcgccagtcctggaagtctcacccgccatagcaatggagaccccgcctcctgctacagttaattaatccttcttttttgcttcacaataaaaatagcatggctcttctgattgtaaaaagtgatatacactccttatttaacgaaaaattcaaagaaggctggtgtctcatggcgaaaagtcaaacgactcggaccgatg

SEQ ID NO: 11409 - DNA, 203 bp, Homo sapiens
ggcgcgccagtcctggtccgtgcacccgccatagttgcctcccggtaccctcctgctacagttaattaatccttcttttttgcttcacaataaaaatagcatggctcttctgattgtaaaaagtgatatacactccttatttaacgaaaaattcaaagaatttgataaatgacaggcgaaaagtcaaacgactcggaccgatg

SEQ ID NO: 11410 - DNA, 203 bp, Homo sapiens
ggcgcgccagtcctcggagacccaccgaggatgctctgaatgatatcaagcgagacatcataagaagcgccatatgaactcaccaggaacaccagactcacgggcccgatgcgtgggagaaagccacaatgattccctgtttaataaaaaataagcacgaacacaagtccaatccaaccatagcagcacgactcggaccgatg

SEQ ID NO: 11411 - DNA, 203 bp, Homo sapiens
ggcgcgccagtcctggacaacccaccgggccggttggggccccgctcgccggcgggagccaccggagccccggccaacccatttgtaacacccccgccggccccgccctcccggctgcggcctggccaatcagagcggctcttactggcgggtgggctgagccggcccagctgctcggaggctctggccgactcggaccgatg

SEQ ID NO: 11412 - DNA, 203 bp, Homo sapiens
ggcgcgccagtcctaggaacggcaccgggccggttggggccccgctcgttacgtctggccaccggagccccggccacgaaggggtgcgaccccccgccggccccgccctcccggctgcggcctggccaatcagagcggctcttagaactaccagggctgagccggcccagctgctcggaggctctggccgactcggaccgatg

SEQ ID NO: 11413 - DNA, 203 bp, Homo sapiens
ggcgcgccagtcctagcaatatcacgccttcatgtaaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtccgactcggaccgatg

SEQ ID NO: 11414 - DNA, 203 bp, Homo sapiens
ggcgcgccagtcctatcgggtccacgcgagccgttggtggttgttgtgatgattatactggataccaggagttagtaatcaaaacttcacatgacgactaagttcgtctttgattcattgcactgatctcttgttagatctttttgcaatctagcatttgttaaagttcttaaggccacgccctattacgactcggaccgatg

SEQ ID NO: 11415 - DNA, 203 bp, Homo sapiens
ggcgcgccagtcctcacaagaccacgttggttagtccatcttcccggggccgcgccgcgcgcgcgcgcgggctttgggcgggaccctgcagaggcggcggggctcctcctcccgctcctcctcggcctccccttcgggcgctctcgcgctaactgtgctcctccggggccctccgcctgctcccagcccgactcggaccgatg

SEQ ID NO: 11416 - DNA, 203 bp, Homo sapiens
ggcgcgccagtcctcctggcgtcactggtgacagcggcgtacaataaatcaggtaccccgaggtaacacgcgacactcgggatctgagaaggggactggggcttctataaaagcgctcggtttaaaaagcttctatgcctgaataggtgaccggaggtcggcacctttcctttacaattaatgaccctcgactcggaccgatg

SEQ ID NO: 11417 - DNA, 203 bp, Homo sapiens
ggcgcgccagtcctcattaggacactggtgacaggctaaggatgccctgactacgaggttttgtaacacgcgacactcgggatctgagaaggggactggggcttctataaaagcgctcggtttaaaaagcttctatgcctgaataggtgaccggaggtcggcacctttcctttacaattaatgaccctcgactcggaccgatg

SEQ ID NO: 11418 - DNA, 203 bp, Homo sapiens
ggcgcgccagtcctgttgtaaccactggtgacaggctaaggatgcccttcaggtaccccgaggtaacacgcgacactcgggatctgagaaggggactggggcttctataaaagcgctcccggattgccctgactatgcctgaataggtgaccggaggtcggcacctttcctttacaattaatgaccctcgactcggaccgatg

SEQ ID NO: 11419 - DNA, 203 bp, Homo sapiens
ggcgcgccagtcctgcgcatgccactggtgacaggctaaggatgcccttcaggtaccccgaggtaacacgcgacactcgggatctgagaaggggactggggcttctataaaagcgctcggtttaaaaagcttaagctgagtctactgtgaccggaggtcggcacctttcctttacaattaatgaccctcgactcggaccgatg

SEQ ID NO: 11420 - DNA, 203 bp, Homo sapiens
ggcgcgccagtcctcctgggtccactggtgacaggctaaggatgcccttcaggtaccccgaggtaacacgcgacactcgggatctgagaaggggactggggcttctataaaagcgctcggtttaaaaagcttctatgcctgaatagacctatcttctaatgcacctttcctttacaattaatgaccctcgactcggaccgatg

SEQ ID NO: 11421 - DNA, 203 bp, Homo sapiens
ggcgcgccagtcctatggtgagcactggtgacaggctaaggatgcccttcaggtaccccgaggtaacacgcgacactcgggatctgagaaggggactggggcttctataaaagcgctcggtttaaaaagcttctatgcctgaatagcgacttattctcacgcacctttcctttacaattaatgaccctcgactcggaccgatg

SEQ ID NO: 11422 - DNA, 203 bp, Homo sapiens
ggcgcgccagtcctgggctccccactggtgacaggctaaggatgcccttcaggtaccccgaggtaacacgcgacactcgggatctgagaaggggactggggcttctataaaagcgctcggtttaaaaagcttctatgcctgaataggtgaccggaggtcgcgcttaaagagagtcaattaatgaccctcgactcggaccgatg

SEQ ID NO: 11423 - DNA, 203 bp, Homo sapiens
ggcgcgccagtcctctcccaaacactggtgacaggctaaggatgcccttcaggtaccccgaggtaacacgcgacactcgggatctgagaaggggactggggcttctataaaagcgctcggtttaaaaagcttctatgcctgaataggtgaccggaggtcgtacgggcgggggcccaattaatgaccctcgactcggaccgatg

SEQ ID NO: 11424 - DNA, 203 bp, Homo sapiens
ggcgcgccagtcctgtgtttagcactggtgacaggctaaggatgcccttcaggtaccccgaggtaacacgcgacactcgggatctgagaaggggactggggcttgacacgccataggaggtttaaaaagcttctatgcctgaataggtgaccggaggtcggcacctttcctttacaattaatgaccctcgactcggaccgatg

SEQ ID NO: 11425 - DNA, 203 bp, Homo sapiens
ggcgcgccagtcctctctccaccactggtgacaggctaaggatgcccttcaggtaccccgaggtaacacgcgacactcgggatctgagaaggggactggggcttgccctcgtagtgggggtttaaaaagcttctatgcctgaataggtgaccggaggtcggcacctttcctttacaattaatgaccctcgactcggaccgatg

SEQ ID NO: 11426 - DNA, 203 bp, Homo sapiens
ggcgcgccagtcctttgtagtacactggtgacagttacctatcaagtatcaggtaccccgaggtaacacgcgacactcgggatctgagaaggggactggggcttctataaaagcgctcggtttaaaaagcttctatgcctgaataggtgaccggaggtcggcacctttcctttacaattaatgaccctcgactcggaccgatg

SEQ ID NO: 11427 - DNA, 203 bp, Homo sapiens
ggcgcgccagtcctctcggccacactgtaacgatggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgacgactcggaccgatg

SEQ ID NO: 11428 - DNA, 203 bp, Homo sapiens
ggcgcgccagtcctatgagccccacttcctctgtaaagctctcaacccctgggaagcgaatgtctctcctgggaaagagccctcccatgcctagctgctgctcttagggaccctgtggctaggtgcgcggatggaaatccaggatctccgcctggttcggcccgcctgcctccactcctgcctctacccgactcggaccgatg

SEQ ID NO: 11429 - DNA, 203 bp, Homo sapiens
ggcgcgccagtcctatgggctgcacttcctctgtaaagctctcaaccctgtccccttccccctctctcctgggaaaagaaaaagaagcttctagctgctgctcttagggaccctgtggctaggtgcgcggatggaaatccaggatctccgcctggttcggcccgcctgcctccactcctgcctctacccgactcggaccgatg

SEQ ID NO: 11430 - DNA, 203 bp, Homo sapiens
ggcgcgccagtccttccaccatcacttcctctgtaaagctctcaaccctgtccccttccccctctctcctgggaaagagccctcccatgcctagctgctgctctcgtatgaatgtgttctaggtgcgcggatggaaatccaggatctccgcctggttcggcccgcctgcctccactcctgcctctacccgactcggaccgatg

SEQ ID NO: 11431 - DNA, 203 bp, Homo sapiens
ggcgcgccagtccttgcttgtgcacttcctctgtaaagctctcaaccctgtccccttccccctctctcctgggaaagagccctcccatgcctagctgctgctcttagggaccctgtggctaggtgcgcggatggaaatccaggatcataagtatacatctcccgcctgcctccactcctgcctctacccgactcggaccgatg

SEQ ID NO: 11432 - DNA, 203 bp, Homo sapiens
ggcgcgccagtcctcgctgacacacttcctctgtaaagctctcaaccctgtccccttccccctctctcctgggaaagagccctcccatgcctagctgctgctcttagggaccctgtggctaggtgcgcggatggaaatccaggatctccgcctggttcggaataagaaagcgttctcctgcctctacccgactcggaccgatg

SEQ ID NO: 11433 - DNA, 203 bp, Homo sapiens
ggcgcgccagtcctgttaagcccacttcctctgtaaagctctcaaccctgtccccttccccctctctcctgggaaagagccctcccatgcctagctgctgctcttagggaccctgtggctaggtgcgcggatggaaatccaggatctccgcctggttcggcccgcctgcctccaacgagtgagtagtacgactcggaccgatg

SEQ ID NO: 11434 - DNA, 203 bp, Homo sapiens
ggcgcgccagtcctcctaattccacttcctctgtaaagctctcaaccctgtccccttccccctctctcctgggaaagagccctcccatgcctagctgctgctcttagggaccctgtggctaggtgcgcggatggaaatccaggatctccgcctggttcggcccgcctgcctccactcctgcctctacccgactcggaccgatg

SEQ ID NO: 11435 - DNA, 203 bp, Homo sapiens
ggcgcgccagtcctgcccgcttcacttcctctgtaaagctctcaaccctgtccccttccccctctctcctgggaaagagccctcccatgcctagctgctgctcttagggaccctgtggctaggtgcgcggattagttgaattccgttccgcctggttcggcccgcctgcctccactcctgcctctacccgactcggaccgatg

SEQ ID NO: 11436 - DNA, 203 bp, Homo sapiens
ggcgcgccagtccttgaccgaacacttcctctgtaaagctctcaaccctgtccccttccccctctctcctgggaaagagccctcccatgcctagctgctgctcttagggaccctgtggtctaacatatcctcggaaatccaggatctccgcctggttcggcccgcctgcctccactcctgcctctacccgactcggaccgatg

SEQ ID NO: 11437 - DNA, 203 bp, Homo sapiens
ggcgcgccagtcctggaggcagcacttcctctgtaaagctctcaaccctgtccccttccccctctctcctgggaaagagccctcccatgctactacaggttagctagggaccctgtggctaggtgcgcggatggaaatccaggatctccgcctggttcggcccgcctgcctccactcctgcctctacccgactcggaccgatg

SEQ ID NO: 11438 - DNA, 203 bp, Homo sapiens
ggcgcgccagtcctcgcaatcgcacttcctctgtgttagaacgcgtgttgtccccttccccctctctcctgggaaagagccctcccatgcctagctgctgctcttagggaccctgtggctaggtgcgcggatggaaatccaggatctccgcctggttcggcccgcctgcctccactcctgcctctacccgactcggaccgatg

SEQ ID NO: 11439 - DNA, 203 bp, Homo sapiens
ggcgcgccagtcctccgtggtgcagacatgaggttcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacaccgactcggaccgatg

SEQ ID NO: 11440 - DNA, 203 bp, Homo sapiens
ggcgcgccagtcctcggcctcccagagagcgcaaggggcaaggatttcatgagcatcctcctctaaacgcgtgtcaagacaaaagatgcttcagctttggaaacttgttctcctgtgcggcgtgctcactgggacctcagagtctcttcttgacaatcttggcaatgacctaagcaatgtcgtggatacgactcggaccgatg

SEQ ID NO: 11441 - DNA, 203 bp, Homo sapiens
ggcgcgccagtcctccgggccccagagatacagctgccactcacacactcatccagacaaatcaaactagactcacatcattcggaaacaattctctcataatttaaagaaaaaatcataggccggacgggttagaaatccggtgcttgttcgtgatcagataacctccacaccagaatcatacaatccgactcggaccgatg

SEQ ID NO: 11442 - DNA, 203 bp, Homo sapiens
ggcgcgccagtcctgacggcggcagagatacagctgccactcacacactcatccagacaaatttcgggctcggatgatcattcggaaacaattctctcataatttaaagaaaaaatcataggccggacgggttagaaatccggtgcttgttcgtgatcagataacctccacaccagaatcatacaatccgactcggaccgatg

SEQ ID NO: 11443 - DNA, 203 bp, Homo sapiens
ggcgcgccagtcctcaggaaatcagagccctgcacccctaattcccggctcgtttgcaaatgtgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 11444 - DNA, 203 bp, Homo sapiens
ggcgcgccagtcctgacgtgcccagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 11445 - DNA, 203 bp, Homo sapiens
ggcgcgccagtcctatgtagaccagagccctgcagatgagtagtgttctggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 11446 - DNA, 203 bp, Homo sapiens
ggcgcgccagtcctgtctgagtcagaggatttatttagtcactggcaaacggaaagatggcgccggtttactggcaaacacaaattgaggtgggtccgggagcaaccaatgccactataaactttgaagcaggaattctggagtgctatgaaaggttttcatggcaaagagcccttgactatcctggtcgactcggaccgatg

SEQ ID NO: 11447 - DNA, 203 bp, Homo sapiens
ggcgcgccagtccttgtcccagcagaggatttatttagtcactggcaaacggaaagatggcggacaacatgaccacaacacaaattgagggccccttctagtacaccaatgccactataaactttgaagcaggaattctggagtgctatgaaaggttttcatggcaaagagcccttgactatcctggtcgactcggaccgatg

SEQ ID NO: 11448 - DNA, 203 bp, Homo sapiens
ggcgcgccagtcctatctaacacagaggatttatttagtcactggcaaacggaaagatggcggacaacatgaccacaacacaaattgaggtgggtccgggagcaaccaatgccactataaactttgaagcaggaattctggagtgctatgaaaggttttcatggcaaagagcccttgactatcctggtcgactcggaccgatg

SEQ ID NO: 11449 - DNA, 203 bp, Homo sapiens
ggcgcgccagtcctgcccttagcagaggatttatttagtcactggcaaacggaaagatggcggacaacatgaccacaacacaaattgaggtgggtccgggagcaaccaatgccactataaactttgaagcagttggcagcagagtgtatgaaaggttttcatggcaaagagcccttgactatcctggtcgactcggaccgatg

SEQ ID NO: 11450 - DNA, 203 bp, Homo sapiens
ggcgcgccagtcctattggacccagagtattgatgaggaaactgaagtttggagcgatcacatcattttcccaaggtaacacaagtggcaagacagccgggaacccctaccccatccccttattcagcacatgaaataaacaaggggcatccaaatcttgcggcaacgcccccgggacatgcatcgtccgactcggaccgatg

SEQ ID NO: 11451 - DNA, 203 bp, Homo sapiens
ggcgcgccagtcctaacattggcagagtattgatgaggaaactgaagtttggagcgatcacatcattttcccaaggtaacacaagtggcaagacagccgggaacccctaccccatccccttattcagcacatttttcccgtgtaatgcatccaaatcttgcggcaacgcccccgggacatgcatcgtccgactcggaccgatg

SEQ ID NO: 11452 - DNA, 203 bp, Homo sapiens
ggcgcgccagtcctggtttcggcagagtattgatgaggaaactgaagtttggagcgatcacatcattttcccaaggtaacacaagtggcaagacagccgggaactttaggtatcgagacttattcagcacatgaaataaacaaggggcatccaaatcttgcggcaacgcccccgggacatgcatcgtccgactcggaccgatg

SEQ ID NO: 11453 - DNA, 203 bp, Homo sapiens
ggcgcgccagtcctcagcgctacagagtctgagccgttcagaggctcatttgataaatagaagatttatttgggcttggtggtaagtgtgattttatgttttctttgattttcttgtagacttgttcctgacgctgctacaggagccctcactctgattccttcatttatttttccaggtaagcaaaccgactcggaccgatg

SEQ ID NO: 11454 - DNA, 203 bp, Homo sapiens
ggcgcgccagtcctctggataacagataagagccccaggccctgcagtcaactctgggaggcaacccagacacacgtcaggctgaacccaccccacatttctccctcgggaatctgattaaggcagtgattcttcattgcctgccctcctgtccacactcctgcctactgccacccacaagggtcatccgactcggaccgatg

SEQ ID NO: 11455 - DNA, 203 bp, Homo sapiens
ggcgcgccagtcctcgttgctgcagataagagccccaggccctgcagtcaactctgggaggccgtgggctggacttgacccaaatggtttccccacatttctccctcgggaatctgattaaggcagtgattcttcattgcctgccctcctgtccacactcctgcctactgccacccacaagggtcatccgactcggaccgatg

SEQ ID NO: 11456 - DNA, 203 bp, Homo sapiens
ggcgcgccagtccttctcagtccagataagagccccaggccctgcagtcaactctgggaggccgtgggctggactttcaggctgaacccaccccacatcatcgtttcgggaatctgattaaggcagtgattcttcattgcctgccctcctgtccacactcctgcccgtatggacccacaagggtcatccgactcggaccgatg

SEQ ID NO: 11457 - DNA, 203 bp, Homo sapiens
ggcgcgccagtccttgatggcgcagataagagccccaggccctgcagtcaactctgggaggccgtgggctggactttcaggctgaacccaccccacatttctccctcgggaatctgattaaggcagtgattcttcattgcctgcccgaaacagtcgtggtctgcctactgccacccacaagggtcatccgactcggaccgatg

SEQ ID NO: 11458 - DNA, 203 bp, Homo sapiens
ggcgcgccagtcctgagcggcacagataagagccccaggccctgcagtcaactctgggaggccgtgggctggactttcaggctgaacccaccccacatttctccctcgggaatctgattaaggcagtgattcttcattgcctgccctcctgtccacactcctgcccgtatggacccacaagggtcatccgactcggaccgatg

SEQ ID NO: 11459 - DNA, 203 bp, Homo sapiens
ggcgcgccagtccttgcgagtacagataagagccccaggccctgcagtcaactctgggaggccgtgggctggactttcaggctgaacccaggtactcaagtgtgctcgggaatctgattaaggcagtgattcttcattgcctgccctcctgtccacactcctgcctactgccacccacaagggtcatccgactcggaccgatg

SEQ ID NO: 11460 - DNA, 203 bp, Homo sapiens
ggcgcgccagtcctggagccgccagataagagccgtgccatgcaacagcaactctgggaggccgtgggctggactttcaggctgaacccaccccacatttctccctcgggaatctgattaaggcagtgattcttcattgcctgccctcctgtccacactcctgcctactgccacccacaagggtcatccgactcggaccgatg

SEQ ID NO: 11461 - DNA, 203 bp, Homo sapiens
ggcgcgccagtccttttgatgacagatcgtgctacggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgactcggaccgatg

SEQ ID NO: 11462 - DNA, 203 bp, Homo sapiens
ggcgcgccagtcctcggtcgagcagattattcctatgcatcctgccttcctcacccaggactggtctgagagggattcatgatggaagcactcatcgaggcgttcctggttctcgcctaaatgtggtcaacagtgtcagcagttcagaggacatcaagcccttaccagggcttcccgggattggaaaccgactcggaccgatg

SEQ ID NO: 11463 - DNA, 203 bp, Homo sapiens
ggcgcgccagtcctattccttccagattattcctatgcatcctgccttcctcacccaggactggtctgagagggattcatgatggaagcatgttcattctgtgacctggttctcgcctaaatgtggtcaacagtgtcagcagttcagaggacatcaagccagcggtccaatagaccgggattggaaaccgactcggaccgatg

SEQ ID NO: 11464 - DNA, 203 bp, Homo sapiens
ggcgcgccagtcctgttctaggcagattattccttccgtatgcctgaccctcacccaggactggtctgagagggattcatgatggaagcatgttcattctgtgacctggttctcgcctaaatgtggtcaacagtgtcagcagttcagaggacatcaagcccttaccagggcttcccgggattggaaaccgactcggaccgatg

SEQ ID NO: 11465 - DNA, 203 bp, Homo sapiens
ggcgcgccagtcctacatctgccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtgggcacatagaagtcgactcggaccgatg

SEQ ID NO: 11466 - DNA, 203 bp, Homo sapiens
ggcgcgccagtcctaagaatgccagcagcctgcagccgccgccgggttgtgcctcagactgtcagataaatcggcgggccgggccggcggtatttcactgcttacccgggccggacatggcggcgctctacgcctgcaccaagtgccaccagcgcttccccttcgaggcgctgtctcaggggcagcagcgactcggaccgatg

SEQ ID NO: 11467 - DNA, 203 bp, Homo sapiens
ggcgcgccagtcctcgcagaatcagcagcctgcagccgccgccgggttgtgcctcagactgtcagataaatcggcgttggttaagtcaacgtcggtgagcgcggcccgggccggacatggcggcgctctacgcctgcaccaagtgccaccagcgcttccccttcgaggcgctgtctcaggggcagcagcgactcggaccgatg

SEQ ID NO: 11468 - DNA, 203 bp, Homo sapiens
ggcgcgccagtcctaaatcgaccagcatccaccgcgcggcccaggactcgagcatgccctaccgttgcgtgaggcgggtaaatgttcgcggaagcggcaaagacgacacggccttgtgggatggcggagtttaaggagaagcctgaggccccgactgagcagctggatgtcgcgtgcggccaggaaaacgactcggaccgatg

SEQ ID NO: 11469 - DNA, 203 bp, Homo sapiens
ggcgcgccagtccttaacgccccagcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgccatctagaatttgcgactcggaccgatg

SEQ ID NO: 11470 - DNA, 203 bp, Homo sapiens
ggcgcgccagtcctcgtacgatcagcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagccaaacccaaagatatgcggccaggaaaacgactcggaccgatg

SEQ ID NO: 11471 - DNA, 203 bp, Homo sapiens
ggcgcgccagtcctgcgggtggcagcatccaccgcgcggcccaggactgtcagggtagtgggcgttgcgtgaggcgggtaaatgttcgcggaagcggcaaagacgacacggccttgtgggatggcggagtttaaggagaagcctgataattgcgtccgatagctggatgtcgcgtgcggccaggaaaacgactcggaccgatg

SEQ ID NO: 11472 - DNA, 203 bp, Homo sapiens
ggcgcgccagtcctccatcacacagcatccaccgcgcggcccaggactgtcagggtagtgggcgttgcgtgaggcgtagcgcccacactcgaagcggcaaagacgacacggccttgtgggatggcggagtttaaggagaagcctgaggccccgactgagcagctggatgtcgcgtgcggccaggaaaacgactcggaccgatg

SEQ ID NO: 11473 - DNA, 203 bp, Homo sapiens
ggcgcgccagtcctcagcgtatcagcatccaccgcgcggcccaggactgtcagggtagtggggagacaaactcaacggtaaatgttcgcggaagcggcaaagacgacacggccttgtgggatggcggagtttaaggagaagcctgaggccccgactgagcagctggatgtcgcgtgcggccaggaaaacgactcggaccgatg

SEQ ID NO: 11474 - DNA, 203 bp, Homo sapiens
ggcgcgccagtcctgaactgctcagcatcccagacagacttccagattccttacgtaggggaccaacacgtaggtgtatgggagaccacatcatttcatgacttatgtttgaggaacactaggctgttgtctagacgaggcaagctctggaaagcaacgccgagtctctgagaagagggagcataggccgactcggaccgatg

SEQ ID NO: 11475 - DNA, 203 bp, Homo sapiens
ggcgcgccagtcctcaccaaggcagcatcccagacagacttccagatttgaacatctaccccccaacacgtaggtggtgctctacgtgtgtcatttcatgacttatgtttgaggaacactaggctgttgtctagacgaggcaagctctggaaagcaacgccgagtctctgagaagagggagcataggccgactcggaccgatg

SEQ ID NO: 11476 - DNA, 203 bp, Homo sapiens
ggcgcgccagtcctacgactagcagcatcccagacagacttccagatttgaacatctaccccccaacacgtaggtgtatgggagaccacatcatttcatgacttatgtttgaggaacactaggctgttgtctagacgaggcaagcttcaccctaacggagcgagtctctgagaagagggagcataggccgactcggaccgatg

SEQ ID NO: 11477 - DNA, 203 bp, Homo sapiens
ggcgcgccagtcctaattacggcagcatcccagacagacttccagatttgaacatctaccccccaacacgtaggtgtatgggagaccacatcatttcatgacttgcaacgcgccccgtctaggctgttgtctagacgaggcaagctctggaaagcaacgccgagtctctgagaagagggagcataggccgactcggaccgatg

SEQ ID NO: 11478 - DNA, 203 bp, Homo sapiens
ggcgcgccagtcctaacctcctcagcatcccagatgtggcatatcgaatgaacatctaccccccaacacgtaggtgtatgggagaccacatcatttcatgacttatgtttgaggaacactaggctgttgtctagacgaggcaagctctggaaagcaacgccgagtctctgagaagagggagcataggccgactcggaccgatg

SEQ ID NO: 11479 - DNA, 203 bp, Homo sapiens
ggcgcgccagtccttataacctcagccccgggggcagggagagcctagattacggaagtaccgcgagcaaggagacttaggggatatcgcgtccggagctagctggatcctctaggcaggatggtgatgggaatctttgcaaattgtatcttctgtttgaaagtgaagtacttacctcagcagcagaacgactcggaccgatg

SEQ ID NO: 11480 - DNA, 203 bp, Homo sapiens
ggcgcgccagtcctaagggcgtcagccccgggggcagggagagcctagattacggaagtaccgcgagcaaggagcgcggaatcggggagcgtccggagctagctggatcctctaggcaggatggtgatgggaatctttgcaaattgtatcttctgtttgattccatttagtaagcctcagcagcagaacgactcggaccgatg

SEQ ID NO: 11481 - DNA, 203 bp, Homo sapiens
ggcgcgccagtcctttcagcctcagccccgggggcagggagagcctagattacggaagtaccgcgagcaaggagcgcggaatcggggagctgaaacctggtcaaggatcctctaggcaggatggtgatgggaatctttgcaaattgtatcttctgtttgaaagtgaagtacttacctcagcagcagaacgactcggaccgatg

SEQ ID NO: 11482 - DNA, 203 bp, Homo sapiens
ggcgcgccagtcctttgctaaccagcctagctaatggtggtggcgctttaggcagcctccacgcccaccacctcccagatagagcggcggcactgtagggaagaccggggaccggtcactaccaaggacgcagacctctttttgagtatcacgcctccggaagtagttgggcaagcccacctatatgtcgactcggaccgatg

SEQ ID NO: 11483 - DNA, 203 bp, Homo sapiens
ggcgcgccagtcctttcaaagtcagcgcacgtagtcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccacgactcggaccgatg

SEQ ID NO: 11484 - DNA, 203 bp, Homo sapiens
ggcgcgccagtcctggtaacaccagcgtcatcaggcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactcgactcggaccgatg

SEQ ID NO: 11485 - DNA, 203 bp, Homo sapiens
ggcgcgccagtccttactattccaggaagtggacggtgagttcgttggatggcttaagccctgagtacagggtagtcgtcagtggttcgacgccttggaataaaggtctcgagatgccacgtggacgagggcatgcccaaagcacatcttaacctgagcgggggtcgcccaggtaaaagcagttttaacgactcggaccgatg

SEQ ID NO: 11486 - DNA, 203 bp, Homo sapiens
ggcgcgccagtcctcgaacttacaggacccagacagagacacacggtcactgcagctgaagccgctgcccctgctaagtccctctgtccagaggctgggagagccaaggatcacgcagcaaggaagaaacagacccaggtgcagactcaggcaccaccaggaccagctgatcattccagcccacagcacgactcggaccgatg

SEQ ID NO: 11487 - DNA, 203 bp, Homo sapiens
ggcgcgccagtcctccggcactcaggacccagacagagacacacggtcactgcagctgaagccgctgcccctgctacagatgaagaaaaggaggctgggagagccaaggatcacgcagcaaggaagaaacagacccaggtgcagacgagacatgacagcagaccagctgatcattccagcccacagcacgactcggaccgatg

SEQ ID NO: 11488 - DNA, 203 bp, Homo sapiens
ggcgcgccagtcctggtcggaacaggacccagacagagacacacggtcactgcagctgaagccgctgcccctgctacagatgaagaaaaggaggctgggagagccaaggatcacgcagcaaggaagaaacagacccaggtgcagactcaggcaccaccagccgagttgagggcctccagcccacagcacgactcggaccgatg

SEQ ID NO: 11489 - DNA, 203 bp, Homo sapiens
ggcgcgccagtcctgaggctgtcaggacccagacagagacacacggtcactgcagctgaagccgctgcccctgctacagatgaagaaaaggaggctgggagagccaaggatcacgcagcaaggaagaaacagacccaggtgcagactcaggcaccaccaggaccagctgatcatattcattacaccttcgactcggaccgatg

SEQ ID NO: 11490 - DNA, 203 bp, Homo sapiens
ggcgcgccagtcctgcaccagtcaggacccagactattcgcggtaccgactgcagctgaagccgctgcccctgctacagatgaagaaaaggaggctgggagagccaaggatcacgcagcaaggaagaaacagacccaggtgcagactcaggcaccaccaggaccagctgatcattccagcccacagcacgactcggaccgatg

SEQ ID NO: 11491 - DNA, 203 bp, Homo sapiens
ggcgcgccagtcctcctctccgcaggaggaggagcccgggcgggcgaggggcggccggagagcgccagggcctgagctgccggagcggcgcctgtgagtgagtgcagaaagcaggcgcccgcgcgctagccggttactttttctgacgcacgccgcgctctctccctgggcgacctgcagtttgcaatcgactcggaccgatg

SEQ ID NO: 11492 - DNA, 203 bp, Homo sapiens
ggcgcgccagtcctcctacgcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatcgactcggaccgatg

SEQ ID NO: 11493 - DNA, 203 bp, Homo sapiens
ggcgcgccagtccttacttcttcaggaggcttctctgggtataaagcagctgaaatgtggagttcgacattaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11494 - DNA, 203 bp, Homo sapiens
ggcgcgccagtccttcccgaggcaggaggcttctctgggtataaagcagctgaaatgtggagttcgacggtaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11495 - DNA, 203 bp, Homo sapiens
ggcgcgccagtcctaaactaggcaggaggcttctctgggtataaagcagctgaaatgtggagtttcctcccaggagctgagagcgtgtccatgggcccagtgcctggcgtgtcctccccctttcaagcaactacgcatgaccaggattctgggagggcagaggacagaccacaggcacccaggataaccgactcggaccgatg

SEQ ID NO: 11496 - DNA, 203 bp, Homo sapiens
ggcgcgccagtccttagcaactcaggaggcttctctgggtataaagcagctgaaatgtggagtttcctcccaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11497 - DNA, 203 bp, Homo sapiens
ggcgcgccagtcctaatccgagcaggaggcttctctgggtataaagcagctgaaatgtggagtttcctcccaggagctgagagcgtgtccatgggcccagtgcctggcgtgtcctccctgggagcttgctggacgcatgaccaggattctgggagggcagctatggttgtgttagcacccaggataaccgactcggaccgatg

SEQ ID NO: 11498 - DNA, 203 bp, Homo sapiens
ggcgcgccagtcctcggcagcgcaggaggcttctctgggtataaagcagctgaaatgtggagtttcctcccaggagctgagagcgtgtccatgggcccagtgcctggcgtgtcctccctgggagcttgctggttagtgtgttttacttctgggagggcagaggacagaccacaggcacccaggataaccgactcggaccgatg

SEQ ID NO: 11499 - DNA, 203 bp, Homo sapiens
ggcgcgccagtcctgttcataccaggaggcttctctgggtataaagcagctgaaatgtggagtttcctcccaggagtaccagtgcaacaaatgggcccagtgcctggcgtgtcctccctgggagcttgctggacgcatgaccaggattctgggagggcagaggacagaccacaggcacccaggataaccgactcggaccgatg

SEQ ID NO: 11500 - DNA, 203 bp, Homo sapiens
ggcgcgccagtcctcaaccacccaggaggcttctctgggtataaagcattcagctgtctttctttcctcccaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11501 - DNA, 203 bp, Homo sapiens
ggcgcgccagtcctcagagagtcaggaggcttcttaccaacatgcaatgctgaaatgtggagtttcctcccaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11502 - DNA, 203 bp, Homo sapiens
ggcgcgccagtcctgggactatcaggcaagattgaagtgaccctccctgggctgctttctttcgattatcatcagtgaccctaccccggctgctcttcccagcacaactccggtgcaaaggcttgggcatcctggtgctttgcctctagcccatgctccacagcgaggagagagaaaaccctgaggcacgactcggaccgatg

SEQ ID NO: 11503 - DNA, 203 bp, Homo sapiens
ggcgcgccagtcctgaagggaacagggccttgtgattaccctatctaaccgagggcaaggcagtggcggcggccgccccaacggagctgcagacgaaaggcaagaacggcgatggccgccgtaggtcagctaaagatcatcaccctggtaaaactttgccagagaacccagcaggattcaccagcacgcgactcggaccgatg

SEQ ID NO: 11504 - DNA, 203 bp, Homo sapiens
ggcgcgccagtcctggacgttccagggccttgtgcgacatgggctgcgagacatcaggctgggtggcggcggccgccccaacggagctgcagacgaaaggcaagaacggcgatggccgccgtaggtcagctaaagatcatcaccctggtaaaactttgccagagaacccagcaggattcaccagcacgcgactcggaccgatg

SEQ ID NO: 11505 - DNA, 203 bp, Homo sapiens
ggcgcgccagtcctatgacaaccagggccttgtgcgacatgggctgcgccgagggcaaggcatctctccatttaatcccaacggagctgcagacgaaaggcaagaacggcgatggccgccgtaggtcagctaaagatcatcaccctggtaaaactttgccagagaacccagcaggattcaccagcacgcgactcggaccgatg

SEQ ID NO: 11506 - DNA, 203 bp, Homo sapiens
ggcgcgccagtccttgcgtcgtcagggctgagggagctcaagtttcagcctgaggcatgggcacctgaaggtctcggacctgagacccgtggattctgtccagtacaccctgttgctccttctgcctcccctctcctgtattgaaagcgtttgtgttcatcttatcagggacctgaccctaagagaatcgactcggaccgatg

SEQ ID NO: 11507 - DNA, 203 bp, Homo sapiens
ggcgcgccagtcctacgatatgcagggctgagggagctcaagtttcagcctgaggcatgggccaggaggccatggtatggatgtcgttccggattctgtccagtacaccctgttgctccttctgcctcccctctcctgtattgaaagcgtttgtgttcatcttatcagggacctgaccctaagagaatcgactcggaccgatg

SEQ ID NO: 11508 - DNA, 203 bp, Homo sapiens
ggcgcgccagtcctgatttctacagggctgagggagctcaagtttcagcctgaggcatgggccaggaggccatggtgacctgagacccgtggattctgtccagtacaccctgttgctccttctgcctcccctctcctgtattgaaacatcactccgcacgcttatcagggacctgaccctaagagaatcgactcggaccgatg

SEQ ID NO: 11509 - DNA, 203 bp, Homo sapiens
ggcgcgccagtcctatctcaatcagggctgagggagctcaagtttcagcctgaggcatgggccaggaggccatggtgacctgagacccgtggattctgtccagtacaccctgttgctccttctgcctcccctctcctgtattgaaagcgtttgtgttcattgaccatatactaggaccctaagagaatcgactcggaccgatg

SEQ ID NO: 11510 - DNA, 203 bp, Homo sapiens
ggcgcgccagtcctcgctcgcccagggctgagggagctcaagtttcagcctgaggcatgggccaggaggccatggtgacctgagacccgtggattctgtccagtacaccctgttgctccttctgcctcccctgagagcagcgtgctgcgtttgtgttcatcttatcagggacctgaccctaagagaatcgactcggaccgatg

SEQ ID NO: 11511 - DNA, 203 bp, Homo sapiens
ggcgcgccagtcctcactttcccagggctgagggagctcaagtttcagcctgaggcatgggccaggaggccatggtgacctgagacccgtggattctgtccagtcactaaatccttctcttctgcctcccctctcctgtattgaaagcgtttgtgttcatcttatcagggacctgaccctaagagaatcgactcggaccgatg

SEQ ID NO: 11512 - DNA, 203 bp, Homo sapiens
ggcgcgccagtccttggccctacagggctgagggagctcaagtttcagttctgatagctattcaggaggccatggtgacctgagacccgtggattctgtccagtacaccctgttgctccttctgcctcccctctcctgtattgaaagcgtttgtgttcatcttatcagggacctgaccctaagagaatcgactcggaccgatg

SEQ ID NO: 11513 - DNA, 203 bp, Homo sapiens
ggcgcgccagtcctactgtaagcaggggaggcgcaaagcgttggttagcctgccccggggcgaagggtatgtggcgagacagagccctgcacccctaattcccggtggaaaactcctgttgccgtttccctccaccggcctggagtctcccagtcttgtcccggcagtgccgccctccccactaagaccgactcggaccgatg

SEQ ID NO: 11514 - DNA, 203 bp, Homo sapiens
ggcgcgccagtcctgaagaaggcaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagaccgactcggaccgatg

SEQ ID NO: 11515 - DNA, 203 bp, Homo sapiens
ggcgcgccagtccttgccacaccaggggaggcgcctgtgaggcccggacctgccccggggcgaagggtatgtggcgagacagagccctgcgtaggggtgctaatgtggaaaactcctgttgccgtttccctccaccggcctggagtctcccagtcttgtcccggcagtgccgccctccccactaagaccgactcggaccgatg

SEQ ID NO: 11516 - DNA, 203 bp, Homo sapiens
ggcgcgccagtccttgtattcccaggggaggcgcctgtgaggcccggaggccagggtaaaataagggtatgtggcgagacagagccctgcacccctaattcccggtggaaaactcctgttgccgtttccctccaccggcctggagtctcccagtcttgtcccggcagtgccgccctccccactaagaccgactcggaccgatg

SEQ ID NO: 11517 - DNA, 203 bp, Homo sapiens
ggcgcgccagtccttcggtaggcaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccacgccctaagaaattcccagggcgaagagcgactcggaccgatg

SEQ ID NO: 11518 - DNA, 203 bp, Homo sapiens
ggcgcgccagtccttcggcccacaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgaggacaccgatgagtcgactcggaccgatg

SEQ ID NO: 11519 - DNA, 203 bp, Homo sapiens
ggcgcgccagtcctccctgccgcaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccatttatcaatctacgcccagggcgaagagcgactcggaccgatg

SEQ ID NO: 11520 - DNA, 203 bp, Homo sapiens
ggcgcgccagtcctgacagggtcaggggcgccgccgccggcgctcgcaggccgcggatgaagaagaaaacccggcgccgctcgacccggagcgaggagttgacccggagcgaggagttgaccctgagtgaggcgagataactacaggaagaggcgacccagagtgaggaggcgacccagggcgaagagcgactcggaccgatg

SEQ ID NO: 11521 - DNA, 203 bp, Homo sapiens
ggcgcgccagtcctgggttgcgcaggggcgccgctagaatgttctcatggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagcgactcggaccgatg

SEQ ID NO: 11522 - DNA, 203 bp, Homo sapiens
ggcgcgccagtcctgctagtatcaggtcaattatattcagtatggaaagaataaaagaactacggaacctgatgtcgcagtctcgcactcgcgagatactgacaaaaaccacagtggaccatatggccataattaagaagtacacatcggggagacaggaggtatctttaaagattaggatgaaatggcgactcggaccgatg

SEQ ID NO: 11523 - DNA, 203 bp, Homo sapiens
ggcgcgccagtcctggcgaagacaggtcaattatattcagtatggaaagaataaaagaactagcccgatctgctgggcagtctcgcactcgcgagatactgacaaaaaccacagtggaccatatggccataattaagaagtacacatcggggagacaggaaaagaacccgtcacttaggatgaaatggcgactcggaccgatg

SEQ ID NO: 11524 - DNA, 203 bp, Homo sapiens
ggcgcgccagtcctgagacgaacaggttcagaaaatttaaaaagtcttgcaccgcagtctctcgtcatttggtgcatacacgcagaagagaaagtgaaagatactgaaggagcaaaacaaatagtgcggagacatctagtggcagaaacaggaactgcagagaaaatgccaagcacaagtagaccaaccgactcggaccgatg

SEQ ID NO: 11525 - DNA, 203 bp, Homo sapiens
ggcgcgccagtcctagtgaattcaggttcagaaaatttaaaaagtctttttaatactgtctgcgtcatttggtgcatacacgcagaagagaaagtgaaagatactgaaggagcaaaacaaatagtgcggagatcagggtccctcttaacaggaactgcagagaaaatgccaagcacaagtagaccaaccgactcggaccgatg

SEQ ID NO: 11526 - DNA, 203 bp, Homo sapiens
ggcgcgccagtcctgtaagacacaggttcagaaaatttaaaaagtctttttaatactgtctgcgtcatttggtgcatacacgcagaagagaaagtgaaagatactgaaggagcaaaactttccagagcatcgcatctagtggcagaaacaggaactgcagagaaaatgccaagcacaagtagaccaaccgactcggaccgatg

SEQ ID NO: 11527 - DNA, 203 bp, Homo sapiens
ggcgcgccagtccttagaactacagtgaccgggtggtttgcttaggcgcagacggggaagcggagccaacatgccaacatatgttgctgaggtttgtcgcaaaacttatgtgaccccgcggagacccttcgagaaatctcgtctcgaccaagagctgaagctgatcggcgagtatgggctccggaacacgactcggaccgatg

SEQ ID NO: 11528 - DNA, 203 bp, Homo sapiens
ggcgcgccagtcctcttaccgtcagtgaccgggtggtttgcttaggcgcagacggggaagcggagccaacatgccagtggcccggagctgggtttgtcgcaaaaaacgcaacgtttttcggagacccttcgagaaatctcgtctcgaccaagagctgaagctgatcggcgagtatgggctccggaacacgactcggaccgatg

SEQ ID NO: 11529 - DNA, 203 bp, Homo sapiens
ggcgcgccagtccttgagataacagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtacctctctaacgtaccgactcggaccgatg

SEQ ID NO: 11530 - DNA, 203 bp, Homo sapiens
ggcgcgccagtcctaacgatttcagtgaccgggtggtttgcttaggcgcagacggggaagcggagccaacatgccagtggcccggagctgggtttgtcgcaaaacttatgtgaccccggatctgggacgtaggaaatctcgtctcgaccaagagctgaagctgatcggcgagtatgggctccggaacacgactcggaccgatg

SEQ ID NO: 11531 - DNA, 203 bp, Homo sapiens
ggcgcgccagtcctgaatcctccagtgcctccggaggaaatctgctcggtccccggcagccgccgcttcccctttgatgttttggtacgccgtgcgcatgcgcccgcgcacgttcgggctgcactgggcagactaagttggatctcctctcttcagtgaaaccctcaattccatcaaaaactaaagggcgactcggaccgatg

SEQ ID NO: 11532 - DNA, 203 bp, Homo sapiens
ggcgcgccagtcctagctgcggcagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatagggtgtgggtccacgactcggaccgatg

SEQ ID NO: 11533 - DNA, 203 bp, Homo sapiens
ggcgcgccagtcctcttatgtgcagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 11534 - DNA, 203 bp, Homo sapiens
ggcgcgccagtccttaaacaatcagtgcctccggaggaaatctgctcggtccccggcagccgccgcttcccctttgatgttttggtacgccgtgcgcatgcgcctcacattagaattactgcactgggcagactaagttggatctcctctcttcagtgaaggttgtggccgagccaaaaactaaagggcgactcggaccgatg

SEQ ID NO: 11535 - DNA, 203 bp, Homo sapiens
ggcgcgccagtcctggagtagtcagtgcctccggaggaaatctgctcgtatgtaattgaatcccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 11536 - DNA, 203 bp, Homo sapiens
ggcgcgccagtcctctgtgaagcagtgcctccgggtcgctgtacaaacgtccccggcagccgccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 11537 - DNA, 203 bp, Homo sapiens
ggcgcgccagtccttcgttatacagttgctttctcgtggctctgcagcgagagcgcagagaagcagaggaccaagaggcagaatgccggcgctccaccgcccgagactgtgtttcctgtgagtccagatgtgtgatccagatatgctgcaatggtgacataaactgttgactgagactaggagcgtgccgactcggaccgatg

SEQ ID NO: 11538 - DNA, 203 bp, Homo sapiens
ggcgcgccagtcctgtcctacacagttggcccgtgtgaggagaaggccggggcagcggaggcttccggcggaaaatccaagaggaagaaggatctacggatatcgacgggtggagtctcacccgcacccaaccccacacccccccggaacctggactcccggaccttcatcaccattggagacagaaacgactcggaccgatg

SEQ ID NO: 11539 - DNA, 203 bp, Homo sapiens
ggcgcgccagtcctctctctcgcagttggcccgtgtgaggagaaggcctattacaattctctttccggcggaaaatccaagaggaagaaggatctacggatatcctgcatgtccaagccacccgcacccaaccccacacccccccggaacctggactcccggaccttcatcaccattggagacagaaacgactcggaccgatg

SEQ ID NO: 11540 - DNA, 203 bp, Homo sapiens
ggcgcgccagtcctacatggagcataacaaacacttcaacatcacagtacaggctgaatcatttcttcacatcatgctacccacacaactaagctagatccttaactcatagttacataaaaacctcaagtatcacaatcaaacacccgccgggggtccaattcacaaaattaacagctggggcaaatcgactcggaccgatg

SEQ ID NO: 11541 - DNA, 203 bp, Homo sapiens
ggcgcgccagtcctggcttggtcataacaaacacttcaacatcacagtacaggctgaatcatttcttcacatcatggctagttgcaggtgaagctagatccttaactcatagttacataaaaacctcaagtatcacaatcaaacactaaatcaacacatcattcacaaaattaacagctggggcaaatcgactcggaccgatg

SEQ ID NO: 11542 - DNA, 203 bp, Homo sapiens
ggcgcgccagtcctttgaagatcataagagtctaattcaccaaaaaagttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 11543 - DNA, 203 bp, Homo sapiens
ggcgcgccagtccttatacacccataagagtctatcattgatttctttttgtggtaaaaatcacctggaccaatgcgaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 11544 - DNA, 203 bp, Homo sapiens
ggcgcgccagtccttcatcggacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 11545 - DNA, 203 bp, Homo sapiens
ggcgcgccagtcctcagggtgccataagccaaattgtgagccatgatagtggcactgaatttctaaatacaagaaattgcttagacaattggtttagtatctgtatatgggcaatactctgtcctgcagtaggcagcatgtcagctgaaacaccaatcacggctccagctacggctcaggatctgcagcgactcggaccgatg

SEQ ID NO: 11546 - DNA, 203 bp, Homo sapiens
ggcgcgccagtcctagtatctgcataagccaaattgtgagccatgatagtggcactgaatttctaaatacaagaaattgcttagacaattttgcattcgctcagatatgggcaatactctgtcctgcagtaggcagcatgtcagctgaaacaccaatcacattgaatatcgatcctcaggatctgcagcgactcggaccgatg

SEQ ID NO: 11547 - DNA, 203 bp, Homo sapiens
ggcgcgccagtcctccttatctcataaggtatacgcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 11548 - DNA, 203 bp, Homo sapiens
ggcgcgccagtcctatccgcgtcatacaatgcacggcggggctgctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagcgactcggaccgatg

SEQ ID NO: 11549 - DNA, 203 bp, Homo sapiens
ggcgcgccagtcctgttcaattcatcctgggtcactaatgatgttaaggaaccagaacgttttcccctcctggactgttagtaacttagtctccctcctcccctaaccacccccgcccccccccaccccccgcagtaataaaggcccctgaacgtgtatgttggtctcccgggagctgcttgctgaagcgactcggaccgatg

SEQ ID NO: 11550 - DNA, 203 bp, Homo sapiens
ggcgcgccagtcctgggtagaacatcctgggtcagaggccgatccgcagaaccagaacgttttcccctcctggactgttagtaacttagtctccctcctcccctaaccacccccgcccggatatctaattgccagtaataaaggcccctgaacgtgtatgttggtctcccgggagctgcttgctgaagcgactcggaccgatg

SEQ ID NO: 11551 - DNA, 203 bp, Homo sapiens
ggcgcgccagtcctgaggttcgcatcctgggtcagaggccgatccgcagaaccagaacgttttcccctcctggactgttagtaacttagtctccctcctcccctcggggttgatctaaccccccaccccccgcagtaataaaggcccctgaacgtgtatgttggtctcccgggagctgcttgctgaagcgactcggaccgatg

SEQ ID NO: 11552 - DNA, 203 bp, Homo sapiens
ggcgcgccagtcctgggctgatcatctgcctgggatcatcaagccctaattagcccccaatcttaaattagggctgccgttttctgtttctccctgggctgcggaaagccagaagattttatctagcttatacaaggctgctggtgttccctctttttttccacgagggtgtttttggctgcaattgccgactcggaccgatg

SEQ ID NO: 11553 - DNA, 203 bp, Homo sapiens
ggcgcgccagtcctatatccttcatctgcctgggatcatcaagccctagaagctgggtttctttaaattagggctgccgttttctgtttctccctgggctgcggcggatagcttagcgttatctagcttatacaaggctgctggtgttccctctttttttccacgagggtgtttttggctgcaattgccgactcggaccgatg

SEQ ID NO: 11554 - DNA, 203 bp, Homo sapiens
ggcgcgccagtcctaggatagacatgaaatgtccagggattacgactcgcgtggtcggacagcacatgttagtcatgtattatggtgtttcccaacacgtatctttgctctagtattgaactttagtgatgagtgtacttggcatgtacacctgattagttagcccttgtggatacgccactgccgctcgactcggaccgatg

SEQ ID NO: 11555 - DNA, 203 bp, Homo sapiens
ggcgcgccagtcctatatgaaccatgagccggaacctatcaataacgtgcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgaccgactcggaccgatg

SEQ ID NO: 11556 - DNA, 203 bp, Homo sapiens
ggcgcgccagtcctcgtgacgacatgagccggaagaccgtcccggatgaagctccactaatacagtgtgtggaggtgagctccgggattgccggcattcccgcttctgctggttgcttcatgctgcaggctgcggccgtcagccctcgctcgcattggtggcgctgaggtgccggggcagcaagtgaccgactcggaccgatg

SEQ ID NO: 11557 - DNA, 203 bp, Homo sapiens
ggcgcgccagtcctctgtttgacatgagccggaagaccgtcccggatggcctcggggactgccagtgtgtggaggtacttattacctgatccggcattcccgcttctgctggttgcttcatgctgcaggctgcggccgtcagccctcgctcgcattggtggcgctgaggtgccggggcagcaagtgaccgactcggaccgatg

SEQ ID NO: 11558 - DNA, 203 bp, Homo sapiens
ggcgcgccagtcctcgagcccgcatgagccggaagaccgtcccggatggcctcggggactgccagtgtgtggaggtgagctccgggattgccggcattcccgcttctgctggttgcttcatgctgcaggctgcggccgtcagccctcgctcgcattggtgaattgtgaccttgagggcagcaagtgaccgactcggaccgatg

SEQ ID NO: 11559 - DNA, 203 bp, Homo sapiens
ggcgcgccagtcctgccgtcctcatgagccggaagaccgtcccggatggcctcggggactgccagtgtgtggaggtgagctccgggattgccggcattcccgcttctgctggttgcttcatgctgcaggctgcggccgtcagccctcgctcgcattggtgcgagctcacacgatgggcagcaagtgaccgactcggaccgatg

SEQ ID NO: 11560 - DNA, 203 bp, Homo sapiens
ggcgcgccagtcctcaagcgatcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccgactattttctcacacgactcggaccgatg

SEQ ID NO: 11561 - DNA, 203 bp, Homo sapiens
ggcgcgccagtcctcagtacagcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgaccgactcggaccgatg

SEQ ID NO: 11562 - DNA, 203 bp, Homo sapiens
ggcgcgccagtcctttggaatccatgagccggaagaccgtcccggatggcctcggggactgccagtgtgtggaggtgagctccgggattgccggcattcccgcttctgctggttgcttcatgctgcaggctggattttatctttaccgctcgcattggtggcgctgaggtgccggggcagcaagtgaccgactcggaccgatg

SEQ ID NO: 11563 - DNA, 203 bp, Homo sapiens
ggcgcgccagtcctgttcgcgacatgagccggaagaccgtcccggatggcctcggggactgccagtgtgtggaggtgagctccgggattgccggcattcccgcttctgctggttgcttcatgctgcaggctgtctgtacttcagaacgctcgcattggtggcgctgaggtgccggggcagcaagtgaccgactcggaccgatg

SEQ ID NO: 11564 - DNA, 203 bp, Homo sapiens
ggcgcgccagtccttgctcaaacatgagccggaagaccgtcccggatggcctcggggactgccagtgtgtggaggttgagagttttcaacccggcattcccgcttctgctggttgcttcatgctgcaggctgcggccgtcagccctcgctcgcattggtggcgctgaggtgccggggcagcaagtgaccgactcggaccgatg

SEQ ID NO: 11565 - DNA, 203 bp, Homo sapiens
ggcgcgccagtcctgcgatgcacatgccttacctcacgtgtaccagtttgctgagacacatgtctccgcccctgggtctggggaagaagtgtccggccagagtggcttacaagcggcttctgcggatggacctgcccgtcgcagatgacaacaccgtccacttcaattccaccctcatggctctgatccgactcggaccgatg

SEQ ID NO: 11566 - DNA, 203 bp, Homo sapiens
ggcgcgccagtcctaaccgtaacatgccttacctggacatgtatcagagaagcccggctgcctctccgcccctgggtctggggaagaagtgtccggccagagtggcttacaagcggcttctgcggatggacctgcccgtcgcagatgacaacaccgtccacttcaattccaccctcatggctctgatccgactcggaccgatg

SEQ ID NO: 11567 - DNA, 203 bp, Homo sapiens
ggcgcgccagtcctaggccaagcatgccttacctggacatgtatcagatgctgagacacatgtctccgcccctgggtctggggaagaagtgtccggccagagtgctacgatgaaccggtctgcggatggacctgcccgtcgcagatgacaacaccgtccacttcaattccaccctcatggctctgatccgactcggaccgatg

SEQ ID NO: 11568 - DNA, 203 bp, Homo sapiens
ggcgcgccagtcctataaatcccatgccttacctggacatgtatcagatgctgagacacatgtctccgcccctgggtctggggaagaagtgtccggccagagtggcttacaagcggctgagtgcataatctatgcccgtcgcagatgacaacaccgtccacttcaattccaccctcatggctctgatccgactcggaccgatg

SEQ ID NO: 11569 - DNA, 203 bp, Homo sapiens
ggcgcgccagtcctgcgttctgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccacccctcataggacatcacgactcggaccgatg

SEQ ID NO: 11570 - DNA, 203 bp, Homo sapiens
ggcgcgccagtcctgtctacttcatgccttacctggacatgtatcagatgctgagacacatgtctccgcccctgggtctggggaagaagttgatccaggttccagcttacaagcggcttctgcggatggacctgcccgtcgcagatgacaacaccgtccacttcaattccaccctcatggctctgatccgactcggaccgatg

SEQ ID NO: 11571 - DNA, 203 bp, Homo sapiens
ggcgcgccagtcctcggccgttcatggccgagaggccggggcctccgggcggcgccgtgtccgcgaccgcgtaccctgacacccccgcggaattccctccgcacctccaggcgggtgcgatgcggcgccgctccaccttgactgataactgtctgtgcgccggcgcgttcggggccctggccgccgcccgactcggaccgatg

SEQ ID NO: 11572 - DNA, 203 bp, Homo sapiens
ggcgcgccagtccttccaaggccatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgcaccgcaccaacaccccctggccgccgcccgactcggaccgatg

SEQ ID NO: 11573 - DNA, 203 bp, Homo sapiens
ggcgcgccagtcctacctatgacatggtgagaaaagggttgcggtaccttccagcaaggtcatacatgaaatcaagactggtggattggaaatgtatgtcccaggatggcaggccatgttccgctggatgcgcttccatgacctcggattgtggacaggagatcgcgatcttctgcccgaattcgtaacgactcggaccgatg

SEQ ID NO: 11574 - DNA, 203 bp, Homo sapiens
ggcgcgccagtcctctcagctgcatggtgagaaattttacagaaagatttccagcaaggtcatacatgaaatcaagactggtggattggaaatgtatgtcccaggatggcaggccatgccaattctttcaaccttccatgacctcggattgtggacaggagatcgcgatcttctgcccgaattcgtaacgactcggaccgatg

SEQ ID NO: 11575 - DNA, 203 bp, Homo sapiens
ggcgcgccagtccttgacttctcatggtgagaaattttacagaaagatttccagcaaggtcatacatgaaatcaagactggtggattggaaatgtatgtcccaggatggcaggccatgttccgctggatgcgcttccatgacctcggattgtggacaggagatcgcgatcttctgcccgaattcgtaacgactcggaccgatg

SEQ ID NO: 11576 - DNA, 203 bp, Homo sapiens
ggcgcgccagtcctattcgtagcatggttacccaatgcgcactcccgattccaataaacttgaatgtaaggcttgaaacagtggtctaggtgccctatttagggtgaggagcctagctggcagccccagtgaatcctctattggatagaaaccgctatatcgggtagctatagcagtcggatagtaatcgactcggaccgatg

SEQ ID NO: 11577 - DNA, 203 bp, Homo sapiens
ggcgcgccagtcctgtgaatggcatggttacccatcatttgaggaaatttccaataaacttgaatgtaaggcttgaaacagtggtctaggtgccctatttagggtgaggagcctagctggcagccccagtgaatcctctattggatagaaaccgctatatcgggtagctatagcagtcggatagtaatcgactcggaccgatg

SEQ ID NO: 11578 - DNA, 203 bp, Homo sapiens
ggcgcgccagtcctatgcggcgcatggttacccatcatttgaggaaatttccaataaacttgaatgtaaggcttgaaacagtggtctaggtgccctatttagggtgaggagcctagctggcagccccagtgaatcctctattggattagtttaatacctacgggtagctatagcagtcggatagtaatcgactcggaccgatg

SEQ ID NO: 11579 - DNA, 203 bp, Homo sapiens
ggcgcgccagtccttgggctcgcattcagcgcaacagccgtcggtcctctcgctttcccgtaggggccgtcggcgttcgtttgaaacgcggtccacccgtcccagcgtagccggcgctcttcggcgccgcgcgcaaacttcccgagccggcgggtgcgggcggtggcagcggggagtctcctatacgtcgactcggaccgatg

SEQ ID NO: 11580 - DNA, 203 bp, Homo sapiens
ggcgcgccagtcctctgccgggcattcagcgcaacagccgtcggtcctctcgctttcccgtaggggccgtcggcgttcgtttgaaacgcggtccacccgtcccagcgtagccggcgctcttcggcgccgcgcgcaaacttcccgagccggcgggtgcgggtatacctgtgtcaccccggatgggcgcccgactcggaccgatg

SEQ ID NO: 11581 - DNA, 203 bp, Homo sapiens
ggcgcgccagtcctaagccggtcattcatttctaccggtctctagtagtgcagcttcggctgagacacgtcccagtcttcctccgctgccgcccccgcaaggcttcgccgtcatcgaggccatttccagcgacttgtcgcacgcttttctatatacttcgttccccgccaaccgcaaccattgacgcccgactcggaccgatg

SEQ ID NO: 11582 - DNA, 203 bp, Homo sapiens
ggcgcgccagtcctcttggtaccattcatttctaccggtctctagtagtgcagcttcggctggtgtcatcggtgtccttcctccgctgccgcccccgcaaggcttcgccgtcatcgagctttcacatgcatccttgtcgcacgcttttctatatacttcgttccccgccaaccgcaaccattgacgcccgactcggaccgatg

SEQ ID NO: 11583 - DNA, 203 bp, Homo sapiens
ggcgcgccagtcctatttatgtcattcatttctaccggtctctagtagtgcagcttcggctggtgtcatcggtgtctgaatgatttaattgcccccgcaaggcttcgccgtcatcgaggccatttccagcgacttgtcgcacgcttttctatatacttcgttccccgccaaccgcaaccattgacgcccgactcggaccgatg

SEQ ID NO: 11584 - DNA, 203 bp, Homo sapiens
ggcgcgccagtccttggttcaacattcatttctaggttctctattatctgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgcccgactcggaccgatg

SEQ ID NO: 11585 - DNA, 203 bp, Homo sapiens
ggcgcgccagtcctaccttacgcatttgggccttacgagcccacaggccccggagtagcagcggggaggccgggagcccgcgggccggagccgcccggccgaggcgtgggggctgcggatgtactttgagactgggggcgacttgagcgttgagggcgcgcggggaggcgagccaccatgttcagccacgactcggaccgatg

SEQ ID NO: 11586 - DNA, 203 bp, Homo sapiens
ggcgcgccagtcctttactgtccatttgggccttacgagcccacaggccccggagtagcagctactgataacccttcccgcgggccggagccgcccggccgaggcgtgggggctgcggggccggcccatccgtgggggcgacttgagcgttgagggcgcgcggggaggcgagccaccatgttcagccacgactcggaccgatg

SEQ ID NO: 11587 - DNA, 203 bp, Homo sapiens
ggcgcgccagtcctactgtgcaccaaaacgaggggatatcagcttaccgaggccgcaggttttcctagtccctaccgatcgccccaagctgacatccccgggcccggaatgcggctctctgaccctctctgtgccctcccccgccccccgaaccaggcttggcgggcggaggcgccagcggatgtctccgactcggaccgatg

SEQ ID NO: 11588 - DNA, 203 bp, Homo sapiens
ggcgcgccagtcctctgctgaaccaaaacgaggggatatcagcttaccgaggccgcaggttttcctagtccctacctcatagatatgtaggacatccccgggcccggaatgcggctctctgaccctctctgtgccctcccccgcccatgatgtagttgcaggcgggcggaggcgccagcggatgtctccgactcggaccgatg

SEQ ID NO: 11589 - DNA, 203 bp, Homo sapiens
ggcgcgccagtcctgtaactgcccaaaacgaggggatatcagcttaccgaggccgcaggttttcctagtccctacctcatagatatgtaggacatccccgggcccggaatgcggctctctgaccctctctgtgccctcccccgccccccgaaccaggcttaaattaacactaacccagcggatgtctccgactcggaccgatg

SEQ ID NO: 11590 - DNA, 203 bp, Homo sapiens
ggcgcgccagtcctccgtaagaccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcggttagacgacggcgcgactcggaccgatg

SEQ ID NO: 11591 - DNA, 203 bp, Homo sapiens
ggcgcgccagtcctcgggcgcaccaaaacgaggggatatcagcttaccgaggccgcaggttttcctagtccctacctcatagatatgtaggacatccccgggccgctctacatatgagctgaccctctctgtgccctcccccgccccccgaaccaggcttggcgggcggaggcgccagcggatgtctccgactcggaccgatg

SEQ ID NO: 11592 - DNA, 203 bp, Homo sapiens
ggcgcgccagtccttctagttgccaaaacgaggggatatcagcttacctgtagttggcccactcctagtccctacctcatagatatgtaggacatccccgggcccggaatgcggctctctgaccctctctgtgccctcccccgccccccgaaccaggcttggcgggcggaggcgccagcggatgtctccgactcggaccgatg

SEQ ID NO: 11593 - DNA, 203 bp, Homo sapiens
ggcgcgccagtccttcgcttcgccaaaatacctcattaccttaacgggttcagctgttaggattccagaaccttcttgaatggcaggccctgctctttgtcattttcctgctcatctactgcctgaccattatagggaatgttgtcatcatcaccgtggtgagccagggcctgcgactgcactcccctcgactcggaccgatg

SEQ ID NO: 11594 - DNA, 203 bp, Homo sapiens
ggcgcgccagtcctggaaagtgccaaaatacctccactgtgactaactttcagctgttaggaaagggcgtgtggggtgaatggcaggccctgctctttgtcattttcctgctcatctactgcctgaccattatagggaatgttgtcatcatcaccgtggtgagccagggcctgcgactgcactcccctcgactcggaccgatg

SEQ ID NO: 11595 - DNA, 203 bp, Homo sapiens
ggcgcgccagtcctttaaactcccaaaatacctccactgtgactaactttcagctgttaggattccagaaccttcttgaatggcaggccctgctctttgtcattttcctgctcatctactgcctgaccattatagggaatgttgtcatcatcaccgtggtcttggttacatactgactgcactcccctcgactcggaccgatg

SEQ ID NO: 11596 - DNA, 203 bp, Homo sapiens
ggcgcgccagtcctctttattgccaaaatacctccactgtgactaactttcagctgttaggattccagaaccttcttgaatggcaggccctgctctttgtcattttcctgctcatctactgcctgaccattatagggaatgttgtcatcatcaccgtggtgagccagggcctgcgactgagggatactcgactcggaccgatg

SEQ ID NO: 11597 - DNA, 203 bp, Homo sapiens
ggcgcgccagtcctgggaagctccaaaatacctccactgtgactaactttcagctgttaggattccagaaccttcttgaatggcaggccctgctctttgtcattttcctgctcatctactgcctgaccattatagggaatgttgtcatcatcaccgtggtgagccagggcctgcgactgcactcccctcgactcggaccgatg

SEQ ID NO: 11598 - DNA, 203 bp, Homo sapiens
ggcgcgccagtcctgatggtgaccaaaatacctccactgtgactaactttcagctgttaggattccagaaccttcttgaatggcaggccctgctctttgtcattttcctgctcatctactgcctgaccattatagggaatgttgtctagggagtaccctagagccagggcctgcgactgcactcccctcgactcggaccgatg

SEQ ID NO: 11599 - DNA, 203 bp, Homo sapiens
ggcgcgccagtcctggtatagcccaaaatacctccactgtgactaactttcagctgttaggattccagaaccttcttgaatggcaggccctgctctttgtcattttcctgctcatctagaaaagtgaggaactagggaatgttgtcatcatcaccgtggtgagccagggcctgcgactgcactcccctcgactcggaccgatg

SEQ ID NO: 11600 - DNA, 203 bp, Homo sapiens
ggcgcgccagtccttaatccagccaacagaaagtctgcaagcaatgccatgaggtcctgaccagagggtcttctgccaatgcctccaagtggtcaccacctcagaactataagaagcgaagtcggaagagataagccaagcaaaagcccagcacttcccagagccagggactgacacgacaagaccagcgactcggaccgatg

SEQ ID NO: 11601 - DNA, 203 bp, Homo sapiens
ggcgcgccagtccttttcgtccccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagcgactcggaccgatg

SEQ ID NO: 11602 - DNA, 203 bp, Homo sapiens
ggcgcgccagtcctggccaaatccaacctactaacaggtgggtgggtagacctcagcaggaaactcagttcttctcatggggtttctctgagctccattcataccagaaagggagcaggagagagaggacaagtggatccaacagccttcgctccaggggaatcagggcatcgcctccttttctgggacgactcggaccgatg

SEQ ID NO: 11603 - DNA, 203 bp, Homo sapiens
ggcgcgccagtccttatggctgccaacctactaacaggtgggtgggtatggtgtgtggtttcactcagttcttctcatggggtttctctgagctccattcatacactgggtccttgcagagagagaggacaagtggatccaacagccttcgctccaggggaatcagggcatcgcctccttttctgggacgactcggaccgatg

SEQ ID NO: 11604 - DNA, 203 bp, Homo sapiens
ggcgcgccagtccttgtgtgggccaacctactaacaggtgggtgggtatggtgtgtggtttcactcagttcttctcatggggtttctctgagctccattcataccagaaagggagcagcgttcgcgttcagggtggatccaacagccttcgctccaggggaatcagggcatcgcctccttttctgggacgactcggaccgatg

SEQ ID NO: 11605 - DNA, 203 bp, Homo sapiens
ggcgcgccagtcctagaggagaccaacctactaacaggtgggtgggtatggtgtgtggtttcactcagttcttctcatggggtttctctgagctccattcataccagaaagggagcaggagagagaggacaagtggatccaacagccttcgctccaggggtgagcctaaccatgctccttttctgggacgactcggaccgatg

SEQ ID NO: 11606 - DNA, 203 bp, Homo sapiens
ggcgcgccagtcctcttgacagccaacctactaatgaacactcaacgttggtgtgtggtttcactcagttcttctcatggggtttctctgagctccattcataccagaaagggagcaggagagagaggacaagtggatccaacagccttcgctccaggggaatcagggcatcgcctccttttctgggacgactcggaccgatg

SEQ ID NO: 11607 - DNA, 203 bp, Homo sapiens
ggcgcgccagtcctcgagtaacccaactccacttatattggaagggatggacaggtggctcttgccctttagactacagttcccagcatgcccaggcgattgcgtcccagaaccgacgtcccaccgccttcccacatcggatcgcagggctcccaaaatggcctataacattcacgtgaatggagtcccgactcggaccgatg

SEQ ID NO: 11608 - DNA, 203 bp, Homo sapiens
ggcgcgccagtcctgtcaaatgccaactccactttgggctccctatcccttggacatatgtctgccctttagactacagttcccagcatgcccaggcgattgcgtcccagaaccgacgtcccaccgccttcccacatcggatcgcagggctcccaaaatggcctataacattcacgtgaatggagtcccgactcggaccgatg

SEQ ID NO: 11609 - DNA, 203 bp, Homo sapiens
ggcgcgccagtcctattacggaccaactccactttgggctccctatccggacaggtggctcttgccctttagactacagttcccagcatgcccaggcgattgcgtcccagaaccgacgtcccaccgccttcccacatcggatcgcagggctcccaaaatggcctataacattcatcgtcccctgcagtcgactcggaccgatg

SEQ ID NO: 11610 - DNA, 203 bp, Homo sapiens
ggcgcgccagtcctctacgcggccaactccactttgggctccctatccggacaggtggctcttgccctttagactacagttcccagcatgcccaggcgattgcgtcccagaaccgacgtcccaccgccttccgtagcaccggacacgggctcccaaaatggcctataacattcacgtgaatggagtcccgactcggaccgatg

SEQ ID NO: 11611 - DNA, 203 bp, Homo sapiens
ggcgcgccagtcctcgattccaccaagccccttgggtcgcgtatctggctggatccagcctctccgcatcttgatccaagtttgctagggaggaggcatccctacaccctatgactacaggcctgattctcttctttcagtcagggcgacccttgggcgctggagtacgcttgggactggggctgcgacgactcggaccgatg

SEQ ID NO: 11612 - DNA, 203 bp, Homo sapiens
ggcgcgccagtcctgtgcagagccaagccccttgggtcgcgtatctggctggatccagcctctccgcatcttgatcttttcccctcttctaggaggcatccctaataagctgcggacaaggcctgattctcttctttcagtcagggcgacccttgggcgctggagtacgcttgggactggggctgcgacgactcggaccgatg

SEQ ID NO: 11613 - DNA, 203 bp, Homo sapiens
ggcgcgccagtcctccatacggccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttggactgtcaaagctatcgactcggaccgatg

SEQ ID NO: 11614 - DNA, 203 bp, Homo sapiens
ggcgcgccagtcctcggtcatcccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttgggactggggctgcgacgactcggaccgatg

SEQ ID NO: 11615 - DNA, 203 bp, Homo sapiens
ggcgcgccagtccttattgtgcccaataaactcagtattaaggcttgttgtgttggacaaggtgccctatttagggtgaggagccttactctagttgggtcaacatcctccattggataggaacagctatattgggtagttgtagcagttgtattcaaatgaatgcagcgttccgaaatatcatacctcgactcggaccgatg

SEQ ID NO: 11616 - DNA, 203 bp, Homo sapiens
ggcgcgccagtccttctcctgaccaataaactctggtgtaaggcttagagtgatggtcgaggtgccctatttagggcattctagaaaaagggcagccccaccaaatcctctattggataggaacagctgtactgggcagttacagcagtcgtatggtaacacatgcggcgttccgaaataccatgcctcgactcggaccgatg

SEQ ID NO: 11617 - DNA, 203 bp, Homo sapiens
ggcgcgccagtccttttagctaccaataaactctggtgtaaggcttagagtgatggtcgaggtgccctatttagggtgaggagcctcggtggcagccccaccaaatcctctattggataggaacagctgtactgggcagttacagcagtcgtatggtaaccatgatccacacgagaaataccatgcctcgactcggaccgatg

SEQ ID NO: 11618 - DNA, 203 bp, Homo sapiens
ggcgcgccagtcctgaccatgtccaataaactctggtgtaaggcttagagtgatggtcgaggtgccctatttagggtgaggagcctcggtggcagccccaccaaatcctctattggataggaacagctgtactgggcagttacagcgcggcatcaaatggacatgcggcgttccgaaataccatgcctcgactcggaccgatg

SEQ ID NO: 11619 - DNA, 203 bp, Homo sapiens
ggcgcgccagtcctgccgcgggccaataaactctggtgtaaggcttagagtgatggtcgaggtgccctatttagggtgaggagcctcggtggcagccccaccaacaaggtgtagcagcaggaacagctgtactgggcagttacagcagtcgtatggtaacacatgcggcgttccgaaataccatgcctcgactcggaccgatg

SEQ ID NO: 11620 - DNA, 203 bp, Homo sapiens
ggcgcgccagtcctagttagcgccaataaactctggtgtaaggcttaggtatcctcctcccctgccctatttagggtgaggagcctcggtggcagccccaccaaatcctctattggataggaacagctgtactgggcagttacagcagtcgtatggtaacacatgcggcgttccgaaataccatgcctcgactcggaccgatg

SEQ ID NO: 11621 - DNA, 203 bp, Homo sapiens
ggcgcgccagtccttcacccgcccaataaacttgaatgtaaggcttgaaacagtggtctaggtgccctatttagggtgaggagcctagctggcagccccagtgaatcctctattggatagaaaccgctatatcgggtagctatagcagtcggatagtaatatatccggcgtttcgaaataccatacctcgactcggaccgatg

SEQ ID NO: 11622 - DNA, 203 bp, Homo sapiens
ggcgcgccagtcctcataaataccaataaacttgaatgtaaggcttgaaacagtggtctaggtgccctatttagggtgaggagcctagctggcagccccagtgaatcctctattggatagaaaccgctatatcgggtagctatagcagtcggatagtaatatatccggcgtttctcgcccgggagtggcgactcggaccgatg

SEQ ID NO: 11623 - DNA, 203 bp, Homo sapiens
ggcgcgccagtcctagtccgccccaataaacttggtgtcgtactccagaacagtggtctaggtgccctatttagggtgaggagcctagctggcagccccagtgaatcctctattggatagaaaccgctatatcgggtagctatagcagtcggatagtaatatatccggcgtttcgaaataccatacctcgactcggaccgatg

SEQ ID NO: 11624 - DNA, 203 bp, Homo sapiens
ggcgcgccagtcctgaacctggccaatcggtgtgctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggcgactcggaccgatg

SEQ ID NO: 11625 - DNA, 203 bp, Homo sapiens
ggcgcgccagtccttgaaaccaccacaagccacagcgctgagctgcaggcgcggcgaaacttccctctacccgcccggcccgcggcgcgcaccgttggcgctggacgcttcctccttggaagcgcctctccctcagttatggagaaaacttgtatagatgcacttcctcttacttcactccagatccgcgactcggaccgatg

SEQ ID NO: 11626 - DNA, 203 bp, Homo sapiens
ggcgcgccagtccttgttatggccacaagccacagcgctgagctgcaggcgcggcgaaacttccctctacccgcccggcccgcggcgcgcaccgttggcgctggacgcttcctccttggaagcgcctctccctcagttatggagaacctggtatgtacctcacttcctcttactatgaattcttcagacgactcggaccgatg

SEQ ID NO: 11627 - DNA, 203 bp, Homo sapiens
ggcgcgccagtcctgcccgtgaccacaagccacagcgctgagctgcaggcgcggcgaaacttccctctacccgcccggcccgcggcgcgcaccgttggcgctgggtctgggtctgccagaagcgcctctccctcagttatggagaaaacttgtatagatgcacttcctcttactatgaattcttcagacgactcggaccgatg

SEQ ID NO: 11628 - DNA, 203 bp, Homo sapiens
ggcgcgccagtccttcctggctccacaagccacagcgctgagctgcaggcgcggcgaaacttccctctacccgcccggcccgcggcgcgcggacagccgtgcttacgcttcctccttggaagcgcctctccctcagttatggagaaaacttgtatagatgcacttcctcttactatgaattcttcagacgactcggaccgatg

SEQ ID NO: 11629 - DNA, 203 bp, Homo sapiens
ggcgcgccagtccttgccgaccccacaagccacagcgctgagctgcaggcgcggcgaaacttccctctacccgccctagggttcaacgttaccgttggcgctggacgcttcctccttggaagcgcctctccctcagttatggagaaaacttgtatagatgcacttcctcttactatgaattcttcagacgactcggaccgatg

SEQ ID NO: 11630 - DNA, 203 bp, Homo sapiens
ggcgcgccagtcctgcgtgtaaccacaatgccgtggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagccgactcggaccgatg

SEQ ID NO: 11631 - DNA, 203 bp, Homo sapiens
ggcgcgccagtcctgacaaaccccacacgggcccgtcatgtgtgcaaccccagcacggcgacagattgtgaggtgtcactttaaagtgacattgaaactggtacccacacactggtgacaggctaaggatgcccttcaggtaccccgaggtaacacgcgacactcgggatctgagaaggggactggggcgactcggaccgatg

SEQ ID NO: 11632 - DNA, 203 bp, Homo sapiens
ggcgcgccagtccttcagaagaccacacgggcccgtcatgtgtgcaaccccagcacggcgactttactgcgaaacccactttaaagtgacattgaaactggtacccacacactggtgaagttaggcatcacgccttcaggtaccccgaggtaacacgcgacactcgggatctgagaaggggactggggcgactcggaccgatg

SEQ ID NO: 11633 - DNA, 203 bp, Homo sapiens
ggcgcgccagtccttggactgaccacacgggcccgtcatgtgtgcaaccccagcacggcgactttactgcgaaacccactttaaagtgacattgaaactggtacccacacactggtgacaggctaaggatgcccttcaggtaccccgaggtaacacgcgacactcgggatctgatctataagggcttccgactcggaccgatg

SEQ ID NO: 11634 - DNA, 203 bp, Homo sapiens
ggcgcgccagtcctgtttggacccacacgggcccgtcatgtgtgcaaccccagcacggcgactttactgcgaaacccactttaaagtgacattgaaactggtactgtttagagccgaccaggctaaggatgcccttcaggtaccccgaggtaacacgcgacactcgggatctgagaaggggactggggcgactcggaccgatg

SEQ ID NO: 11635 - DNA, 203 bp, Homo sapiens
ggcgcgccagtcctgcagattcccacacgggcccgtcatgtgtgcaaccccagcacggcgactttactgcgaaacccactttaaagtgacgggatggaaatgttccacacactggtgacaggctaaggatgcccttcaggtaccccgaggtaacacgcgacactcgggatctgagaaggggactggggcgactcggaccgatg

SEQ ID NO: 11636 - DNA, 203 bp, Homo sapiens
ggcgcgccagtcctatggacgcccacacgggcccgtcatgtgtgcaacggtctgcgatgttgtttactgcgaaacccactttaaagtgacattgaaactggtacccacacactggtgacaggctaaggatgcccttcaggtaccccgaggtaacacgcgacactcgggatctgagaaggggactggggcgactcggaccgatg

SEQ ID NO: 11637 - DNA, 203 bp, Homo sapiens
ggcgcgccagtcctggctttcaccaccagcctcggccagctggttgtggaccagccgtgaccgacctatcaggtttcaacctcaccgtccaatgggctgcagccacctctctccagtgaggtctgagacccagccttaacgaggctacccccttccaggtccggccgtagcacctccgcgccgtcgcccgactcggaccgatg

SEQ ID NO: 11638 - DNA, 203 bp, Homo sapiens
ggcgcgccagtcctacagatagccaccagcctcggccagctggttgtggaccagccgtgacctggggcaacccagccaacctcaccgtccaatgggctgcagccacctctctccagtgaggtctgagacccagccttaacgaggctacccccttccaggaatcatgacagcacctccgcgccgtcgcccgactcggaccgatg

SEQ ID NO: 11639 - DNA, 203 bp, Homo sapiens
ggcgcgccagtccttgcgtatcccaccagcctcggccagctggttgtggaccagccgtgacctggggcaacccagccaacctcaccgtccaatgggctgcagccacctctctccagtgaggtctgagacccagccttaacgaggctgagtttgcgagttgccggccgtagcacctccgcgccgtcgcccgactcggaccgatg

SEQ ID NO: 11640 - DNA, 203 bp, Homo sapiens
ggcgcgccagtccttactaccaccaccagcctcggccagctggttgtggaccagccgtgacctggggcaacccagccaacctcaccgtccaatgggctgcagccacctctctccagtgtaccagtttgaggtgccttaacgaggctacccccttccaggtccggccgtagcacctccgcgccgtcgcccgactcggaccgatg

SEQ ID NO: 11641 - DNA, 203 bp, Homo sapiens
ggcgcgccagtcctgattagatccaccagcctcggccagctggttgtggaccagccgtgacctggggcaacccagccaacctcaccgtccaatgggctgcagccggtctgacattaccaggtctgagacccagccttaacgaggctacccccttccaggtccggccgtagcacctccgcgccgtcgcccgactcggaccgatg

SEQ ID NO: 11642 - DNA, 203 bp, Homo sapiens
ggcgcgccagtccttcggatacccacccctaatgagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 11643 - DNA, 203 bp, Homo sapiens
ggcgcgccagtcctatagcaggccacggctagccttgacaaccgccagtgtgttcaagattcagaccagtgtttcaagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 11644 - DNA, 203 bp, Homo sapiens
ggcgcgccagtcctgacatattccactaccagccaacaagtcacgggcgtcgagacaactatttttgaggtatctgaggctaccccacagcactctctggcattggcaagactcgtggctgtgacccatgggcctctgaggaggcgttgtaagtccgcccagctccccacttgctgtgctctcactcacgactcggaccgatg

SEQ ID NO: 11645 - DNA, 203 bp, Homo sapiens
ggcgcgccagtcctgcctggtcccactaccagccggagccagggcctggtcgagacaactatttttgaggtatctgaggctaccccacagcactctctggcattataggcgaggacacctgtgacccatgggcctctgaggaggcgttgtaagtccgcccagctccccacttgctgtgctctcactcacgactcggaccgatg

SEQ ID NO: 11646 - DNA, 203 bp, Homo sapiens
ggcgcgccagtcctaagtctgaccactaccagccggagccagggcctggtcgagacaactatttttgaggtatctgaggctaccccacagcactctctggcattggcaagactcgtggctgtgacccatgggcctctgaggaggcgttgtaagtccgcccagctccccacttgcaagtaaggtgtaagcgactcggaccgatg

SEQ ID NO: 11647 - DNA, 203 bp, Homo sapiens
ggcgcgccagtcctagtctacaccactaccagccggagccagggcctggtcgagacaactatttttgaggtatctgaggctaccccacagcactctctggcattggcaagactcgtggctgtgacccatgggcctctgaggaggcgttgtaagtccgcccgatcgaggtgcatatgtgctctcactcacgactcggaccgatg

SEQ ID NO: 11648 - DNA, 203 bp, Homo sapiens
ggcgcgccagtcctatcaagagccactaccagccggagccagggcctggtcgagacaactatttttgaggtatctgaggctaccccacagcactctctggcattggcaagactcgtggtctgtctgggaaaacctctgaggaggcgttgtaagtccgcccagctccccacttgctgtgctctcactcacgactcggaccgatg

SEQ ID NO: 11649 - DNA, 203 bp, Homo sapiens
ggcgcgccagtcctataaagttccactaccagccggagccagggcctggtcgagacaactatttttgaggtatctgtctaacggagcatacactctctggcattggcaagactcgtggctgtgacccatgggcctctgaggaggcgttgtaagtccgcccagctccccacttgctgtgctctcactcacgactcggaccgatg

SEQ ID NO: 11650 - DNA, 203 bp, Homo sapiens
ggcgcgccagtcctctgcaataccagaactttacacagaaaaggtgctcaaaggatatttgtttaatgaatgtggtatgctgacatttaaacaggacaaaacttgtagaacttcatggaggaacacggagtgacccaaaccgaacatatggctaccatagaagcacatgcagtgctgggtggttgaagcgactcggaccgatg

SEQ ID NO: 11651 - DNA, 203 bp, Homo sapiens
ggcgcgccagtcctgaattccgccagaactttacacagaaaaggtgctcaaaggatatttgtttaatgaatgtggtatgctgacatttaaacaggacaaaacttgtagaacttcatggaggaacacggagtgacccaaaccgaacatatggctaccatagaagcacatgcagtggcccagcaagtgcacgactcggaccgatg

SEQ ID NO: 11652 - DNA, 203 bp, Homo sapiens
ggcgcgccagtccttcttcacgccagaactttacacagaaaaggtgctcaaaggatatttgtttaatgaatgtggtatgctgacatttaagttacctccgtagcgtagaacttcatggaggaacacggagtgacccaaaccgaacatatggctaccatagaagcacatgcagtggcccagcaagtgcacgactcggaccgatg

SEQ ID NO: 11653 - DNA, 203 bp, Homo sapiens
ggcgcgccagtcctaccaactgccagaagacagcggggcgttccttgctgcatttctattggttggcgtttgttactcccagccaatagaaagtgagcgcaactttttatgccaaaatggcgatgcctaccacctagaactggattgtgcgctggccgccaccgctgccacctgctcagagtgaaatacgactcggaccgatg

SEQ ID NO: 11654 - DNA, 203 bp, Homo sapiens
ggcgcgccagtcctaatcacttccagaagacagcggggcgttccttgctgcatttctattggttggcgtttgttactcccagccaatagaaagtgagcttcttgacaagtgccaaaattagccctaacgaggcctagaactggattgtgcgctggccgccaccgctgccacctgctcagagtgaaatacgactcggaccgatg

SEQ ID NO: 11655 - DNA, 203 bp, Homo sapiens
ggcgcgccagtccttgaaccacccagaatcaagtgttccgcgtgattgaagacaccccctcgcttcgagcctgtctgcacatccaataaaatagctggattataactcctcttctttctctgggggccgtggggtgggagctggggcgagaggtgccgttggcccccgttgcttttcctctgggaaggcgactcggaccgatg

SEQ ID NO: 11656 - DNA, 203 bp, Homo sapiens
ggcgcgccagtcctttgtcctgccagaatcaagtgttccgcgtgattgaagacaccccctcgtccaagaatgcaaacgggccgtggggttatagctggattataactcctcttctttctctgggggccgtggggtgggagctggggcgagaggtgccgttggcccccgttgcttttcctctgggaaggcgactcggaccgatg

SEQ ID NO: 11657 - DNA, 203 bp, Homo sapiens
ggcgcgccagtccttctctgagccagaatcaagtgttccgcgtgattgaagacaccccctcgtccaagaatgcaaagcacatccaataaaatagctggattataactcctcttctttcatccccaaggtataggtgggagctggggcgagaggtgccgttggcccccgttgcttttcctctgggaaggcgactcggaccgatg

SEQ ID NO: 11658 - DNA, 203 bp, Homo sapiens
ggcgcgccagtcctagattcgtccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttaattctatttcgcacgactcggaccgatg

SEQ ID NO: 11659 - DNA, 203 bp, Homo sapiens
ggcgcgccagtccttcgatcgtccagaatcaagtgttccgcgtgattgaagacaccccctcgtccaagaatgcaaagcacatccaataaaggcttacccacgccactcctcttctttctctgggggccgtggggtgggagctggggcgagaggtgccgttggcccccgttgcttttcctctgggaaggcgactcggaccgatg

SEQ ID NO: 11660 - DNA, 203 bp, Homo sapiens
ggcgcgccagtccttctatgctccagaatcaagtgttccgcgtgattgtcactcagttagactccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 11661 - DNA, 203 bp, Homo sapiens
ggcgcgccagtcctaatctttaccagacagtggctcagccttcaggacctgagcttccagcagccgaagacacctattcacacaagatggtaaaaacaaatcataggcgctgtcgcacaaaattcacagaagaacagttgaaaatcctcatcaataccttcaatcaaaagccttacccaggttatgctcgactcggaccgatg

SEQ ID NO: 11662 - DNA, 203 bp, Homo sapiens
ggcgcgccagtcctacttgtcaccagacagtggctcagccttcaggactctcttccagcatggccgaagacacctattcacacaagatggtaaaaacaaatcataggcgctgtcgcacaaaattcacagaagaacagttgaaaatcctcatcaataccttcaatcaaaagccttacccaggttatgctcgactcggaccgatg

SEQ ID NO: 11663 - DNA, 203 bp, Homo sapiens
ggcgcgccagtcctgtcgtcaaccagacagtggctcagccttcaggactctcttccagcatggccgaagacacctattcacacaagatggtaaaaacaaatcataggcgctgtcgcacaaaattcacagaagcttgtaacgtggaactcatcaataccttcaatcaaaagccttacccaggttatgctcgactcggaccgatg

SEQ ID NO: 11664 - DNA, 203 bp, Homo sapiens
ggcgcgccagtcctactccagcccagccttgaactcgctggacagagcgttgctttctctaagcctggaagtgcccgctgagaaagggagaagacagcagaggggttgccgagagcatatatcagagggaccccctgaagctggtggccactttcagacaaatacttcaaggagagaaaaaagctgttcgactcggaccgatg

SEQ ID NO: 11665 - DNA, 203 bp, Homo sapiens
ggcgcgccagtccttaaggaacccagccttgaactcgctggacagagctacagacctatggggcctggaagtgccccggagttcctcttcaagacagcagaggggttgccgagagcatatatcagagggaccccctgaagctggtggccactttcagacaaatacttcaaggagagaaaaaagctgttcgactcggaccgatg

SEQ ID NO: 11666 - DNA, 203 bp, Homo sapiens
ggcgcgccagtcctatcccgtgccagccttgaactcgctggacagagctacagacctatggggcctggaagtgcccgctgagaaagggagaagacagcagaggggttgccgagagcatatatcagagggaccccctgaagctggtggccactttcagacaaatacttcaaggaggcggtggcctcacgcgactcggaccgatg

SEQ ID NO: 11667 - DNA, 203 bp, Homo sapiens
ggcgcgccagtcctgcgctgggccagccttgaactcgctggacagagctacagacctatggggcctggaagtgcccgctgagaaagggagaagacagcagaggggttgccgagagcatatatcagagggaccccctgaagctggtggccactttcagacagtgctgcatgacctagaaaaaagctgttcgactcggaccgatg

SEQ ID NO: 11668 - DNA, 203 bp, Homo sapiens
ggcgcgccagtcctatgttccaccagccttgaactcgctggacagagctacagacctatggggcctggaagtgcccgctgagaaagggagaagacagcagagggtaccgttgcccgtaatatcagagggaccccctgaagctggtggccactttcagacaaatacttcaaggagagaaaaaagctgttcgactcggaccgatg

SEQ ID NO: 11669 - DNA, 203 bp, Homo sapiens
ggcgcgccagtcctcaccacaaccagctgattaccgacgagaattcaacctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcacccgactcggaccgatg

SEQ ID NO: 11670 - DNA, 203 bp, Homo sapiens
ggcgcgccagtcctcgtttgttccagctgattacttgtcctgcgagttcctcttgagactggccgaaaggcagccacggggccaccaaggcggcgcagcgctgcatgcggcaaggggaaaaatccttcgggtagggttatcctcttatcccttcccttaggagcatgagtgtggtcgacacattcacccgactcggaccgatg

SEQ ID NO: 11671 - DNA, 203 bp, Homo sapiens
ggcgcgccagtcctaaatggcaccagctgattacttgtcctgcgagttcctcttgagactggccgaaaggcagccacggggccaccaaggcggcgcagcgctgcatgcggcaaggggaaaaatccttcgggtgacccctggtggcaatcccttcccttagatagggcgtgaacctcgacacattcacccgactcggaccgatg

SEQ ID NO: 11672 - DNA, 203 bp, Homo sapiens
ggcgcgccagtccttggcattcccagctgattacttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtgggtactgatgcagagcgactcggaccgatg

SEQ ID NO: 11673 - DNA, 203 bp, Homo sapiens
ggcgcgccagtcctcccaccgaccagctgattacttgtcctgcgagttcctcttgagactggccgaaaggcagccacggggccaccaaggcggcgcagcgctgcatgcggcaaggggactttaggagttcaggacccctggtggcaatcccttcccttaggagcatgagtgtggtcgacacattcacccgactcggaccgatg

SEQ ID NO: 11674 - DNA, 203 bp, Homo sapiens
ggcgcgccagtcctctcttctaccagctgattacttgtcctgcgagttcctcttgagactggccgaaaggcagccacggggccaccaaggcggcgcagcgctgctgcgtatgttttagaaaatccttcgggtgacccctggtggcaatcccttcccttaggagcatgagtgtggtcgacacattcacccgactcggaccgatg

SEQ ID NO: 11675 - DNA, 203 bp, Homo sapiens
ggcgcgccagtcctacatactcccaggccgccccgaggcttggggtctctcccactcccagagcgcccggggccgaacagcgggggcacacggggcgctgccgaagtgcaaggccacggccagagctcgagcccgacgcgctgtctggagtcgtaggaccctgacgtggctgaagcggccccgggagccgactcggaccgatg

SEQ ID NO: 11676 - DNA, 203 bp, Homo sapiens
ggcgcgccagtcctgagcattgccaggccgccccgaggcttggggtcttcgaaggataatcggcgcccggggccgaacagcgggggcacacggggcgctgccgaagtgcaaggccacggccagagctcgagcccgacgcgctgtctcttccgcggcttagctgacgtggctgaagcggccccgggagccgactcggaccgatg

SEQ ID NO: 11677 - DNA, 203 bp, Homo sapiens
ggcgcgccagtccttgtaagagccaggccgccccgaggcttggggtcttcgaaggataatcggcgcccggggccgatttcgctacaagagcggggcgctgccgaagtgcaaggccacggccagagctcgagcccgacgcgctgtctggagtcgtaggaccctgacgtggctgaagcggccccgggagccgactcggaccgatg

SEQ ID NO: 11678 - DNA, 203 bp, Homo sapiens
ggcgcgccagtcctggtgtacgccaggtgcgtacgcgacggagcggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggcgactcggaccgatg

SEQ ID NO: 11679 - DNA, 203 bp, Homo sapiens
ggcgcgccagtccttatgacacccaggtgcgtacgcgacggagcggggtgtgaagatggcggctcccagactatgacaggagaggttgagttgcggcgaaggcggctgcgtcgcggagctgcagcgcctgggcgagcggctccaggagctggagctacagctgcgggagagccgggtaccggccgtggcgactcggaccgatg

SEQ ID NO: 11680 - DNA, 203 bp, Homo sapiens
ggcgcgccagtcctgtcctggcccagttcccatgcgacaagaacagtttcgaatcggaagcttgcttaacgtagttctaacagttttttattagagagcagatctctgatgaacaaccaacggaaaaagacgggtcgaccgtctttcaatatgctgaaacgcgcgagaaaccgcgtgtcaactgtttccgactcggaccgatg

SEQ ID NO: 11681 - DNA, 203 bp, Homo sapiens
ggcgcgccagtcctacccaagtccatgagggggatccaatttaggaaacattctgtttaagagttgacaaggtctcaatgaataatggacaagcaacaattacaagaaatggaggaaggttcgaaatcaggtgtcgtcacttggaccgtgactacaccatgccactaccaaatgctactagtaatgatcgactcggaccgatg

SEQ ID NO: 11682 - DNA, 203 bp, Homo sapiens
ggcgcgccagtccttccactccccattggacctctcaagacttgattgatgcaattcaaaattttctacaacatctaggtattactgatgggcgcaggcttcagtatatattagtgtcataacactcaatcctaatgcttaccacatcatcaaactattaactcaaacaattcaagccatgggacaaacgactcggaccgatg

SEQ ID NO: 11683 - DNA, 203 bp, Homo sapiens
ggcgcgccagtcctcacggatgccattttgtgaagagacgaagactgactatcaggcagatgatttctggcctcgagccgcagtcagcttctccccgtagaacccggcagtaggagacttagaatcgaatctcttctccctcccgcctcctgtttttggctttttgagaaaccttatcatccaacacacgactcggaccgatg

SEQ ID NO: 11684 - DNA, 203 bp, Homo sapiens
ggcgcgccagtccttaaagtaaccattttgtgaagagacgaagactgagctgttttggctgcatttctggcctcgaatgcataaatcagcctccccgtagaacccggcagtaggagacttagaatcgaatctcttctccctcccgcctcctgtttttggctttttgagaaaccttatcatccaacacacgactcggaccgatg

SEQ ID NO: 11685 - DNA, 203 bp, Homo sapiens
ggcgcgccagtcctcgacacagccattttgtgaagagacgaagactgagctgttttggctgcatttctggcctcgagccgcagtcagcttctccccgtagaacccggcagtaggagacactcccctccgctgcttctccctcccgcctcctgtttttggctttttgagaaaccttatcatccaacacacgactcggaccgatg

SEQ ID NO: 11686 - DNA, 203 bp, Homo sapiens
ggcgcgccagtcctggttagtcccattttgtgaagagacgaagactgagctgttttggctgcatttctggcctcgagccgcagtcagcttctccccgtagaacccggcagtaggagacttagaatcgaatctcttctccctcccgcaaatgtagccctcatttttgagaaaccttatcatccaacacacgactcggaccgatg

SEQ ID NO: 11687 - DNA, 203 bp, Homo sapiens
ggcgcgccagtccttaggtggacccaatagatcactaatacatagcacttatttctcttgctttacggcaggtgaagtaagaagagccatcagaggggaaaagttattgtcctgctgcaactatccccaagctcataaagcacaggtaccatcacttcaatacctagccctagtagtagtacaacaaacgactcggaccgatg

SEQ ID NO: 11688 - DNA, 203 bp, Homo sapiens
ggcgcgccagtcctcgcgtggacccacccggcaggggaggcggcctaacgactctttcactgggtcgccatcttggtcccgggactccaaggaacttaggaatttagtctgcttaggtgagagtctgtaccacctgggaactgccaaagcaacacagtgtctgagaaaggtcctgttttgggccttctcgactcggaccgatg

SEQ ID NO: 11689 - DNA, 203 bp, Homo sapiens
ggcgcgccagtcctgatgccagcccacccggcaggggaggcggcctaagccacagcagcagcccaacaatctcctatcccgggactccaaggaacttaggaatttagtctgcttaggtgagagtctgtaccacctgggaactgccaaagcaacacagtgtctgagaaaggtcctgttttgggccttctcgactcggaccgatg

SEQ ID NO: 11690 - DNA, 203 bp, Homo sapiens
ggcgcgccagtcctggattatccccacccggcaggggaggcggcctaagccacagcagcagcggtcgccatcttggtcccgggactccaaggaacttaggaattctcctgttagcaaagagagtctgtaccacctgggaactgccaaagcaacacagtgtctgagaaaggtcctgttttgggccttctcgactcggaccgatg

SEQ ID NO: 11691 - DNA, 203 bp, Homo sapiens
ggcgcgccagtcctagaaccgacccacccggcagtatctagcttaatggccacagcagcagcggtcgccatcttggtcccgggactccaaggaacttaggaatttagtctgcttaggtgagagtctgtaccacctgggaactgccaaagcaacacagtgtctgagaaaggtcctgttttgggccttctcgactcggaccgatg

SEQ ID NO: 11692 - DNA, 203 bp, Homo sapiens
ggcgcgccagtcctaggagtgtcccattgttccactagaatgctcatagcaggctcctccggaagaccaggggcagacggggcggtggcggggtcgtgcccagtgggaggggtcgggtctgcccaatgggttctcccgggcggggggcggggctctatttcagcagctctcagggccttgggctcatccgactcggaccgatg

SEQ ID NO: 11693 - DNA, 203 bp, Homo sapiens
ggcgcgccagtccttcccataacccattgttccaggcaggattcagccatgtaacataagttaagaccaggggcagacggggcggtggcggggtcgtgcccagtgggaggggtcgggtctgcccaatgggttctcccgggcggggggcggggctctatttcagcagctctcagggccttgggctcatccgactcggaccgatg

SEQ ID NO: 11694 - DNA, 203 bp, Homo sapiens
ggcgcgccagtcctcccgagctcccattgttccaggcaggattcagccgcaggctcctccggaagaccaggggcagacggggcggtggcggggtcgtgcccagtgggaggggtcgggtctgcccaatgggttctcccgggcgggggagcccttagcgacccagcagctctcagggccttgggctcatccgactcggaccgatg

SEQ ID NO: 11695 - DNA, 203 bp, Homo sapiens
ggcgcgccagtcctggtccgtgcccattgttccaggcaggattcagccgcaggctcctccggaagaccaggggcagacggggcggtggcgtatgttaatagctggggaggggtcgggtctgcccaatgggttctcccgggcggggggcggggctctatttcagcagctctcagggccttgggctcatccgactcggaccgatg

SEQ ID NO: 11696 - DNA, 203 bp, Homo sapiens
ggcgcgccagtcctttatgtgacccattgttccaggcaggattcagccgcaggctcctccgggttcggttcctggcacggggcggtggcggggtcgtgcccagtgggaggggtcgggtctgcccaatgggttctcccgggcggggggcggggctctatttcagcagctctcagggccttgggctcatccgactcggaccgatg

SEQ ID NO: 11697 - DNA, 203 bp, Homo sapiens
ggcgcgccagtcctatgtgagaccccaacaatcgactcagcttcaaaaagtgcgctcgccgtcggctctacctgcgtgctttagctccttctcgcctgatccttctgtctctcccaaccccggacacccggcttcgactggttatatcttcggtgttcttttcctctcttcttctttcgcggttcagccgactcggaccgatg

SEQ ID NO: 11698 - DNA, 203 bp, Homo sapiens
ggcgcgccagtcctcagtatttccccaacaatcgctgtgtgccgctttagtgcgctcgccgtaatagtccgaccattgctttagctccttctcgcctgatccttctgtctctcccaaccccggacacccggcttcgactggttatatcttcggtgttcttttcctctcttcttctttcgcggttcagccgactcggaccgatg

SEQ ID NO: 11699 - DNA, 203 bp, Homo sapiens
ggcgcgccagtccttccctgtaccccaacaatcgctgtgtgccgctttagtgcgctcgccgtcggctctacctgcggctggctataatggctcgcctgatccttctgtctctcccaaccccggacacccggcttcgactggttatatcttcggtgttcttttcctctcttcttctttcgcggttcagccgactcggaccgatg

SEQ ID NO: 11700 - DNA, 203 bp, Homo sapiens
ggcgcgccagtcctctttggcgccccaacaatcgctgtgtgccgctttagtgcgctcgccgtcggctctacctgcgtgctttagctccttctcgcctgatccttctgtctctcccaacaagttttcagaaaattcgactggttatatcttcggtgttcttttcctctcttcttctttcgcggttcagccgactcggaccgatg

SEQ ID NO: 11701 - DNA, 203 bp, Homo sapiens
ggcgcgccagtccttatactgtccccaacaatcgctgtgtgccgctttagtgcgctcgccgtcggctctacctgcgtgctttagctccttctcgcctgatccttctgtctctcccaaccccggacacccggcaattcaactgctgctcttcggtgttcttttcctctcttcttctttcgcggttcagccgactcggaccgatg

SEQ ID NO: 11702 - DNA, 203 bp, Homo sapiens
ggcgcgccagtcctcggagaccccccaacaatcgctgtgtgccgctttagtgcgctcgccgtcggctctacctgcgtgctttagctccttctcgcctgatccttctgtctctcccaaccccggacacccggcttcgactggttatagtcatacatcaaagttcctctcttcttctttcgcggttcagccgactcggaccgatg

SEQ ID NO: 11703 - DNA, 203 bp, Homo sapiens
ggcgcgccagtcctaagagacaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttcagcttgcagctgctcgactcggaccgatg

SEQ ID NO: 11704 - DNA, 203 bp, Homo sapiens
ggcgcgccagtcctgtacggccccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagccgactcggaccgatg

SEQ ID NO: 11705 - DNA, 203 bp, Homo sapiens
ggcgcgccagtcctctgcacacccccaacaatcgctgtgtgccgctttagtgcgctcgccgtcggctctacctgcgtgctttagctccttgcgaatatgaaaccctgtctctcccaaccccggacacccggcttcgactggttatatcttcggtgttcttttcctctcttcttctttcgcggttcagccgactcggaccgatg

SEQ ID NO: 11706 - DNA, 203 bp, Homo sapiens
ggcgcgccagtccttcacgcatccccatgccttccctttcacgcttccgtcctgacgcaaacccattaaatttcgacgcactgcgggcttgtccttggccctgccctactcagtttcctgaagcatgcgcagttgcctttccgtcaattcctgtcctgggcgtacgtcaagatggcggcgtctgtattcgactcggaccgatg

SEQ ID NO: 11707 - DNA, 203 bp, Homo sapiens
ggcgcgccagtcctgtggaccaccccatgccttccctttcacgcttccgtcctgacgcaaacgtggggccgccttcattgaacaatcgacgtccttggccctgccctactcagtttcctgaagcatgcgcagttgcctttccgtcaattcctgtcctgggcgtacgtcaagatggcggcgtctgtattcgactcggaccgatg

SEQ ID NO: 11708 - DNA, 203 bp, Homo sapiens
ggcgcgccagtcctagtattaaccccatgccttccctttcacgcttccgtcctgacgcaaacgtggggccgccttccgcactgcgggcttgtccttggccctgccctactcagtttcctgaagcatgcgcagaccagccagtcaatattcctgtcctgggcgtacgtcaagatggcggcgtctgtattcgactcggaccgatg

SEQ ID NO: 11709 - DNA, 203 bp, Homo sapiens
ggcgcgccagtcctactgcgtgccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatgaacatagtatagcacgactcggaccgatg

SEQ ID NO: 11710 - DNA, 203 bp, Homo sapiens
ggcgcgccagtccttaagattgccccatgccttccctttcacgcttccgtcctgacgcaaacgtggggccgccttccgcactgcgggcttgtccttggccctgcgtataatttcggtttgaagcatgcgcagttgcctttccgtcaattcctgtcctgggcgtacgtcaagatggcggcgtctgtattcgactcggaccgatg

SEQ ID NO: 11711 - DNA, 203 bp, Homo sapiens
ggcgcgccagtcctgcacctcaccccatgccttccctttcacgcttccgtcctgacgcaaacgtggggccgccttccgcactgcgggctttagtacaatatctgcctactcagtttcctgaagcatgcgcagttgcctttccgtcaattcctgtcctgggcgtacgtcaagatggcggcgtctgtattcgactcggaccgatg

SEQ ID NO: 11712 - DNA, 203 bp, Homo sapiens
ggcgcgccagtcctaggaacggccccatgccttcttcccggactcaatgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattcgactcggaccgatg

SEQ ID NO: 11713 - DNA, 203 bp, Homo sapiens
ggcgcgccagtcctgggagccacccccgccccccatgcgggaggttcctaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgcccgactcggaccgatg

SEQ ID NO: 11714 - DNA, 203 bp, Homo sapiens
ggcgcgccagtcctgcggatctcccccggttgactaggagctggcggttttctacaacaaagggaagaccgacgcgatgaagcccagacctgcagggttcgtggataataaactcaagcagcgagtcatccagtaccttaccagtaacaaatgtggcaaatatgtggacattggagtcttagcgtctgcgactcggaccgatg

SEQ ID NO: 11715 - DNA, 203 bp, Homo sapiens
ggcgcgccagtcctattgtcttcccccggttgactaggagctgggggtccgagctgtggcttatgtccttcggttcatgaagcccagacctgcagggttcgtggataataaactcaagcagcgagtcatccagtaccttaccagtaacaaatgtggcaaatatgtggacattggagtcttagcgtctgcgactcggaccgatg

SEQ ID NO: 11716 - DNA, 203 bp, Homo sapiens
ggcgcgccagtcctcctgggtccccccggttgactaggagctgggggtccgagctgtggcttggaagaccgacgcgatgaagcccagacctgcagggttcgtggataataaactcaagcagcgagtcatccagtaccttaccagtacgcctccgctgtggtatgtggacattggagtcttagcgtctgcgactcggaccgatg

SEQ ID NO: 11717 - DNA, 203 bp, Homo sapiens
ggcgcgccagtccttttagggtcccccggttgactaggagctgggggtccgagctgtggcttggaagaccgacgcgcgtcccgaagttggtgcagggttcgtggataataaactcaagcagcgagtcatccagtaccttaccagtaacaaatgtggcaaatatgtggacattggagtcttagcgtctgcgactcggaccgatg

SEQ ID NO: 11718 - DNA, 203 bp, Homo sapiens
ggcgcgccagtcctattacatgccccggtcaccgcgaggatgtagcacccctgtgcttataacctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 11719 - DNA, 203 bp, Homo sapiens
ggcgcgccagtcctccagctacccccggtcaccggccctgcccccgggattatctagacgcgcctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 11720 - DNA, 203 bp, Homo sapiens
ggcgcgccagtcctctcccaaaccccggtcaccggccctgcccccgggccctgtgcttataaaagccctactaggaccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 11721 - DNA, 203 bp, Homo sapiens
ggcgcgccagtcctgtgtttagccccggtcaccggccctgcccccgggccctgtgcttataacctgggatgggcacccctgccagtcctgaggccggaatctgtaccgctgcccgagcccgagtggttcactgcactgtgaaaacagattccagacgccgggaactcacgcctccaatcccagacgctcgactcggaccgatg

SEQ ID NO: 11722 - DNA, 203 bp, Homo sapiens
ggcgcgccagtcctgggtaaggccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctctccagggcttgtgacgactcggaccgatg

SEQ ID NO: 11723 - DNA, 203 bp, Homo sapiens
ggcgcgccagtcctatgggctgccccggtcaccggccctgcccccgggccctgtgcttataacctgggatgggcacccctgccagtcctgctctgccgcctgcctaattacggtattgccgagtggttcactgcactgtgaaaacagattccagacgccgggaactcacgcctccaatcccagacgctcgactcggaccgatg

SEQ ID NO: 11724 - DNA, 203 bp, Homo sapiens
ggcgcgccagtccttgcttgtgccccgtggccaaaagcccagtgtttacagcacctctcacatccaggacgaccccatcctggcgctcaccacctcggcgcctccttagtacgcattaggtggtaagccgagctctccctcggccttgttctgaatgcacacatgtctaggggctaaggatgtcctaccgactcggaccgatg

SEQ ID NO: 11725 - DNA, 203 bp, Homo sapiens
ggcgcgccagtcctccgtggtgccccgtggccaaaagcccagtgtttacagcacctctcacatccaggacgacccccgggccatcgcgcgtcttagtagtatggcttagtacgcattaggtggtaagccgagctctccctcggccttgttctgaatgcacacatgtctaggggctaaggatgtcctaccgactcggaccgatg

SEQ ID NO: 11726 - DNA, 203 bp, Homo sapiens
ggcgcgccagtcctcttcagatccccgtggccaatcatattcgtggatcagcacctctcacatccaggacgaccccatcctggcgctcactcttagtagtatggcttagtacgcattaggtggtaagccgagctctccctcggccttgttctgaatgcacacatgtctaggggctaaggatgtcctaccgactcggaccgatg

SEQ ID NO: 11727 - DNA, 203 bp, Homo sapiens
ggcgcgccagtcctcggcctccccccgttcttccaacatcctccgctggcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 11728 - DNA, 203 bp, Homo sapiens
ggcgcgccagtcctgcgtaattccccgttcttccctgcggagtgcgctcatttataaccgagtgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 11729 - DNA, 203 bp, Homo sapiens
ggcgcgccagtcctccgggcccccccgttcttccctgcggagtgcgctgcgccgcccagccctgtcgccccccggaggtgatccctccctcctgcctgcccgccagcctgacctgtgcccggctcgcgggccgcagcctcggccccctactctaaattcgagctctcggcgcgatgagcatagagacgcgactcggaccgatg

SEQ ID NO: 11730 - DNA, 203 bp, Homo sapiens
ggcgcgccagtcctcgagatgcccccgttcttccctgcggagtgcgctgcgccgcccagccctgtcgccccccggaggtgatccctccctcctgcctgcccgccagcctgacctgtgctacctgataaccgagcagcctcggcccccgcgcgcccccggcagctctcggcgcgatgagcatagagacgcgactcggaccgatg

SEQ ID NO: 11731 - DNA, 203 bp, Homo sapiens
ggcgcgccagtcctcaggaaatcccctcccaaaccacctcccaaatgggagataatggggggccccggccttaccaatcagcggtggaaaggtccattgcaatccctccaggaagcggccggggcagccttgctctccatagacggctccccccggtggatcccgtggcgattcctgaaaaaagctgccgactcggaccgatg

SEQ ID NO: 11732 - DNA, 203 bp, Homo sapiens
ggcgcgccagtccttcatgtaccccctcccaaaccacctcccaaatggttctattataaactccccggccttaccaatcagcggtggaaaaagaagcccagtctcctccaggaagcggccggggcagccttgctctccatagacggctccccccggtggatcccgtggcgattcctgaaaaaagctgccgactcggaccgatg

SEQ ID NO: 11733 - DNA, 203 bp, Homo sapiens
ggcgcgccagtcctagacggttcccctcccaaaccacctcccaaatggttctattataaactccccggccttaccaatcagcggtggaaaggtccattgcaatccctccaggaagcggccggggcagccttgctctccatagacggctccccccggtggatcccgtggcgattcctgaaaaaagctgccgactcggaccgatg

SEQ ID NO: 11734 - DNA, 203 bp, Homo sapiens
ggcgcgccagtcctgtgtgctacccctcccaaaccacctcccaaatggttctattataaactccccggccttaccaatcagcggtggaaaggtccattgcaatccctccaggaagcggccggggcagccttgctctccatagacggtgagaaggaaaaattcccgtggcgattcctgaaaaaagctgccgactcggaccgatg

SEQ ID NO: 11735 - DNA, 203 bp, Homo sapiens
ggcgcgccagtcctatgtagaccccctctaggttgaaggatgcccagaaggtacccgcaggtaacaagagacactgtggatctgatctggggccacctacctctatcctggtgaggtggttaaaaaacgtctagtgggccaaacccaggggggatccctggtttccttattttagtgtaaatgtcattcgactcggaccgatg

SEQ ID NO: 11736 - DNA, 203 bp, Homo sapiens
ggcgcgccagtccttaattagacccgaaaacacacccaactccacacaaacacccacagcatccgagccctctacatcaaattccacccaaaatacccaatcacatgcttagttattcaaaaactacatcttagcagaaaaccgtgacctatcaagcaagtcacggtaacctaatggggcaaataacccgactcggaccgatg

SEQ ID NO: 11737 - DNA, 203 bp, Homo sapiens
ggcgcgccagtccttattaagtcccgaaaacacaggtgcgcgatagataacacccacagcatccgagccctctacatcaaattccacccaaaatacccaatcacatgcttagttattcaaaaactacatcttagcagaaaaccgtgacctatcaagcaagaacgaaattaaacctggggcaaataacccgactcggaccgatg

SEQ ID NO: 11738 - DNA, 203 bp, Homo sapiens
ggcgcgccagtcctcgataacgcccgatcgtaaactccatgtattggttacccatctgcatcgaaaactctccgaacactaggtgcagtaaggctttcatggagcccggcctatgaccgcgtacgtgtaccataggcagccccaaaaacacgtgtgaggagaaagtcccagtcactttgggcaaagtacgactcggaccgatg

SEQ ID NO: 11739 - DNA, 203 bp, Homo sapiens
ggcgcgccagtcctccaacggccccgatcgtaaactccatgtattggttacccatctgcatcgaaaactctccgaacactaggtgcagtaaggctttcatggagtggtttgctatttagcgtacgtgtaccataggcagccccaaatttgacgcacgattgaaagtcccagtcactttgggcaaagtacgactcggaccgatg

SEQ ID NO: 11740 - DNA, 203 bp, Homo sapiens
ggcgcgccagtccttcgagagacccgcaggacgcgcctcccagccagcccgactcctaggaggaggggaggcgggaaagcagctcaagccagtagattgcgttcgcccccagccccgccactcccaggctcctcgggactcggcgggtcctcctgggagtctcggaggggaccggctgtgcagacgcccgactcggaccgatg

SEQ ID NO: 11741 - DNA, 203 bp, Homo sapiens
ggcgcgccagtcctgctacggtcccgcaggacgcgcctcccagccagcccgactcctaggaggaggggaggcgggaaagcagctcaagcctcacccaccgccctaaatgtttttttctcactcccaggctcctcgggactcggcgggtcctcctgggagtctcggaggggaccggctgtgcagacgcccgactcggaccgatg

SEQ ID NO: 11742 - DNA, 203 bp, Homo sapiens
ggcgcgccagtcctcatttaaacccgcaggacgcgcctcccagccagcccgactcctaggaggaggggaggcgggaaagcagctcaagcctcacccaccgccctgcccccagccccgccactcccaggctcctcgggacaacaactaacctcctgggagtctcggaggggaccggctgtgcagacgcccgactcggaccgatg

SEQ ID NO: 11743 - DNA, 203 bp, Homo sapiens
ggcgcgccagtcctcagcgctacccgcaggacgcgcctcccagccagcccgactcctaggaggaggggaggcgggaaagcagctcaagcctcacccaccgccctgcccccagccccgccactcccaggctcctcgggactcggcgggtcctcctgggagtaattccatttcatagctgtgcagacgcccgactcggaccgatg

SEQ ID NO: 11744 - DNA, 203 bp, Homo sapiens
ggcgcgccagtcctgggaaatccccgcaggacgcgcctcccagccagcccgactcctaggaggaggggaggcgggaaagcagctcaagcctcacccaccgccctgcccccagccccgctttcttgctagctttcgggactcggcgggtcctcctgggagtctcggaggggaccggctgtgcagacgcccgactcggaccgatg

SEQ ID NO: 11745 - DNA, 203 bp, Homo sapiens
ggcgcgccagtccttctcagtccccgccgccatgacgctgcgcgcggccgtcttcgaccttgacggggtgctggcgacagtgatctaaggcggcgtcctcggccgcacggaggaggccctggcgctgcccaggacttctgaatgatgctttccagaaagggggaccagagggtgccactacccggcttcgactcggaccgatg

SEQ ID NO: 11746 - DNA, 203 bp, Homo sapiens
ggcgcgccagtcctcttcatcacccgccgccatgacgctgcgcgcggccgtcttcgaccttgacggggtgctggcgctgccagcggtgttcggcgtcctcggccgcacggaggaggccggtcttaccaaggcgacttctgaatgatgctttccagaaagggggaccagagggtgccactacccggcttcgactcggaccgatg

SEQ ID NO: 11747 - DNA, 203 bp, Homo sapiens
ggcgcgccagtcctaagctcgacccgccgccatgacgctgcgcgcggccgtcttcgaccttgcaaattaaaataatctgccagcggtgttcggcgtcctcggccgcacggaggaggccctggcgctgcccaggacttctgaatgatgctttccagaaagggggaccagagggtgccactacccggcttcgactcggaccgatg

SEQ ID NO: 11748 - DNA, 203 bp, Homo sapiens
ggcgcgccagtccttgcgagtacccgccgccatgacgctgcgcgcggctaatccatttgactacggggtgctggcgctgccagcggtgttcggcgtcctcggccgcacggaggaggccctggcgctgcccaggacttctgaatgatgctttccagaaagggggaccagagggtgccactacccggcttcgactcggaccgatg

SEQ ID NO: 11749 - DNA, 203 bp, Homo sapiens
ggcgcgccagtcctcgcgactgcccgcctgccggcctgcctgccacagccggactccgccaccagccctacgagatccgcctgtcattccctagcccagctcttgggaaactgcagaggggtccagaggatttgcagttctgaacctgcacactccagtctaggatctccgagcaagagcgtagcctccgactcggaccgatg

SEQ ID NO: 11750 - DNA, 203 bp, Homo sapiens
ggcgcgccagtcctcacgtcagcccgcctgccggcctgcctgccacagccggactccgccactccggtaggattccccgcctgtcattccctagcccagctcttgggaaactgcagagacaggggtgtccactgcagttctgaacctgcacactccagtctaggatctccgagcaagagcgtagcctccgactcggaccgatg

SEQ ID NO: 11751 - DNA, 203 bp, Homo sapiens
ggcgcgccagtcctggcccttacccgcctgccggcctgcctgccacagccggactccgccactccggtaggattccccgcctgtcattccctagcccagctcttgggaaactgcagaggggtccagaggattccggtccagcctggtgcacactccagtctaggatctccgagcaagagcgtagcctccgactcggaccgatg

SEQ ID NO: 11752 - DNA, 203 bp, Homo sapiens
ggcgcgccagtcctcggtcgagcccgcctgccggcctgcctgccacagccggactccgccactccggtaggattccccgcctgtcattccctagcccagctcttgggaaactgcagaggggtccagaggatttgcagttctgaacctgcacactccagtcatattcgctttgtgaagagcgtagcctccgactcggaccgatg

SEQ ID NO: 11753 - DNA, 203 bp, Homo sapiens
ggcgcgccagtcctattccttccccgcctgccggcctgcctgccacagccggactccgccactccggtaggattccgacgagcagccgttctagcccagctcttgggaaactgcagaggggtccagaggatttgcagttctgaacctgcacactccagtctaggatctccgagcaagagcgtagcctccgactcggaccgatg

SEQ ID NO: 11754 - DNA, 203 bp, Homo sapiens
ggcgcgccagtcctgttgcctccccgcctgccggcctgcctgccacagtattctcattgatgtccggtaggattccccgcctgtcattccctagcccagctcttgggaaactgcagaggggtccagaggatttgcagttctgaacctgcacactccagtctaggatctccgagcaagagcgtagcctccgactcggaccgatg

SEQ ID NO: 11755 - DNA, 203 bp, Homo sapiens
ggcgcgccagtcctgttctaggcccggaaatctgacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagcgactcggaccgatg

SEQ ID NO: 11756 - DNA, 203 bp, Homo sapiens
ggcgcgccagtcctacatctgccccggctcggggtccgggctggggaggggaacctgggcgcctgggacccgccgatgccccctgccccgcccggaggtgaaagcgggtgtgaggagcgcggcgcggcaggtcatattgaacattccagatacctatcatcctgacgacacacagataacagcaagatcgactcggaccgatg

SEQ ID NO: 11757 - DNA, 203 bp, Homo sapiens
ggcgcgccagtcctggatcaagcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttacgcctttttgacacgactcggaccgatg

SEQ ID NO: 11758 - DNA, 203 bp, Homo sapiens
ggcgcgccagtcctaagaatgccccggctcggggtccgggctggggaggggaacctgggcgcctgggacccgccgatgccccctgccccgtggacccagatgtacgggtgtgaggagcgcggcgcggcaggtcatattgaacattccagatacctatcattactcgatgctgttgataacagcaagatcgactcggaccgatg

SEQ ID NO: 11759 - DNA, 203 bp, Homo sapiens
ggcgcgccagtcctgtgttcgtcccggctcggggtccgggctggggaggggaacctgggcgcggttcgtataggcttgccccctgccccgcccggaggtgaaagcgggtgtgaggagcgcggcgcggcaggtcatattgaacattccagatacctatcattactcgatgctgttgataacagcaagatcgactcggaccgatg

SEQ ID NO: 11760 - DNA, 203 bp, Homo sapiens
ggcgcgccagtcctgctgttaacccggggccaacatacgccgtggagcgcagcaagggctagggcttcctgaacctctccgggagaggtcctagcaaccctcgcggcccgccctaggagcattgtcttcccggggaagacaaacaattgggggctcgtccgggatttgaattcctccattctcacattcgactcggaccgatg

SEQ ID NO: 11761 - DNA, 203 bp, Homo sapiens
ggcgcgccagtccttgggacagcccggggccaacatacgccgtggagcgcagcaagggctagggcttcctgaacctctccgggagaggtctattgctataggcaggcccgccctaggacagcacaaggggttgggaagacaaacaattgggggctcgtccgggatttgaattcctccattctcacattcgactcggaccgatg

SEQ ID NO: 11762 - DNA, 203 bp, Homo sapiens
ggcgcgccagtccttcatagtgcccggggccaacatacgccgtggagcgcagcaagggctagggcttcctgaacctctccgggagaggtctattgctataggcaggcccgccctaggagcattgtcttcccggggaagacaaacaacgctaactagcaatgggatttgaattcctccattctcacattcgactcggaccgatg

SEQ ID NO: 11763 - DNA, 203 bp, Homo sapiens
ggcgcgccagtcctcgtacgatcccggggccaacatacgccgtggagcgcagcaagggctagggcttcctgaacctctccgggagaggtctattgctataggcaggcccgccctaggagcattgtcttcccggggaagacaaacaattgggggctcgtccgggatttgaattcctccattctcacattcgactcggaccgatg

SEQ ID NO: 11764 - DNA, 203 bp, Homo sapiens
ggcgcgccagtcctgcgggtggcccggggccaacatacgccgtggagcgcagcaagggctagggcttcctgaacctctccgggagaggtctattgctataggcaggcccgccctaggagcattgtcttcccgttcggctaggcaggttgggggctcgtccgggatttgaattcctccattctcacattcgactcggaccgatg

SEQ ID NO: 11765 - DNA, 203 bp, Homo sapiens
ggcgcgccagtcctgaactgctccctaaccaacccagctggacactccctccctgcaccatgtcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 11766 - DNA, 203 bp, Homo sapiens
ggcgcgccagtcctcaccaaggccctaactaggtacttgatcattatattaagaaaaacttaggatccaagaccataaatctaggatcctttacaatctcagaccctggtgcaaggttatatatagagcccaattctcctaattaaacagtgtctcaggttgacaaatggacaagttggatctagtcacgactcggaccgatg

SEQ ID NO: 11767 - DNA, 203 bp, Homo sapiens
ggcgcgccagtccttcctttgcccctaccccatccccttattcagcacatgaaataaacaaggggcatccaaatcttgcggcaacgcccccgggacatgcatcgcatagatcggatgatcaaaccccttatccctctggacagaatgcaggtccaaccacgctggtataccctcaaacccctcagacacgactcggaccgatg

SEQ ID NO: 11768 - DNA, 203 bp, Homo sapiens
ggcgcgccagtcctaattacggccctaccccatccccttattcagcacatgaaataaacaaggggcatccaaatcttgcggcaacgcccccgggacatgcatcgtcccctggactctcatgcggaagccgaacctctggacagaatgcaggtccaaccacgctggtataccctcaaacccctcagacacgactcggaccgatg

SEQ ID NO: 11769 - DNA, 203 bp, Homo sapiens
ggcgcgccagtcctggttccctccctaccccatccccttattcagcacatgaaataaacaaggggcatccaaatcttgcggcaacgcccccgggacatgcatcgtcccctggactctctcaaaccccttatccctctggacagaatgcaggtccaaccaccgcaactctagtcgaaacccctcagacacgactcggaccgatg

SEQ ID NO: 11770 - DNA, 203 bp, Homo sapiens
ggcgcgccagtccttgctatctccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcgtttgtaatgctgtcgactcggaccgatg

SEQ ID NO: 11771 - DNA, 203 bp, Homo sapiens
ggcgcgccagtccttgctgctaccctaccccatccccttattcagcacatgaaataaacaaggggcatccaaatcttgcggcaacgcccccgggacatgcatcgtcccctggactctctcaaaccccttatccctctggacagaatgcaggtccaaccactgctccgacatggtaaacccctcagacacgactcggaccgatg

SEQ ID NO: 11772 - DNA, 203 bp, Homo sapiens
ggcgcgccagtcctattagcggccctaccccatccccttattcagcacatgaaataaacaagttaggcaacgcgagtgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 11773 - DNA, 203 bp, Homo sapiens
ggcgcgccagtcctaagggcgtccctaccccatccccttattcagcaccgcgtgatccatcagggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 11774 - DNA, 203 bp, Homo sapiens
ggcgcgccagtcctttcagcctccctaccccatcgttcacgcacagttatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 11775 - DNA, 203 bp, Homo sapiens
ggcgcgccagtcctctccatagccctagagccatgcactaacaaatgcgtacccttcacggccagtttccattgccagctgtgtttctcgaaaaaggggctcggaatatcatatgagcgaaagggcagacgaagaaggactccaaggaaaactaagactccttcgccttctgcaccagacaagtgagtcgactcggaccgatg

SEQ ID NO: 11776 - DNA, 203 bp, Homo sapiens
ggcgcgccagtcctttgctaacccctagagccatgcactaacaaatgctattgtaagcgatgcagtttccattgccagctgtgtttctcgaaaaaggggctcggaatatcatatgagcatctcttagatgatagaaggactccaaggaaaactaagactccttcgccttctgcaccagacaagtgagtcgactcggaccgatg

SEQ ID NO: 11777 - DNA, 203 bp, Homo sapiens
ggcgcgccagtcctggctatacccctagagccatgcactaacaaatgctattgtaagcgatgcagtttccattgccagctgtgtttctcgaaaaaggggctcggctagcaggggtttggaaagggcagacgaagaaggactccaaggaaaactaagactccttcgccttctgcaccagacaagtgagtcgactcggaccgatg

SEQ ID NO: 11778 - DNA, 203 bp, Homo sapiens
ggcgcgccagtcctggtcggaaccctagagccatgcactaacaaatgctattgtaagcgatgtgccacgggcgaaaagctgtgtttctcgaaaaaggggctcggaatatcatatgagcgaaagggcagacgaagaaggactccaaggaaaactaagactccttcgccttctgcaccagacaagtgagtcgactcggaccgatg

SEQ ID NO: 11779 - DNA, 203 bp, Homo sapiens
ggcgcgccagtcctgcaccagtccctatcccgtgaccctgttcctccgcttcttcgttgggcgcatctcctggaactgggccgcgtccccgccgcctttccgtcatttcttcagatagctccccagctgtggaaaatgagcatcctcaagagaccccagagaatccatcggatttgtatacttccttccgactcggaccgatg

SEQ ID NO: 11780 - DNA, 203 bp, Homo sapiens
ggcgcgccagtcctgtttctggccctatcccgtgaccctgttcctccgcttcttcgttgggcgcatctcctggaactgggccgcgtccccgccgcctttccgtccagcggcgttcctcctccccagctgtggaaaatgagcatcctcaagagaccccagaatccaacaatagcgtgtatacttccttccgactcggaccgatg

SEQ ID NO: 11781 - DNA, 203 bp, Homo sapiens
ggcgcgccagtccttttctgcaccctatcccgtgaccctgttcctccgcttcttcgttgggcgcatctcctggaactgggccgcgtcccctagagtccatttatatttcttcagatagctccccagctgtggaaaatgagcatcctcaagagaccccagaatccaacaatagcgtgtatacttccttccgactcggaccgatg

SEQ ID NO: 11782 - DNA, 203 bp, Homo sapiens
ggcgcgccagtcctttctggaaccctatcccgtgctatgtgcgtgtaccttcttcgttgggcgcatctcctggaactgggccgcgtccccgccgcctttccgtcatttcttcagatagctccccagctgtggaaaatgagcatcctcaagagaccccagaatccaacaatagcgtgtatacttccttccgactcggaccgatg

SEQ ID NO: 11783 - DNA, 203 bp, Homo sapiens
ggcgcgccagtcctctgaggctccctgggccaggacgcctccctcattaagcgggaggacacgaccccagggcattgtgggaacactggccaggctggactttgccttcctcctcgtcctttagccgggagcctgtctttgcttgcctttgcctttgaggctctgtggctgtggggctgagtggcatccgactcggaccgatg

SEQ ID NO: 11784 - DNA, 203 bp, Homo sapiens
ggcgcgccagtcctattagaaaccctgggccaggcttggcagagagggaagcgggaggacacgaccccagggcattgtgggaacactggccaggctggactttgccttcctcctcgtcaaggcatttacttgctgtctttgcttgcctttgcctttgaggctctgtggctgtggggctgagtggcatccgactcggaccgatg

SEQ ID NO: 11785 - DNA, 203 bp, Homo sapiens
ggcgcgccagtcctagaattgcccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggactgcccatttgaacgactcggaccgatg

SEQ ID NO: 11786 - DNA, 203 bp, Homo sapiens
ggcgcgccagtcctccctcaagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatccgactcggaccgatg

SEQ ID NO: 11787 - DNA, 203 bp, Homo sapiens
ggcgcgccagtccttacttcttccctgggccaggcttggcagagagggaagcgggaggacacgaccccagggcattgtgggaacactggccaggctggactttgccttcctcctcgtcctttagccgggagcctgtctttgcttgcctttgcctttgagggcagagacggcccaggctgagtggcatccgactcggaccgatg

SEQ ID NO: 11788 - DNA, 203 bp, Homo sapiens
ggcgcgccagtcctgtccctatccctgggccaggcttggcagagagggaagcgggaggacacgaccccagggcattgtgggaacactggccaggctggactttgccttcctcctcgtcctttagccgggagctctcgggattggagctttgcctttgaggctctgtggctgtggggctgagtggcatccgactcggaccgatg

SEQ ID NO: 11789 - DNA, 203 bp, Homo sapiens
ggcgcgccagtccttctgcattccctgggccaggcttggcagagagggaagcgggaggacacgaccccagggcattgtgggaacactggcgtcagccactagcaccttcctcctcgtcctttagccgggagcctgtctttgcttgcctttgcctttgaggctctgtggctgtggggctgagtggcatccgactcggaccgatg

SEQ ID NO: 11790 - DNA, 203 bp, Homo sapiens
ggcgcgccagtcctaatccgagccctgggtccatcacagtataaaatctgcaagtagtgctattgttggaatcaccgtacctatttaggtttacgctccaagatcggtggatagcagccctatcaatatctaggagaactgtgctatgtttagaagattaggtagtctctaaacagaacaatttacctcgactcggaccgatg

SEQ ID NO: 11791 - DNA, 203 bp, Homo sapiens
ggcgcgccagtcctgtacgtaacccttgcgcaattagggaacaaatccctctcagcgaaggccgaaaagaggctagccatgcccttagtaggactagcataatgaggggggtagcaacagtggtgagttcgttggatggcttaagccctgagtacagggtagtcgtcagtggttcgacgccttggaatcgactcggaccgatg

SEQ ID NO: 11792 - DNA, 203 bp, Homo sapiens
ggcgcgccagtcctcaaccaccccgacaatcccacagtcgtgctcatctttgtggtgagtatgttgctattatgttgttgttctactggttgctgtggcttctttagttgttttgcatcttctattagaggttgttgtgaatcaactaaacttccttattacgacgttgaaaagatccacatacagtacgactcggaccgatg

SEQ ID NO: 11793 - DNA, 203 bp, Homo sapiens
ggcgcgccagtcctgggactatccgagcagccggtcctccagtggctcatagatgttcagcatgtgggctcaaaatgacagaggctcacaggacacctgcatgcccaaggcactccaccgtatgtgatcaacctggatccagcagtacatgaagttccctttcctgccaatattggtgatgaaatttacgactcggaccgatg

SEQ ID NO: 11794 - DNA, 203 bp, Homo sapiens
ggcgcgccagtccttcgtatgtccgagcagccggtcctccagtggctccgctccccgttctctgtgggctcaaaatgacagaggctcacaggacacctgcatgcccaaggcactccaccgtatgtgatcaacctggatccagcagtacatgaagttccctgggtcaatctcggaggtgatgaaatttacgactcggaccgatg

SEQ ID NO: 11795 - DNA, 203 bp, Homo sapiens
ggcgcgccagtccttgtcaagcccgagcagccggtcctccagtggctccgctccccgttctctgtgggctcaaaatgacagaggctcacaggacacctgcatgcccaaggcactccaccgtatgtgatcaacctggatccagcagtacatgaagttccctttcctgccaatattggtgatgaaatttacgactcggaccgatg

SEQ ID NO: 11796 - DNA, 203 bp, Homo sapiens
ggcgcgccagtcctagaaagacccgagcagccggtcctccagtggctccgctccccgttctctgtgggctcaaaatgacagaggctcacaggacacctgcatgcccaaggcactccaccgtatgtgatcaacctggatccagcagtctggttgccgggacttcctgccaatattggtgatgaaatttacgactcggaccgatg

SEQ ID NO: 11797 - DNA, 203 bp, Homo sapiens
ggcgcgccagtcctgacccaacccgattatccatcgccatttcccctggtagacctggcagatgaggctagaaataccccactggcgacagtgttctagcctgcgtggctgcctgcacaccctatgggtgtgaagccaaacaatggacaaggtgtgaagagccccgtgtgctcgctttgagtcctccgcgactcggaccgatg

SEQ ID NO: 11798 - DNA, 203 bp, Homo sapiens
ggcgcgccagtcctatgacaacccgcccaagcgttttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaacgactcggaccgatg

SEQ ID NO: 11799 - DNA, 203 bp, Homo sapiens
ggcgcgccagtcctacgatatgccgcccgagtggatgagcgagcgagcatagccacttttcagccgcggcccggtcaccaaccaggaccgggatcacgtggctcccagggctgggtgaagaagccgccgggaccgagcgcgccggagaggaggggcgcctggggacagaaggcgacgtcccctgaaatcgactcggaccgatg

SEQ ID NO: 11800 - DNA, 203 bp, Homo sapiens
ggcgcgccagtcctaataggccccgcccgagtggatgagcgagcgagcgacttgtgaaacacgccgcggcccggtcaccaaccaggaccgaagagtaactctcgccagggctgggtgaagaagccgccgggaccgagcgcgccggagaggaggggcgcctggggacagaaggcgacgtcccctgaaatcgactcggaccgatg

SEQ ID NO: 11801 - DNA, 203 bp, Homo sapiens
ggcgcgccagtccttcatcatcccgcccgagtggatgagcgagcgagcgacttgtgaaacacgccgcggcccggtcaccaaccaggaccgggatcacgtggctcccagggctgggtgaagaagccgccgggaccgagcgcgccggagaggaggggcgcctctaccgtattcttaacgtcccctgaaatcgactcggaccgatg

SEQ ID NO: 11802 - DNA, 203 bp, Homo sapiens
ggcgcgccagtcctccttagagccgcccgagtggatgagcgagcgagcgacttgtgaaacacgccgcggcccggtcaccaaccaggaccgggatcacgtggctcccagggctgggtgaagaagccgccgggaccgagcgcgccggagaggaggggcgcctggggacagaaggcgacgtcccctgaaatcgactcggaccgatg

SEQ ID NO: 11803 - DNA, 203 bp, Homo sapiens
ggcgcgccagtcctcgctcgccccgcccgagtggatgagcgagcgagcgacttgtgaaacacgccgcggcccggtcaccaaccaggaccgggatcacgtggctcccagggctgggtgaagaagccgccgggaccgagcgcgccggatgcacatccatggaggggacagaaggcgacgtcccctgaaatcgactcggaccgatg

SEQ ID NO: 11804 - DNA, 203 bp, Homo sapiens
ggcgcgccagtcctcactttccccgcccgagtggatgagcgagcgagcgacttgtgaaacacgccgcggcccggtcaccaaccaggaccgggatcacgtggctcccagggctgggtgacagttggaatgctcccgagcgcgccggagaggaggggcgcctggggacagaaggcgacgtcccctgaaatcgactcggaccgatg

SEQ ID NO: 11805 - DNA, 203 bp, Homo sapiens
ggcgcgccagtcctgagtgacgccgcccgagtggatgagcgagcgagcgacttgtgaaacacgccgcggcccggtcaccaaccaggaccgggatcacgtggctcgtccattccacatgagaagccgccgggaccgagcgcgccggagaggaggggcgcctggggacagaaggcgacgtcccctgaaatcgactcggaccgatg

SEQ ID NO: 11806 - DNA, 203 bp, Homo sapiens
ggcgcgccagtccttggccctaccgcccgagtggatgagcgagcgagcgacttgtgaaacacgccgcggcccggtcgattgaagtttttcggatcacgtggctcccagggctgggtgaagaagccgccgggaccgagcgcgccggagaggaggggcgcctggggacagaaggcgacgtcccctgaaatcgactcggaccgatg

SEQ ID NO: 11807 - DNA, 203 bp, Homo sapiens
ggcgcgccagtcctcgttacccccgccggggcagcctcgtctagcgcgcgccgcgcagacgcccccggagtcgccagctaccgcagccctcgccgcccagtgcccttcggcctcggggttaaaaaggattcaggtctccgcgaagcgggaaagcgcggcggccgccgggattcgggcgccgcggcagccgactcggaccgatg

SEQ ID NO: 11808 - DNA, 203 bp, Homo sapiens
ggcgcgccagtcctggagatcgccgccttctccggtcccctcctcggagtcattttttcctgttccccctctgccgccctttcctcacgcaaatttaagcaactttctcttggaagcgaaggtgtcggctatgagccggagcctccttccttgaatttctccgtggaggacccgccgcgccccccggccgactcggaccgatg

SEQ ID NO: 11809 - DNA, 203 bp, Homo sapiens
ggcgcgccagtcctcgaaaggaccgccttctccggtcccctcctcggagtcattttttcctgttccccctctgccgccctttcctcacgccccgggtgaggcaaaggctcccctcataaaggtgtcggctatgagccggagcctccttccttgaatttctccgtggaggacccgccgcgccccccggccgactcggaccgatg

SEQ ID NO: 11810 - DNA, 203 bp, Homo sapiens
ggcgcgccagtcctagaggtccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgataatatgagttatcgactcggaccgatg

SEQ ID NO: 11811 - DNA, 203 bp, Homo sapiens
ggcgcgccagtccttcggcccaccgccttctccggtcccctcctcggataagaacgcgaagattccccctctgccgccctttcctcacgccccgggtgaggcaattctcttggaagcgaaggtgtcggctatgagccggagcctccttccttgaatttctccgtggaggacccgccgcgccccccggccgactcggaccgatg

SEQ ID NO: 11812 - DNA, 203 bp, Homo sapiens
ggcgcgccagtcctccgtccgcccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcactatgtcgtaagcaccgactcggaccgatg

SEQ ID NO: 11813 - DNA, 203 bp, Homo sapiens
ggcgcgccagtccttggtggttccgcgcgcgcgccccaggccccggcccgggcctcggttccagaagggagaggagcccgccaaggcgcgcaagagagcgggctgcctcgcagtccgagccggagagggagcagcctatttttttcccccggacgggcctccgaaaccatgaactttctgctctcttgcgactcggaccgatg

SEQ ID NO: 11814 - DNA, 203 bp, Homo sapiens
ggcgcgccagtcctgctagtatccgcgcgcgcgccccaggccccggcccgggcctcggttccagaagggagaggagcccgccaaggcgcgcaagagagcgggctgcctcgcagtccgagccggagagggagcgcgagccgcgccggccccggacgggccttgcccttgtccctttttctgctctcttgcgactcggaccgatg

SEQ ID NO: 11815 - DNA, 203 bp, Homo sapiens
ggcgcgccagtcctataccggcccgcgcgcgcgccccaggccccggcccgggcctcggttccagaagggagaggagcccgccaaggcgcgcaagagagcgggctgcctcgcagtccgagccggagagggagcgcgagccgcgccgggtgttagacctggaccgaaaccatgaactttctgctctcttgcgactcggaccgatg

SEQ ID NO: 11816 - DNA, 203 bp, Homo sapiens
ggcgcgccagtcctgattgtagccgcgcgcgcgccccaggccccggcccgggcctcggttcctccctcttagttcacccgccaaggcgcgcaagagagcgggctgcctcgcagtccgagccggagagggagcgcgagccgcgccggccccggacgggcctccgaaaccatgaactttctgctctcttgcgactcggaccgatg

SEQ ID NO: 11817 - DNA, 203 bp, Homo sapiens
ggcgcgccagtcctgagacgaaccgcgcgcgcgccccaggccccggccgtccaagtaaagttagaagggagaggagcccgccaaggcgcgcaagagagcgggctgcctcgcagtccgagccggagagggagcgcgagccgcgccggccccggacgggcctccgaaaccatgaactttctgctctcttgcgactcggaccgatg

SEQ ID NO: 11818 - DNA, 203 bp, Homo sapiens
ggcgcgccagtcctcccttgcaccgcggccgcctcccgccagctcgccaatacatgtttttggcgcgtgagctcaggcgtccccgccccagcttttctcggaaccatgaaccccaactgcgcccggtgcggcaagatcgtgtatcccacggagaaggtgaactgtctggataagttctggcataaagccgactcggaccgatg

SEQ ID NO: 11819 - DNA, 203 bp, Homo sapiens
ggcgcgccagtcctttcttactccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagccgactcggaccgatg

SEQ ID NO: 11820 - DNA, 203 bp, Homo sapiens
ggcgcgccagtcctaccatcaaccgcggccgcctcccgccagctcgcctcggggaacaggacgcgcgtgagctcaggcgtccccgccccagcttttctcggaacggactctgagccaagcgcccggtgcggcaagatcgtgtatcccacggagaaggtgaactgtctggataagttctggcataaagccgactcggaccgatg

SEQ ID NO: 11821 - DNA, 203 bp, Homo sapiens
ggcgcgccagtcctcctaaaggccgcggtcggcggcagcgctctcctaagctctcgcggctgcgcttcggtcccggtatgaattgtttgccggggtagtgggtgctcctcggccccggacattgcaagccccagaaggcaagactaactcggtgttgctcctcccggcgctgacttcgaggcccggctcgactcggaccgatg

SEQ ID NO: 11822 - DNA, 203 bp, Homo sapiens
ggcgcgccagtcctagcccagaccgcggtcggcggcagcgctctcctaagctctcgcggctgtaaagtatagagtcacccgggccacccacggggtagtgggtgctcctcggccccggacattgcaagccccagaaggcaagactaactcggtgttgctcctcccggcgctgacttcgaggcccggctcgactcggaccgatg

SEQ ID NO: 11823 - DNA, 203 bp, Homo sapiens
ggcgcgccagtcctctgtgaagccgcggtcggcgtagttttcgctgctagctctcgcggctgcgcttcggtcccggacccgggccacccacggggtagtgggtgctcctcggccccggacattgcaagccccagaaggcaagactaactcggtgttgctcctcccggcgctgacttcgaggcccggctcgactcggaccgatg

SEQ ID NO: 11824 - DNA, 203 bp, Homo sapiens
ggcgcgccagtcctaacttgtcccgctgaagacctcggcctgttgttgtgaatcgccagacctttgtaacacccggaagtctgaagcatgtgtttgatgatctcagaggctcagtatccttgtcctgggttggagatagcactggggtcattctagtcttgactaccttccatggttttactaggtaacgactcggaccgatg

SEQ ID NO: 11825 - DNA, 203 bp, Homo sapiens
ggcgcgccagtcctcttccactccgctgaagacctcggcctgttgttgtgaatcgccagacctttgtaacacccggaagtctgaagcatgtgtttgatgatctcagaggctcagtatccttgtcctgggttggagatagcactggggtcattctagtcttgactaccttccatgtaccactggtaattcgactcggaccgatg

SEQ ID NO: 11826 - DNA, 203 bp, Homo sapiens
ggcgcgccagtcctgtcctacaccgctgaagacctcggcctgttgttgtgaatcgccagacctttgtaacacccggaagtctgaagcatgtgtttgatgatctcgtgtcgattcaccgcttgtcctgggttggagatagcactggggtcattctagtcttgactaccttccatgtaccactggtaattcgactcggaccgatg

SEQ ID NO: 11827 - DNA, 203 bp, Homo sapiens
ggcgcgccagtcctaagtgctcccgctgcaggtgtgcggcccagtccgagacagcagatgaggagactgtccttcctgtttcgcagatgaggaaactgaggcttagagaagtttggcaaattggctaagttcaggggcggtgactagggattagtgatatgcttttctaaagagtagaaaagtcgaagcgactcggaccgatg

SEQ ID NO: 11828 - DNA, 203 bp, Homo sapiens
ggcgcgccagtcctacatggagccgctgcaggtgtgcggcccagtccgagacagcagatgaggagactgtccttcctgtttcgcagatgaggaaactgaggcttagagaagtttggcaaattggctaagttcctacagctaattgtactgccccatgcccgcttttctaaagagtagaaaagtcgaagcgactcggaccgatg

SEQ ID NO: 11829 - DNA, 203 bp, Homo sapiens
ggcgcgccagtccttcacatccccgctgcaggtgtgcggcccagtccgagacagcagatgaggagactgtccttcctgtttcgcagatgaggaaactgaggcttagagaagtttggcaccccttactcaacactacagctaattgtgggattagtgatatgcttttctaaagagtagaaaagtcgaagcgactcggaccgatg

SEQ ID NO: 11830 - DNA, 203 bp, Homo sapiens
ggcgcgccagtcctgacagaagccgcttccagctctgttcttggcaagaagattctaatgcccaggaacatggcgctgctctgggggctcctggtgctcagctggtcctgcctgcaaggcccctgctccgtgttctcccctgtgagcgccatggagcccttgggccggcagctaactagcgggccgaacgactcggaccgatg

SEQ ID NO: 11831 - DNA, 203 bp, Homo sapiens
ggcgcgccagtcctcgatgcgcccggcacccagatcgcgcgagacagcggaaggagcaagagtgggaggcgcgcgcggaggccgcgacggacgcaagatggcgattaactggcgtaaactcgtcaatggccagcaaggaggggggtccgagccggcggcggcggcggcagtggtggcagcgggagacacgactcggaccgatg

SEQ ID NO: 11832 - DNA, 203 bp, Homo sapiens
ggcgcgccagtcctggctcctgccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgatacctttcaactacgactcggaccgatg

SEQ ID NO: 11833 - DNA, 203 bp, Homo sapiens
ggcgcgccagtcctatccgcgtccggcccccaagtcccgcgcgggccgcgagaatagatcaagtcgggccagctgagctatcccgtcagaccgcgccagtttgaatgaaagctctacaagatggcggcggtcggggccgaggcgcgaggagcttggtgtgtgccttgcctagtttcacttgatactctcgactcggaccgatg

SEQ ID NO: 11834 - DNA, 203 bp, Homo sapiens
ggcgcgccagtcctccgaacttccggcccccaagtcccgcgcgggccggccaggggcggggcgtcgggccagctgagctatcccgtcagaccgcgccagtttgaatgaaagctctacaagatggcggcggtcggggccgaggcgcgaggagcttggtgtgcttgcctaggttggtcacttgatactctcgactcggaccgatg

SEQ ID NO: 11835 - DNA, 203 bp, Homo sapiens
ggcgcgccagtcctaatgagaaccggcccccaagtcccgcgcgggccggccaggggcggggcgtcgggccagctgagctatcccgtcagaccgcgccagtttgaatgaaagctctacaagatggcggcggtcggggccgaggcgcggcactgactaacgctgccttgcctagtttcacttgatactctcgactcggaccgatg

SEQ ID NO: 11836 - DNA, 203 bp, Homo sapiens
ggcgcgccagtcctgttcaattccggcccccaagtcccgcgcgggccggccaggggcggggcgtcgggccagctgagctatcccgtcagaccgcgccagtttgaatgaaagctctacaagatggcggcggtcttaattcttttcataggagcttggtgtgtgccttgcctagtttcacttgatactctcgactcggaccgatg

SEQ ID NO: 11837 - DNA, 203 bp, Homo sapiens
ggcgcgccagtcctgatgaatcccggcccccaagtcccgcgcgggccggccaggggcggggcgtcgggccagctgagctatcccgtcagatgctttggcaaacgatgaaagctctacaagatggcggcggtcggggccgaggcgcgaggagcttggtgtgtgccttgcctagtttcacttgatactctcgactcggaccgatg

SEQ ID NO: 11838 - DNA, 203 bp, Homo sapiens
ggcgcgccagtcctcatcccacccggccccgcagccccagcgccttccctgcgccctggtggggacagcagccaggaggacccggccctgccaagcgcctccgaccccgatcatgtttgggccccgaaccccgcgtggcgcccagcctggaagacccggcgggtaccccggccgtgggcgcgctcacccgactcggaccgatg

SEQ ID NO: 11839 - DNA, 203 bp, Homo sapiens
ggcgcgccagtcctgtattcacccggccccgcagccccagcgccttccctgcgccctggtggggacagcagccaggaggacccggccctgccaagcgcctccgattggaggagcccgcgggccccgaaccccgcgtggcgcccagcaacacctggatcttgggtaccccggccgtgggcgcgctcacccgactcggaccgatg

SEQ ID NO: 11840 - DNA, 203 bp, Homo sapiens
ggcgcgccagtcctagttaagaccggccccgcagccccagcgccttccctgcgccctggtggggacagcagccaggaggacccggccctgccaagcgcctccgattggaggagcccgcgggccccgaaccccgcgtggcgcccagcctggaagacgtatgcatgacagttcagtagggcgcgctcacccgactcggaccgatg

SEQ ID NO: 11841 - DNA, 203 bp, Homo sapiens
ggcgcgccagtcctcctctggaccgggaggcaggacagagcggggaaagtgcgcatgcgctgactgagaagaaatatggcttcacagaagcagatggaggtagtgaccaaaggaactgggttccggcgccgccccaagaccatcactggtcttgcggggacctgcgagctgctcagaggaggagatgccgactcggaccgatg

SEQ ID NO: 11842 - DNA, 203 bp, Homo sapiens
ggcgcgccagtccttcggcgtcccgggaggcaggacagagcggggaaagtgcgcatgcgctgactgagtcctcccatggcttcacagaagcagatggaggtagtatttccgttgttatggttccggcgccgccccaagaccatcacttacaccccggggacctgcgagctgctcagaggaggagatgccgactcggaccgatg

SEQ ID NO: 11843 - DNA, 203 bp, Homo sapiens
ggcgcgccagtcctgcttgaggccgggcgagcagagctgcgctgcgggcgtcctgggaagggagatccggagcgaatagggggcttcgcctctggcccagccctcccgctgatcccccagccaggggtccgcaacccttgccgcatccacgaaactttgcccatagcagcgggcgggcactttgcactcgactcggaccgatg

SEQ ID NO: 11844 - DNA, 203 bp, Homo sapiens
ggcgcgccagtcctgttcgcgaccgggcgagcagagctgcgctgcgggcgtcctgggaagggagatccggagcgaatagggggcttcgcctctggcccagccctcccgctgatccccccaggtcttacgtttaacccttgccgcatccacgaaactttgcccatagcagcgggcgggcactttgcactcgactcggaccgatg

SEQ ID NO: 11845 - DNA, 203 bp, Homo sapiens
ggcgcgccagtccttgctcaaaccgggcgagcaggctataaggcgatacgtcctgggaagggagatccggagcgaatagggggcttcgcctctggcccagccctcccgctgatcccccagccaggggtccgcaacccttgccgcatccacgaaactttgcccatagcagcgggcgggcactttgcactcgactcggaccgatg

SEQ ID NO: 11846 - DNA, 203 bp, Homo sapiens
ggcgcgccagtccttcaactggccggggcttagggaaggccgagccagaggcacggcgcctcgtcaaaggggctgcctggaggaggcagcctgtcagctggtgcatcagaggctgtggccaggccagctgggctcggggagcgccagcctgagaggagcgcgtgagcgtcgcgggagcctcgggcacccgactcggaccgatg

SEQ ID NO: 11847 - DNA, 203 bp, Homo sapiens
ggcgcgccagtcctaggccaagccggggcttagggaaggccgagccagcctgggtcaaagaagtcaaaggggctgcctggaggaggcagcctgtcagctggtgcatcagaggctgtggccaggccagctgggctcggggagcgccagcctgagaggagcgtcacccaaggaaccgagcctcgggcacccgactcggaccgatg

SEQ ID NO: 11848 - DNA, 203 bp, Homo sapiens
ggcgcgccagtcctgcgttctgccggggcttagggaaggccgagccagcctgggtcaaagaatgtgtctcaagatactggaggaggcagcctgtcagctggtgcatcagaggctgtggccaggccagctgggctcggggagcgccagcctgagaggagcgcgtgagcgtcgcgggagcctcgggcacccgactcggaccgatg

SEQ ID NO: 11849 - DNA, 203 bp, Homo sapiens
ggcgcgccagtcctctgtcagtccgggtcatgggagaaaccctgcgacaaaacctcctccttttccaagcggctgccgaagatggcggaggtgcaggtcctggtgcttgatggtcgaggccatctcctgggccgcctggcggccatcgtggctaaacagtgaagtacctggctttcctccgcaagcggcgactcggaccgatg

SEQ ID NO: 11850 - DNA, 203 bp, Homo sapiens
ggcgcgccagtcctgtcgatccccggtcccttttcgacaaggacagttccaaatcggaagcttgcttaacacagttctaacagtttgtttgaatagagagcagatctctggaaaaatgaaccaacgaaaaaaggtggttagaccacctttcaatatgctgaaacgcgagagaaaccgcgtatcaaccccgactcggaccgatg

SEQ ID NO: 11851 - DNA, 203 bp, Homo sapiens
ggcgcgccagtcctgtctacttccggttcggtcagctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggcgactcggaccgatg

SEQ ID NO: 11852 - DNA, 203 bp, Homo sapiens
ggcgcgccagtcctacactctaccgtaccttggctccgaggacgtggtgaaggagctgaagaaggctctgtgcaataagggggccgtcaatgataggctgcgctaccggaatgtcatccagcgagtgattagatctggctctcctggccatcaatacgctgtgcaaagactgctcagaccccaatccacgactcggaccgatg

SEQ ID NO: 11853 - DNA, 203 bp, Homo sapiens
ggcgcgccagtcctgagtacctccgtaccttggctccgaggacgtggtgaaggagctgaagaaggctctgtgcaatcctcacattcaagctgataggctgcgctaccggaatgtcatcatctagtgcccggtatctggctctcctggccatcaatacgctgtgcaaagactgctcagaccccaatccacgactcggaccgatg

SEQ ID NO: 11854 - DNA, 203 bp, Homo sapiens
ggcgcgccagtccttccaaggcccgtaccttggctccgaggacgtggtgaaggagctgaagaaggctctgtgcaatcctcacattcaagctgataggctgcgctaccggaatgtcatccagcgagtgattagatctggctctcctggccatcaatacgctgtgcaaagactgctggccaatgcgcagccgactcggaccgatg

SEQ ID NO: 11855 - DNA, 203 bp, Homo sapiens
ggcgcgccagtcctgttatccaccgtaccttggctccgaggacgtggtgaaggagctgaagaaggctctgtgcaatcctcacattcaagctgataggctgcgctaccggaatgtcatccagcgagtgattagatctggctctcctggccatcaatacgcttcttttgccgctagcagaccccaatccacgactcggaccgatg

SEQ ID NO: 11856 - DNA, 203 bp, Homo sapiens
ggcgcgccagtcctttcgctttccgtaccttggctccgaggacgtggtgaaggagctgaagaaggctctgtgcaatcctcacattcaagctgataggctgcgctaccggaatgtcatccagcgagtgattagccggtctgtcgaacgccatcaatacgctgtgcaaagactgctcagaccccaatccacgactcggaccgatg

SEQ ID NO: 11857 - DNA, 203 bp, Homo sapiens
ggcgcgccagtcctgctgggcgccgtcacgtactcgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactaccgactcggaccgatg

SEQ ID NO: 11858 - DNA, 203 bp, Homo sapiens
ggcgcgccagtccttagcctttccgtcctttcaggtgtgtcgtaacgggcaactctgcagcggaaccgactactttgggtgtccgtgtttcattttattcctatactggctgcttatggtgacaattgagagattgttaccatatagctattggattggccatccggtgaccaatagagctattatatcgactcggaccgatg

SEQ ID NO: 11859 - DNA, 203 bp, Homo sapiens
ggcgcgccagtcctcacatacgccgtggatccacgtgctttttcttgtccaatgggagccggctcccgggcgcgaaggggcggggaggaaaggaacgactgtgcgtgacgaaatattcgggcgggacctgcaacgtccgacagaacgaggggacgtaacggaggcaggttggagccgctgccgtcgcccgactcggaccgatg

SEQ ID NO: 11860 - DNA, 203 bp, Homo sapiens
ggcgcgccagtcctctgatattccgtggatccacgtgctttttcttgtccaatgggagccggctcccgggcgcgaaggggcggggaggaaaggaacgactgtgctacgttgccagaaggggcgggacctgcaacgtccgacagaactcactagaagtttagaggcaggttggagccgctgccgtcgcccgactcggaccgatg

SEQ ID NO: 11861 - DNA, 203 bp, Homo sapiens
ggcgcgccagtcctttacaatgccgtggatccacgtgctttttcttgtccaatgggagccgggcggaattgagactggggcggggaggaaaggaacgactgtgctacgttgccagaaggggcgggacctgcaacgtccgacagaacgaggggacgtaacggaggcaggttggagccgctgccgtcgcccgactcggaccgatg

SEQ ID NO: 11862 - DNA, 203 bp, Homo sapiens
ggcgcgccagtcctacaactctccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgagggataggccttctcacgactcggaccgatg

SEQ ID NO: 11863 - DNA, 203 bp, Homo sapiens
ggcgcgccagtcctatgcggcgccgtggtaaaggtggaaaaggtttgggtaagggaggagctaagcgtcatcgcaaggttttgcgcgataacatccagggcatcactaagccagctatgttttattacatcggtcgcggcggtgtcaagcgaatttctggccttatctatgaggagactcgtggtgttcgactcggaccgatg

SEQ ID NO: 11864 - DNA, 203 bp, Homo sapiens
ggcgcgccagtccttagtgaatccgtggtaaaggtggaaaaggtttgggtaagggaggagctgttatcgggactctggttttgcgcgataacatccagggcatcactaagccagctatccggcgccttgctcgtcgcggcggtgtcaagcgaatttctggccttatctatgaggagactcgtggtgttcgactcggaccgatg

SEQ ID NO: 11865 - DNA, 203 bp, Homo sapiens
ggcgcgccagtcctgctattggcctaaatgaggtagatgctacgtggacgagggcatgccaagacacaccttaaccctagcgggggtcgctagggtgaaatcacaccacgtgatgggagtacgacctgatagggcgctgcagaggcccactattaggctagtataaaaatctctgctgtacatggcaccgactcggaccgatg

SEQ ID NO: 11866 - DNA, 203 bp, Homo sapiens
ggcgcgccagtcctctgccgggcctactttcagaactcacatcctttattcaggcctcggtgggagagcagggggaggggagcaccatcttgcaacacatcagcacccttgagagcatatatcagagggaccccctgaagctggtggccactttcagacaaatacttcaaggagagaaaaaagctgttcgactcggaccgatg

SEQ ID NO: 11867 - DNA, 203 bp, Homo sapiens
ggcgcgccagtcctctaaatgtcctactttcagacactgtccagcaccagggcaaaggccgtggagagcagggggaggggagcaccatcttgcaacacatcagcacccttgagagcatatatcagagggaccccctgaagctggtggccactttcagacaaatacttcaaggagagaaaaaagctgttcgactcggaccgatg

SEQ ID NO: 11868 - DNA, 203 bp, Homo sapiens
ggcgcgccagtcctctgctcctcctactttcagacactgtccagcaccttcaggcctcggtgcccataacattaagggggagcaccatcttgcaacacatcagcacccttgagagcatatatcagagggaccccctgaagctggtggccactttcagacaaatacttcaaggagagaaaaaagctgttcgactcggaccgatg

SEQ ID NO: 11869 - DNA, 203 bp, Homo sapiens
ggcgcgccagtccttatccatgcctactttcagacactgtccagcaccttcaggcctcggtgggagagcagggggaggggagcaccatcttgcaacacatcagcacccttgagagcatatatcagagggaccccctgaagctggtgagacaggatcacgcaatacttcaaggagagaaaaaagctgttcgactcggaccgatg

SEQ ID NO: 11870 - DNA, 203 bp, Homo sapiens
ggcgcgccagtcctcttatacccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttcgactcggaccgatg

SEQ ID NO: 11871 - DNA, 203 bp, Homo sapiens
ggcgcgccagtcctaagccggtcctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagttgggtttatgccgcgactcggaccgatg

SEQ ID NO: 11872 - DNA, 203 bp, Homo sapiens
ggcgcgccagtcctccgcaggtcctagcacgcggctatgggtgtgaagccaaacaatggacaaggtgtgaagagccccgtgtgctcgctttgagtcctccggcccctgaatgtggctaaccttaaccctgcagctagagcacgtaacccaatgtgtatctagtcgtaatgagcaattgcgggatgggacgactcggaccgatg

SEQ ID NO: 11873 - DNA, 203 bp, Homo sapiens
ggcgcgccagtcctggaacgcccctatttatgctgacagctataggctaacgcccataaagagcagctggggtattccttaggggctgagtctcctggtatccctaagactgggcttggcttaggcactgagattccttctggaaccccaacgccttcgagacggattccgacctgccggctggatggcgactcggaccgatg

SEQ ID NO: 11874 - DNA, 203 bp, Homo sapiens
ggcgcgccagtcctatatctaacctatttatgctgacagctataggctctgcagggccccagctgcgccatcgtaaccttaggggctgagtctcctggtatccctaagactgggcttggcttaggcactgagattccttctggaaccccaacgccttcgagacggattccgacctgccggctggatggcgactcggaccgatg

SEQ ID NO: 11875 - DNA, 203 bp, Homo sapiens
ggcgcgccagtccttacaggcacctatttatgctgacagctataggctctgcagggccccaggcagctggggtattccttaggggctgagcgcgtgacccggagtaagactgggcttggcttaggcactgagattccttctggaaccccaacgccttcgagacggattccgacctgccggctggatggcgactcggaccgatg

SEQ ID NO: 11876 - DNA, 203 bp, Homo sapiens
ggcgcgccagtcctatttatgtcctatttatgctgacagctataggctctgcagggccccaggcagctggggtattccttaggggctgagtctcctggtatccccgtactgatcgcctgcttaggcactgagattccttctggaaccccaacgccttcgagacggattccgacctgccggctggatggcgactcggaccgatg

SEQ ID NO: 11877 - DNA, 203 bp, Homo sapiens
ggcgcgccagtccttggttcaacctatttatgctgacagctataggctctgcagggccccaggcagctggggtattccttaggggctgagtctcctggtatccctaagactgggcttgctaactaagacccaattccttctggaaccccaacgccttcgagacggattccgacctgccggctggatggcgactcggaccgatg

SEQ ID NO: 11878 - DNA, 203 bp, Homo sapiens
ggcgcgccagtcctcacgcctccctatttatgctgacagctataggctctgcagggccccaggcagctggggtattccttaggggctgagtctcctggtatccctaagactgggcttggcttaggcactgagattccttctggaaccccaacgccttcgacttaaccgggagtgtgccggctggatggcgactcggaccgatg

SEQ ID NO: 11879 - DNA, 203 bp, Homo sapiens
ggcgcgccagtccttagatttccctatttatgctgacagctataggctctgcagggccccaggcagctggggtattccttaggggctgagtctcctggtatccctaagactgggcttggcttaggcactgagattccttctggaaccccaacgccttcgagacggattccgaccctattctcattgaacgactcggaccgatg

SEQ ID NO: 11880 - DNA, 203 bp, Homo sapiens
ggcgcgccagtcctgggtccgacctcagcggcttccgtcctgcagcaagtccggaagaaggtccgggggctggagtcctgggacctagctcgggaccggcctggagatggagttcgactgcgagggcctgagacggctgcttggcaagtacaagttcagggacctaactgtggagtcctactaatgatcgactcggaccgatg

SEQ ID NO: 11881 - DNA, 203 bp, Homo sapiens
ggcgcgccagtcctggcgggcacctcagcggcttccgtcctgcagcaagtccggaagaaggtccgggggctggagtcctgggacctagctcgggaccggcctggagatggagttcgactgcgagggcctgagcatttgaaggatggagtacaagttcagggacctaactgtggaagaactaaggaatgcgactcggaccgatg

SEQ ID NO: 11882 - DNA, 203 bp, Homo sapiens
ggcgcgccagtcctgcttaacacctcagcggctttatgaagtgcagctgtccggaagaaggtccgggggctggagtcctgggacctagctcgggaccggcctggagatggagttcgactgcgagggcctgagacggctgcttggcaagtacaagttcagggacctaactgtggaagaactaaggaatgcgactcggaccgatg

SEQ ID NO: 11883 - DNA, 203 bp, Homo sapiens
ggcgcgccagtcctggttgacccctctgagctattccagaagtagtgaggaggcttttttggaggcctaggcttttgcaaaaagctttgcaaagatggataaagcccctggtcagttcgaatctttgcagctaatggaccttctaggtcttgaaaggagtgcctgggggaatattcctctgatgagaacgactcggaccgatg

SEQ ID NO: 11884 - DNA, 203 bp, Homo sapiens
ggcgcgccagtccttctagttgcctctgagctattccagaagtagtgaggaggcttttttggaggcctaggcttttgcaaaaagctttgcaaagatggataaagttttaaacagagaggaatctttgcagctaatggaccttctagactggtccccttacgcctgggggaatattcctctgatgagaacgactcggaccgatg

SEQ ID NO: 11885 - DNA, 203 bp, Homo sapiens
ggcgcgccagtcctccacaccacctctgtagggaagccaagaatgtccaggaggtaccccttcctctcggaagggatctgacctggagacacatcacacgtgctaattctagagatgggtgtttaaaaattgttacagcttccccgaaccaagtggtcttggttttcactttttatcacactgtcaatcgactcggaccgatg

SEQ ID NO: 11886 - DNA, 203 bp, Homo sapiens
ggcgcgccagtcctgatggtgacctctgtagggaagccaagaatgtccaggaggtaccccttcctctcggaagggatctgacctggagacacatcacacgtgctttacacctgtgctttgtaggtgtttcgcttacagcttccccgaaccaagtggtcttggttttcactttttatcacactgtcaatcgactcggaccgatg

SEQ ID NO: 11887 - DNA, 203 bp, Homo sapiens
ggcgcgccagtcctgatcttatcctctgtagggaagccaagaatgtccaggaggtaccccttgtatatcatgaacctctgacctggagacacatcacacgtgctttacacctgtgcttgtgtttaaaaattgttacagcttccccgaaccaagtggtcttggttttcactttttatcacactgtcaatcgactcggaccgatg

SEQ ID NO: 11888 - DNA, 203 bp, Homo sapiens
ggcgcgccagtcctgactaatacctctgtagggactttgtactgactgaggaggtaccccttcctctcggaagggatctgacctggagacacatcacacgtgctttacacctgtgcttgtgtttaaaaattgttacagcttccccgaaccaagtggtcttggttttcactttttatcacactgtcaatcgactcggaccgatg

SEQ ID NO: 11889 - DNA, 203 bp, Homo sapiens
ggcgcgccagtcctcgcgctaacctgaagcggccgggccaggccctgcctcgatcctcagctcgtcctccccgccccgcaccggccttcactctggagcggccccggcagccgcagcaggggcggcggcggcggatcgaggagctccgtgtagaaggggcggagaggctgctgcagtcccgggacaggcgactcggaccgatg

SEQ ID NO: 11890 - DNA, 203 bp, Homo sapiens
ggcgcgccagtccttagtttctcctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgctccagaactctgctcgactcggaccgatg

SEQ ID NO: 11891 - DNA, 203 bp, Homo sapiens
ggcgcgccagtcctggccaaatcctgaagcggccgggccaggccctgcctcgatcctcagctcgtcctccccgccccgcaccggccttcactctggagcggccccggcagccgcagcatacaaacattgcatggatcgaggagctctccaggtcgtcccgggagaggctgctgcagtcccgggacaggcgactcggaccgatg

SEQ ID NO: 11892 - DNA, 203 bp, Homo sapiens
ggcgcgccagtcctttctgttgcctgaagcggccgggccaggccctgcctcgatcctcagcttagatcttgtagatcgcaccggccttcactctggagcggccccggcagccgcagcaggggcggcggcggcggatcgaggagctctccaggtcgtcccgggagaggctgctgcagtcccgggacaggcgactcggaccgatg

SEQ ID NO: 11893 - DNA, 203 bp, Homo sapiens
ggcgcgccagtccttgaagagtcctgaatgcggctaaccttaaccctagagccttatgccacgatccagtggttgtaaggtcgtaatgagcaattccgggacgggaccgactactttgggtgtccgtgtttccgcacaacaacgtgattgtcttatggtcacagcatatatatacatatactgtgatccgactcggaccgatg

SEQ ID NO: 11894 - DNA, 203 bp, Homo sapiens
ggcgcgccagtcctcttgacagcctgaatgcggctaaccttaaccctagagccttatgccacgatccagtggttgtaaggtcgtaatgagcaattccgggacgggaccgactactttgggtgtccgtgtttctcatttttcttcatattgtcttatggtcacagcatatatatacatatactgtgatccgactcggaccgatg

SEQ ID NO: 11895 - DNA, 203 bp, Homo sapiens
ggcgcgccagtcctgtcaaatgcctgaatgcggctaaccttaaccctagagccttatgccacgatccagtggttgtaaggtcgtaatgagcaattccgggacgggaccgactactttgggtgtccgtgtttctcatttttcttcatattgtcttatggtctgcctcgcatgtctcatatactgtgatccgactcggaccgatg

SEQ ID NO: 11896 - DNA, 203 bp, Homo sapiens
ggcgcgccagtccttacgccctcctgaatgcggctaaccttaaccctagagccttatgccacgatccagtggttgtaaggtcgtaatgagcaattccgggacgggaccgactactttgggtgtccgtgtttctcatttttcttcatgacagtaatcctagacagcatatatatacatatactgtgatccgactcggaccgatg

SEQ ID NO: 11897 - DNA, 203 bp, Homo sapiens
ggcgcgccagtcctgacctgaacctgaatgcggctaaccttaaccctagagccttatgccacgatccagtggttgtaaggtcgtaatgaggtggatacacctatgaccgactactttgggtgtccgtgtttctcatttttcttcatattgtcttatggtcacagcatatatatacatatactgtgatccgactcggaccgatg

SEQ ID NO: 11898 - DNA, 203 bp, Homo sapiens
ggcgcgccagtcctagcacttgcctgaatgcggctaaccttaaccctatgaagagcaatgcagatccagtggttgtaaggtcgtaatgagcaattccgggacgggaccgactactttgggtgtccgtgtttctcatttttcttcatattgtcttatggtcacagcatatatatacatatactgtgatccgactcggaccgatg

SEQ ID NO: 11899 - DNA, 203 bp, Homo sapiens
ggcgcgccagtcctgcgcaacgcctgatgtcttcatcattctcaaattcttaggacggtcggattagtttgcctcagctctcggaattggccgcggaaaccgatctgcccgttgtgtttgtgaaacagagaaagataggcggccatggtccaaccttgaaggaggcagcccaatatggcaagaaggtgcgactcggaccgatg

SEQ ID NO: 11900 - DNA, 203 bp, Homo sapiens
ggcgcgccagtcctccgtctatcctgatgtcttcatcattctcaaattcttaggacggtcgggccctggaaggaacgctctcggaattggccgcggaaaccgatgacagatggagagatgtgaaacagagaaagataggcggccatggtccaaccttgaaggaggcagcccaatatggcaagaaggtgcgactcggaccgatg

SEQ ID NO: 11901 - DNA, 203 bp, Homo sapiens
ggcgcgccagtccttacggagtcctgatgtcttcatcattctcaaattcttaggacggtcgggccctggaaggaacgctctcggaattggggagacgcgatatgctgcccgttgtgtttgtgaaacagagaaagataggcggccatggtccaaccttgaaggaggcagcccaatatggcaagaaggtgcgactcggaccgatg

SEQ ID NO: 11902 - DNA, 203 bp, Homo sapiens
ggcgcgccagtcctgtgcagagcctgatgtcttcatcattctcaaatttgctcagtttgaatgccctggaaggaacgctctcggaattggccgcggaaaccgatctgcccgttgtgtttgtgaaacagagaaagataggcggccatggtccaaccttgaaggaggcagcccaatatggcaagaaggtgcgactcggaccgatg

SEQ ID NO: 11903 - DNA, 203 bp, Homo sapiens
ggcgcgccagtcctgtttgtctcctgatgtcttcgaagagggacgcaacttaggacggtcgggccctggaaggaacgctctcggaattggccgcggaaaccgatctgcccgttgtgtttgtgaaacagagaaagataggcggccatggtccaaccttgaaggaggcagcccaatatggcaagaaggtgcgactcggaccgatg

SEQ ID NO: 11904 - DNA, 203 bp, Homo sapiens
ggcgcgccagtcctctaaggtacctgccctccggcccctctgcagctagatttgtacgacgatctcggcaaacatactccacaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11905 - DNA, 203 bp, Homo sapiens
ggcgcgccagtcctaacactaccctgccctccggcccctctgcagctatgaggtcctccgtcgagatcggcgtgcgctccacaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11906 - DNA, 203 bp, Homo sapiens
ggcgcgccagtccttcgtgcggcctgccctccggcccctctgcagctatgaggtcctccgtctctcggcaaacatactccacaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11907 - DNA, 203 bp, Homo sapiens
ggcgcgccagtccttattgtgccctgccctccggcccctctgcagctatgaggtcctccgtctctcggcaaacatactccacaaaaggggttgggctagtggtttctgccagcggagggagtgggtcccaggcccgcaccagcttcagctcagtgacggtgtctcggagcagtggcagtggtggcgggcgactcggaccgatg

SEQ ID NO: 11908 - DNA, 203 bp, Homo sapiens
ggcgcgccagtcctcgcaaagccctgccctccggcccctctgcagctatgaggtcctccgtctctcggcaaacatagctatgtgttatccgcttcagctccaactctgccagcggagggagtgggtcccaggcccgcaccagcttcagctcagtgacggtgtctcggagcagtggcagtggtggcgggcgactcggaccgatg

SEQ ID NO: 11909 - DNA, 203 bp, Homo sapiens
ggcgcgccagtccttccttcagcctgccctccggcccctctgcagctatgaggtcctccgttgggactaccgcaccacttccaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11910 - DNA, 203 bp, Homo sapiens
ggcgcgccagtcctcctcaaaccctgccctccggggtggactgtttggtgaggtcctccgtctctcggcaaacatactccacaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11911 - DNA, 203 bp, Homo sapiens
ggcgcgccagtcctatcacgctcctggacatcaagattgccaagggaggagccgacaaacagataggttggagcatgctgcggaaggagatgatggcgatttggcccaatctgtcccagaagacgctagacctgctggtcacacctcacaagtccacggacctcaccgtggggaagatctacgcagcccgactcggaccgatg

SEQ ID NO: 11912 - DNA, 203 bp, Homo sapiens
ggcgcgccagtccttccaatttcctggacatcaagattgccaagggaggagccgacaaacagcagatggacgctgactgcttaggctcattgatggcgatttggcccaatctgtcccagaagacgctagacctgctggtcacacctcacaagtccacggacctcaccgtggggaagatctacgcagcccgactcggaccgatg

SEQ ID NO: 11913 - DNA, 203 bp, Homo sapiens
ggcgcgccagtcctcattgactcctggacatcaagattgccaagggaggagccgacaaacagcagatggacgctgagctgcggaaggagatgatggcgatttggcccaatctgtcccaatctgttaaccgtatgctggtcacacctcacaagtccacggacctcaccgtggggaagatctacgcagcccgactcggaccgatg

SEQ ID NO: 11914 - DNA, 203 bp, Homo sapiens
ggcgcgccagtcctagcgacctcctggacatcaagattgccaagggaggagccgacaaacagcagatggacgctgagctgcggaaggagatgatggcgatttggcccaatctgtcccagaagacgctagacctgctggtcacacctttggctatattatccctcaccgtggggaagatctacgcagcccgactcggaccgatg

SEQ ID NO: 11915 - DNA, 203 bp, Homo sapiens
ggcgcgccagtcctagttagcgcctggagatttgggcgtgcccccgcaagactgctagccgagtagtgttgggtcgcgaaaggccttgtggtactgcctgatagggtgcttgcgagtgagggtccttactcggtagaccgtgcaccatgagcacgaatcctaaacctcaaagaaaaaccaaacgtaaccgactcggaccgatg

SEQ ID NO: 11916 - DNA, 203 bp, Homo sapiens
ggcgcgccagtccttcgccaatcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaaccgactcggaccgatg

SEQ ID NO: 11917 - DNA, 203 bp, Homo sapiens
ggcgcgccagtccttcacccgccctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaattcattgggaagtacgactcggaccgatg

SEQ ID NO: 11918 - DNA, 203 bp, Homo sapiens
ggcgcgccagtcctcataaatacctggagatttgggcgtgcccccgcaagactgctagccgagtagtgttgggtcgcgaaaggccttgtggtactgcctgatagggtgcttgcgagtgccccgggaggtctcgtagaccgtgcaccgattaacacccgaataaacctcaaagaaaaaccaaacgtaaccgactcggaccgatg

SEQ ID NO: 11919 - DNA, 203 bp, Homo sapiens
ggcgcgccagtcctacattattcctggagatttgggcgtgcccccgcaagactgctagccgagtagtgttgggtcggtttctcagcaaaagtactgcctgatagggtgcttgcgagtgccccgggaggtctcgtagaccgtgcaccatgagcacgaatcctaaacctcaaagaaaaaccaaacgtaaccgactcggaccgatg

SEQ ID NO: 11920 - DNA, 203 bp, Homo sapiens
ggcgcgccagtcctagaagccgcctggagatttgtcatccgtaggcgcagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaaccgactcggaccgatg

SEQ ID NO: 11921 - DNA, 203 bp, Homo sapiens
ggcgcgccagtcctagtccgcccctggtggcaatcccttcccttaggagcatgagtgtggtccgacacgatgggtcggcttggctgtggttgctggtttgcttccccctcgcggggggggtgctcttcaactcgcggcaccagtgcttcaatggggaccattatgtgctttccaattgttgttcccgacgactcggaccgatg

SEQ ID NO: 11922 - DNA, 203 bp, Homo sapiens
ggcgcgccagtcctgaacctggcctggtggcaatcccttcccttaggagcatgagtgtggtcgacacattcaccatacgcctcagagaaatgctggtttgcttccccctcgcggggggggtgctcttcaactcgcggcaccagtgcttcaatggggaccattatgtgctttccaattgttgttcccgacgactcggaccgatg

SEQ ID NO: 11923 - DNA, 203 bp, Homo sapiens
ggcgcgccagtcctagagtttacctggtggcaatcccttcccttaggagcatgagtgtggtcgacacattcaccatggcttggctgtggtactgcaccgagaagcccctcgcggggggggtgctcttcaactcgcggcaccagtgcttcaatggggaccattatgtgctttccaattgttgttcccgacgactcggaccgatg

SEQ ID NO: 11924 - DNA, 203 bp, Homo sapiens
ggcgcgccagtccttgaaaccacctggtggcaatcccttcccttaggagcatgagtgtggtcgacacattcaccatggcttggctgtggttgctggtttgcttccccctcgcggggggaagaacgcgttttacgcggcaccagtgcttcaatggggaccattatgtgctttccaattgttgttcccgacgactcggaccgatg

SEQ ID NO: 11925 - DNA, 203 bp, Homo sapiens
ggcgcgccagtcctgcagcctgcctggtggcaatcccttcccttaggagcatgagtgtggtcgacacattcaccatggcttggctgtggttgctggtttgcttccccctcgcggggggggtgctcttcaactatatttcagccgatttcaatggggaccattatgtgctttccaattgttgttcccgacgactcggaccgatg

SEQ ID NO: 11926 - DNA, 203 bp, Homo sapiens
ggcgcgccagtccttgttatggcctggtggcaatcccttcccttaggagcatgagtgtggtcgacacattcaccatggcttggctgtggttgctggtttgcttccccctcgcggggggggtgctcttcaactcgcggcaccagtgccattcgaattctgcttatgtgctttccaattgttgttcccgacgactcggaccgatg

SEQ ID NO: 11927 - DNA, 203 bp, Homo sapiens
ggcgcgccagtcctgcccgtgacctggtggcaatcccttcccttaggagcatgagtgtggtcgacacattcaccatggcttggctgtggttgctggtttgcttccccctcgcggggggggtgctcttcaactcgcggcaccagtgcttcaatggggaccattatgtgctttccaattgttgttcccgacgactcggaccgatg

SEQ ID NO: 11928 - DNA, 203 bp, Homo sapiens
ggcgcgccagtccttgacgggccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaaccccgactcggaccgatg

SEQ ID NO: 11929 - DNA, 203 bp, Homo sapiens
ggcgcgccagtcctgcgtgtaacctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggcgtcagaacaatgatcttggataaaccccgactcggaccgatg

SEQ ID NO: 11930 - DNA, 203 bp, Homo sapiens
ggcgcgccagtcctctcgttgtcctgtgaggaactactgtcttcacgcagaaagcgtctagccatggcgttagtatgagtgtcgtgcagcctccaggaccccccctcccgggagagcctcgacaagacagtaaaccggtgagtacaccggaattgccaggacgaccgggtcctttcttggataaaccccgactcggaccgatg

SEQ ID NO: 11931 - DNA, 203 bp, Homo sapiens
ggcgcgccagtccttcagaagacctgtgaggaactactgtcttcacgcagaaagcgtctagccatggcgttagtatgagtgtcgtgcagcctccaggaccccccgaggtccatcctgtatagtggtctgcggaaccggtgagtacaccggaattgccaggacgaccgggtcctttcttggataaaccccgactcggaccgatg

SEQ ID NO: 11932 - DNA, 203 bp, Homo sapiens
ggcgcgccagtccttggactgacctgtgaggaactactgtcttcacgcgacggtgtcgggtgcatggcgttagtatgagtgtcgtgcagcctccaggaccccccctcccgggagagccatagtggtctgcggaaccggtgagtacaccggaattgccaggacgaccgggtcctttcttggataaaccccgactcggaccgatg

SEQ ID NO: 11933 - DNA, 203 bp, Homo sapiens
ggcgcgccagtccttctaacgaccttaagtcataatgaatcaattatctgaattacttggatttgatcttaatccataaattataataaatatcaactagcaaatcaatgtcactaacaccattagttaatataaaacttgacagaagataaaaatggggcaaataaatcaattcagccgacccaacccgactcggaccgatg

SEQ ID NO: 11934 - DNA, 203 bp, Homo sapiens
ggcgcgccagtcctgtttggacccttctgatggtaccaccttttagagttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 11935 - DNA, 203 bp, Homo sapiens
ggcgcgccagtcctgcagattcccttctgatggtgaatgggaactccccatgggtctggctcgcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 11936 - DNA, 203 bp, Homo sapiens
ggcgcgccagtcctggctttcaccttctgatggtgaatgggaactcccttcctcctgcagcagcctgcctgcagctactagttctttctcgtgtggacattgcagaagctgtcactgccccagaaagaaagcaccccagagccaaggcaaagagtcttgaaagcgccacaagcagcagctgctgagcccgactcggaccgatg

SEQ ID NO: 11937 - DNA, 203 bp, Homo sapiens
ggcgcgccagtcctacagatagccttctgatggtgaatgggaactcccttcctcctgcagcagcctgcctgcagctgtcctggtagaacaagacaacatcattcgaagctgtcactgccccagaaagaaagcaccccagagccaaggcaaagagtcttgaaagcgccacaagcagcagctgctgagcccgactcggaccgatg

SEQ ID NO: 11938 - DNA, 203 bp, Homo sapiens
ggcgcgccagtccttgcgtatcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcatagctcctcacctgcgactcggaccgatg

SEQ ID NO: 11939 - DNA, 203 bp, Homo sapiens
ggcgcgccagtccttactaccaccttctgatggtgaatgggaactcccttcctcctgcagcagcctgcctgcagctgtcctggtagaacagtgtggacattgcagaagctgtcactgccccagaaagaaagcaccccagagccaagtgtcctgcctaccgaagcgccacaagcagcagctgctgagcccgactcggaccgatg

SEQ ID NO: 11940 - DNA, 203 bp, Homo sapiens
ggcgcgccagtcctgattagatccttctgatggtgaatgggaactcccttcctcctgcagcagcctgcctgcagctgtcctggtagaacagtgtggacattgcagaagctgtcactgccccagaaagaaagcttatatacttttgagcaaagagtcttgaaagcgccacaagcagcagctgctgagcccgactcggaccgatg

SEQ ID NO: 11941 - DNA, 203 bp, Homo sapiens
ggcgcgccagtcctatagcaggcctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgtacatgtcatagggtcgactcggaccgatg

SEQ ID NO: 11942 - DNA, 203 bp, Homo sapiens
ggcgcgccagtcctgcgttacccctttcccctcccttccctatccccgacgaccggatcctgaggaggcagctgcggtggcagctgctgagttctcggtgaaggtatttcatttctcctgtcccctcccctcgagcattataagcgtaatattattcttttgaagattcttcgttgtcaagccgccaacgactcggaccgatg

SEQ ID NO: 11943 - DNA, 203 bp, Homo sapiens
ggcgcgccagtcctaactatcgcctttcccctcccttccctatccccgacgaccggatcctgttctaaatatcctcgtggcagctgctgagttctcggtgaaggtatttcatttctcctgtcccctcccctccccaccccatctattaatattattcttttgaagattcttcgttgtcaagccgccaacgactcggaccgatg

SEQ ID NO: 11944 - DNA, 203 bp, Homo sapiens
ggcgcgccagtcctctcagagacgaacccactcagagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagcgactcggaccgatg

SEQ ID NO: 11945 - DNA, 203 bp, Homo sapiens
ggcgcgccagtcctataaagttcgaatttagcgtttaaccctgcagctagagcacgtaacccaatgtgtatctagtcgtaatgagcaattgcgggatgggaccaactactttgggtgtccgtgtttcactttttcctttatatttgcttatggtgacaatatatacaatatatatattggcaccatggcgactcggaccgatg

SEQ ID NO: 11946 - DNA, 203 bp, Homo sapiens
ggcgcgccagtcctaaggagcgcgacacacatgttccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccacttcgactcggaccgatg

SEQ ID NO: 11947 - DNA, 203 bp, Homo sapiens
ggcgcgccagtcctgaccactccgaccccagtcgatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagacgactcggaccgatg

SEQ ID NO: 11948 - DNA, 203 bp, Homo sapiens
ggcgcgccagtcctgtcattctcgaccgcattgcaatccccagcagagacccagtgcatgtggcaggagcggtgagatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 11949 - DNA, 203 bp, Homo sapiens
ggcgcgccagtcctctgcaatacgaccgcattgcggcttggttttctcacccagtgcatgtgaggaataattctccatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 11950 - DNA, 203 bp, Homo sapiens
ggcgcgccagtcctacttcgaacgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 11951 - DNA, 203 bp, Homo sapiens
ggcgcgccagtcctctctgatccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgtgaataaaagagagcgactcggaccgatg

SEQ ID NO: 11952 - DNA, 203 bp, Homo sapiens
ggcgcgccagtccttgcaggaccgaccgcattgcggcttggttttctcacccagtgcatgtggcaggagcggtgagatcactgcctcacggcgatcctggactgacggtcacgactgcctaccctctaaccctgttctgagctgccgtaaaatacagggtcccaaacctgtgtgcaggatccgcctcccgactcggaccgatg

SEQ ID NO: 11953 - DNA, 203 bp, Homo sapiens
ggcgcgccagtcctatccttcccgaccgcattgcggcttggttttctcacccagtgcatgtggcaggagcggtgagatcactgcctcacggcgatcctggactggaataattccaatactaccctctaaccctgttctgagctgccccttgcccacacaccccaaacctgtgtgcaggatccgcctcccgactcggaccgatg

SEQ ID NO: 11954 - DNA, 203 bp, Homo sapiens
ggcgcgccagtcctgattcgcccgaccgcattgcggcttggttttctcacccagtgcatgtggcaggagcggtgagcctctccagagtacgcgatcctggactgacggtcacgactgcctaccctctaaccctgttctgagctgccccttgcccacacaccccaaacctgtgtgcaggatccgcctcccgactcggaccgatg

SEQ ID NO: 11955 - DNA, 203 bp, Homo sapiens
ggcgcgccagtcctggatgggacgaccgcattgcggcttggttttctcggttcaaaatacacgcaggagcggtgagatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 11956 - DNA, 203 bp, Homo sapiens
ggcgcgccagtcctaccaactgcgactcgccctcggccttccgcgccagccgcagccacagcattcctagactgtacagccacagccacagccacagccccaggcatagccttcggcacagccccggctccggctcctgcggcagctcctctgggcaccgtccctgcgccgacatcctggaggttgggcgactcggaccgatg

SEQ ID NO: 11957 - DNA, 203 bp, Homo sapiens
ggcgcgccagtcctggaatcaacgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacaatagacgtcaccctcgactcggaccgatg

SEQ ID NO: 11958 - DNA, 203 bp, Homo sapiens
ggcgcgccagtcctgcattgtacgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggcgactcggaccgatg

SEQ ID NO: 11959 - DNA, 203 bp, Homo sapiens
ggcgcgccagtcctaactgattcgagatgccacgtggacgagggcatgcccaaagcacatcttaacctgagcgggggtcgcccaggtaaaagcagttttaaccgactgttacgaatacagcctgatagggtgggttttcattgggatgtattgctactaaaaatctctgctgtacatggcacatggagcgactcggaccgatg

SEQ ID NO: 11960 - DNA, 203 bp, Homo sapiens
ggcgcgccagtcctggcacacgcgatctcttgtcagatctcattaaataagcgtgcccatgtcaagattccctgttatccatgcttgtgagtgtggtttaatcataatcttgtattttactttccacacttttcatctctctgccagtgacgtgttggttgtcctcagcgtccctcccataggtcgcacgactcggaccgatg

SEQ ID NO: 11961 - DNA, 203 bp, Homo sapiens
ggcgcgccagtccttcgatcgtcgatctcttgtcagatctcattaaatctaaactttttaaacaagattccctgttatccatgcttgtgacctgacaaccgctttaatcttgtattttactttccacacttttcatctctctgccagtgacgtgttggttgtcctcagcgtccctcccataggtcgcacgactcggaccgatg

SEQ ID NO: 11962 - DNA, 203 bp, Homo sapiens
ggcgcgccagtcctgatccagacgatctcttgtcagatctcattaaatctaaactttttaaacaagattccctgttatccatgcttgtgagtgtggtttaatcacgcatggccggccgactttccacacttttcatctctctgccagtgacgtgttggttgtcctcagcgtccctcccataggtcgcacgactcggaccgatg

SEQ ID NO: 11963 - DNA, 203 bp, Homo sapiens
ggcgcgccagtccttggagtagcgatctcttgtccttagaatggttcgctaaactttttaaacaagattccctgttatccatgcttgtgagtgtggtttaatcataatcttgtattttactttccacacttttcatctctctgccagtgacgtgttggttgtcctcagcgtccctcccataggtcgcacgactcggaccgatg

SEQ ID NO: 11964 - DNA, 203 bp, Homo sapiens
ggcgcgccagtcctacttgtcacgattgtgttaggccgttctcagcgctgcccgaccccgctcgcgcgccctcccgccgccagtcccggcagcgccctcagttgtcctccgactcgccctcggccttccgcgccagccgcagccacagccgcaacgccacccgcagccacagccacagccacagcccccgactcggaccgatg

SEQ ID NO: 11965 - DNA, 203 bp, Homo sapiens
ggcgcgccagtccttttacgaccgatttaaactagccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagcgactcggaccgatg

SEQ ID NO: 11966 - DNA, 203 bp, Homo sapiens
ggcgcgccagtcctgtcgtcaacgcaaagccggtggcgcccggaggctaagtctcagatcccgcccgcgtcagagcctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 11967 - DNA, 203 bp, Homo sapiens
ggcgcgccagtccttttgtccccgcaaagccggtggcgcccggaggctctggtacccttctcgcccgcgtcagagcctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 11968 - DNA, 203 bp, Homo sapiens
ggcgcgccagtcctcagacccacgcaaagccggtggcgcccggaggctgcacggagagcggtaagatttctgccctctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 11969 - DNA, 203 bp, Homo sapiens
ggcgcgccagtcctcgcactgtcgcaaagccggtggcgcccggaggctgcacggagagcggtaatgaatatccgttctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 11970 - DNA, 203 bp, Homo sapiens
ggcgcgccagtcctctactgcgcgcaaagccggtggcgcccggaggctgcacggagagcggtgcccgcgtcagagcaggaagtgacgcataggctggagtacagtggcgcgatctcggctcactgcaacttccacctgctgggttcaagcaattcttctgacctcagtgaccgaaggaagagaccaagcgactcggaccgatg

SEQ ID NO: 11971 - DNA, 203 bp, Homo sapiens
ggcgcgccagtcctatacgtctcgcaaagccggtggcgcccggaggctgcacggagagcggtgcccgcgtcagagcctcgccctgtcaccaggctggagtacagtggcgcgatctcggctcactgcaacttccacctgctgggttcaagcaattcttctggtaatgacatggctaggaagagaccaagcgactcggaccgatg

SEQ ID NO: 11972 - DNA, 203 bp, Homo sapiens
ggcgcgccagtcctatggctcccgcaaagccggtggcgcccggaggctgcacggagagcggtgcccgcgtcagagcctcgccctgtcaccaggctggagtacagtggcgcgatctcggctcactgcaacttccacctgctgggttcaagcaattcttctggtgaaccgataacgaggaagagaccaagcgactcggaccgatg

SEQ ID NO: 11973 - DNA, 203 bp, Homo sapiens
ggcgcgccagtcctggtgatatcgcaaagccggtggcgcccggaggctgcacggagagcggtgcccgcgtcagagcctcgccctgtcaccaggctggagtacagtggcgcgatctcggctcactgcaacttccacctgctgggttctttactgctgcagcacctcagtgaccgaaggaagagaccaagcgactcggaccgatg

SEQ ID NO: 11974 - DNA, 203 bp, Homo sapiens
ggcgcgccagtcctctccgtgccgcaaagccggtggcgcccggaggctgcacggagagcggtgcccgcgtcagagcctcgccctgtcaccaggctggagtacagtggcgcgatctcggctcactgcaacttctggtattcataactaagcaattcttctgacctcagtgaccgaaggaagagaccaagcgactcggaccgatg

SEQ ID NO: 11975 - DNA, 203 bp, Homo sapiens
ggcgcgccagtcctcatatcttcgcactgcttgacggcagcggtgtccgccccacggccggcgttgccggggtaacggcgagcgcgtggggccaagaaagaatacctcctctgaaaaagaaggagtagcagattccatgccccaaagaggaaaagaagagtgtatgagacttacgagtctccattgcccgactcggaccgatg

SEQ ID NO: 11976 - DNA, 203 bp, Homo sapiens
ggcgcgccagtcctcaccacaacgcactgcttgacggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttactctcgaaggcatagcgactcggaccgatg

SEQ ID NO: 11977 - DNA, 203 bp, Homo sapiens
ggcgcgccagtcctcgtttgttcgcactgcttgacggcagcggtgtccgccccacggccggcgttgccggggtaacttaatcgagaacccgccaagaaagaatacctcctctgaaaaatggcagaagcagttttccatgccccaaagaggaaaagaagagtgtatgagacttacgagtctccattgcccgactcggaccgatg

SEQ ID NO: 11978 - DNA, 203 bp, Homo sapiens
ggcgcgccagtcctaaatggcacgcactgcttgacggcagcggtgtcctttaggaccaaatggttgccggggtaacggcgagcgcgtggggccaagaaagaatacctcctctgaaaaatggcagaagcagttttccatgccccaaagaggaaaagaagagtgtatgagacttacgagtctccattgcccgactcggaccgatg

SEQ ID NO: 11979 - DNA, 203 bp, Homo sapiens
ggcgcgccagtcctatggtagtcgcagtccagagggctgcgctgctcggggtaagtatccaaagaagggggtgacgctgggcagcggcgaggagcgcgccgctgcctctggcgggctttcggcttgaggggcaaggtgaagagcgcaccggccgtggggtttaccgagctggatttgtatgttgcacccgactcggaccgatg

SEQ ID NO: 11980 - DNA, 203 bp, Homo sapiens
ggcgcgccagtcctactctgttcgcagtccagagggctgcgctgctcgtcccctcggctggcagaagggggtgacgctgggcagcggcgacacatcgaggttcccctctggcgggctttcggcttgaggggcaaggtgaagagcgcaccggccgtggggtttaccgagctggatttgtatgttgcacccgactcggaccgatg

SEQ ID NO: 11981 - DNA, 203 bp, Homo sapiens
ggcgcgccagtccttttgaaatcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatcccccataaatgttcgactcggaccgatg

SEQ ID NO: 11982 - DNA, 203 bp, Homo sapiens
ggcgcgccagtcctccggctgacgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcacccgactcggaccgatg

SEQ ID NO: 11983 - DNA, 203 bp, Homo sapiens
ggcgcgccagtcctccacttggcgcagtccagagggctgcgctgctcgtcccctcggctggcagaagggggtgacgggcttagctcatagggagcgcgccgctgcctctggcgggctttcggcttgaggggcaaggtgaagagcgcaccggccgtggggtttaccgagctggatttgtatgttgcacccgactcggaccgatg

SEQ ID NO: 11984 - DNA, 203 bp, Homo sapiens
ggcgcgccagtccttactctatcgccaacaaggcaatgtcaatcacttcttgtttactccgaaccccagaatccattaagaaaaacttaggagacaggtataatattctcatacctgtccattcaccttggacttaaagagagacaatcattcagccccgtccaagacacacctgagtggccagaacccgactcggaccgatg

SEQ ID NO: 11985 - DNA, 203 bp, Homo sapiens
ggcgcgccagtcctggcacggacgccaacaaggcaatgtcaatcacttgaatgcaggggtagaccccagaatccatgcgtctgggacatagagacaggtataatattctcatacctgtccattcaccttggacttaaagagagacaatcattcagccccgtccaagacacacctgagtggccagaacccgactcggaccgatg

SEQ ID NO: 11986 - DNA, 203 bp, Homo sapiens
ggcgcgccagtcctactggtttcgccaacaaggcaatgtcaatcacttgaatgcaggggtagaccccagaatccattaagaaaaacttagcttgggtcggattgattctcatacctgtccattcaccttggacttaaagagagacaatcattcagccccgtccaagacacacctgagtggccagaacccgactcggaccgatg

SEQ ID NO: 11987 - DNA, 203 bp, Homo sapiens
ggcgcgccagtccttgtaagagcgccaacaaggcaatgtcaatcacttgaatgcaggggtagaccccagaatccattaagaaaaacttaggagacaggtataatattctcatacctgtccattcaccttggacttaaagagagacaatcattcagccccgtccaagacacacctcgtccttagcccggcgactcggaccgatg

SEQ ID NO: 11988 - DNA, 203 bp, Homo sapiens
ggcgcgccagtcctagcgaaaccgccaacaaggcaatgtcaatcacttgaatgcaggggtagaccccagaatccattaagaaaaacttaggagacaggtataatattctcatacctgtccattcaccttggacttaaagagagacacaggacagtatggctccaagacacacctgagtggccagaacccgactcggaccgatg

SEQ ID NO: 11989 - DNA, 203 bp, Homo sapiens
ggcgcgccagtcctcctagtgacgccaacaaggcaatgtcaatcacttgaatgcaggggtagaccccagaatccattaagaaaaacttaggagacaggtataatccaacgggcttatcccattcaccttggacttaaagagagacaatcattcagccccgtccaagacacacctgagtggccagaacccgactcggaccgatg

SEQ ID NO: 11990 - DNA, 203 bp, Homo sapiens
ggcgcgccagtccttaataggccgccaacaaggctcgacgttatgggagaatgcaggggtagaccccagaatccattaagaaaaacttaggagacaggtataatattctcatacctgtccattcaccttggacttaaagagagacaatcattcagccccgtccaagacacacctgagtggccagaacccgactcggaccgatg

SEQ ID NO: 11991 - DNA, 203 bp, Homo sapiens
ggcgcgccagtccttatgacaccgccagtcggagcccccggcccagcgtggtccgcctccctctgggcgtccacctgcccggagtactgccagcgggcatgacctcattctgtacatagccgccgccggcgctcgcaggccgcggatgaagaagaaaacccggcgccgctcgacccggagcgaggagtcgactcggaccgatg

SEQ ID NO: 11992 - DNA, 203 bp, Homo sapiens
ggcgcgccagtccttatgtactcgccccgacccgcttactccgagtaaccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcgactcggaccgatg

SEQ ID NO: 11993 - DNA, 203 bp, Homo sapiens
ggcgcgccagtcctcctataatcgccccgacccgtgcgagggccaggtaatgcttaaatttcccaggcgaagcgaggcgacccgcgtgcggccatggcttcgctgctgggagcctacccttggcccgagggtctcgagtgcccggccctggacgccgagctgtcggatggacaatcgccgccggccgtcgactcggaccgatg

SEQ ID NO: 11994 - DNA, 203 bp, Homo sapiens
ggcgcgccagtccttacaatgacgccccgacccgtgcgagggccaggtccgcgcctgccccgccaggcgaagcgagattgattaacccttgccatggcttcgctgctgggagcctacccttggcccgagggtctcgagtgcccggccctggacgccgagctgtcggatggacaatcgccgccggccgtcgactcggaccgatg

SEQ ID NO: 11995 - DNA, 203 bp, Homo sapiens
ggcgcgccagtccttccaaacgcgccctgcccccagccccgccactcccaggctcctcgggactcggcgggtcctcactcactcgaacccggggaccggctgtgcagagaacttcagccaaagcatctgagacgggaagcagaaaaaggagggacagtttggagaagaaaaacgcagctgtgtacgcccgactcggaccgatg

SEQ ID NO: 11996 - DNA, 203 bp, Homo sapiens
ggcgcgccagtcctagtagttccgccctgcccccagccccgccactcccaggctcctcgggactcggcgggtcctcctgggagtctcggaggggaccggctgtgcagagaacttcagccaaagcatctgagacgggaagcagaaaaaggagggacagtttcctattctctggtacagctgtgtacgcccgactcggaccgatg

SEQ ID NO: 11997 - DNA, 203 bp, Homo sapiens
ggcgcgccagtcctgttacaatcgccctgcccccagccccgccactcccaggctcctcgggactcggcgggtcctcctgggagtctcggaggggaccggctgtgcagagaacttcagccaaagcatctgagacgggaagcagaaaaaggagggacagtttggagaagaaaaacgcagctgtgtacgcccgactcggaccgatg

SEQ ID NO: 11998 - DNA, 203 bp, Homo sapiens
ggcgcgccagtcctgcgacagccgccctgcccccagccccgccactccggaaaagtgttcatctcggcgggtcctcctgggagtctcggaggggaccggctgtgcagagaacttcagccaaagcatctgagacgggaagcagaaaaaggagggacagtttggagaagaaaaacgcagctgtgtacgcccgactcggaccgatg

SEQ ID NO: 11999 - DNA, 203 bp, Homo sapiens
ggcgcgccagtcctcacggatgcgccgccatgctcttcttttttctataggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtcgactcggaccgatg

SEQ ID NO: 12000 - DNA, 203 bp, Homo sapiens
ggcgcgccagtcctttgacgcacgccgccatgctgcagaagcgggagaaggtgctgctgctgaggaccttccagggccgcacgctgcggagatcatcttccatttacctgcggccctgcgtgccctgccacagcccgctctgcccgcagcccgccgcctgcagccacgatgggaaactcttgtctagtcgactcggaccgatg

SEQ ID NO: 12001 - DNA, 203 bp, Homo sapiens
ggcgcgccagtcctcgacatttcgccgccatgctgcagaagcgggagaaggtgctgctgctgaggaccttccagggccgcacgctgcggatcgtgcgcgagcactacctgcggccctgcgtgccctgccacagcccgctctgcccgcagcccgccgcctgcagccacgatgggagctcgcgtcgagtgcgactcggaccgatg

SEQ ID NO: 12002 - DNA, 203 bp, Homo sapiens
ggcgcgccagtcctggttagtccgccgccatgctgcagaagcgggagaaggtgctgctgctgaggaccttccagggccgcacgctgcggatcgtgcgcgagcactacctgcggccctgcgtgccctgccacagcccgctctgcccgggaataattatggtcagccacgatgggaaactcttgtctagtcgactcggaccgatg

SEQ ID NO: 12003 - DNA, 203 bp, Homo sapiens
ggcgcgccagtcctgcgcccagcgccgccatgctgcagaagcgggagaaggtgctgctgctgaggaccttccagggccgcacgctgcggatcgtgcgcgagcactacctgcggccctgcgtgccctgccacatttactagaaaggtcagcccgccgcctgcagccacgatgggaaactcttgtctagtcgactcggaccgatg

SEQ ID NO: 12004 - DNA, 203 bp, Homo sapiens
ggcgcgccagtccttcaccgctcgccgccatgctgcagaagcgggagaaggtgctgctgctgaggaccttccagggccgcacgctgcggatcgtgcgcgagcactacctgcggccctggcattagctaattcgcccgctctgcccgcagcccgccgcctgcagccacgatgggaaactcttgtctagtcgactcggaccgatg

SEQ ID NO: 12005 - DNA, 203 bp, Homo sapiens
ggcgcgccagtcctacttataccgccgccgcagcaattactttgaggccccccgccgggtgcctaagcaggcccggcgcggccccaggacttgggaccctggaggactgacgctgctggcctgggcgtccccttccgctgagccatggcgactcccgacgtgagtgtgcacatggaggaggtggtggtcgactcggaccgatg

SEQ ID NO: 12006 - DNA, 203 bp, Homo sapiens
ggcgcgccagtcctggattatccgccgccgcagctcccgacgccgccgcccccgccgggtgcctaagcaggcccggcgcggccccaggacttgggaccctggaggactgacgctgctggcctgggcgtccccttccgctgagccatcctcctgtttctgctgagtgtgcacatggaggaggtggtggtcgactcggaccgatg

SEQ ID NO: 12007 - DNA, 203 bp, Homo sapiens
ggcgcgccagtcctagattaaacgccgccgcagctcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggtcgactcggaccgatg

SEQ ID NO: 12008 - DNA, 203 bp, Homo sapiens
ggcgcgccagtcctcactcgaacgccgccgcagctcccgacgccgccgcccgtcggcaccgcctaagcaggcccggcgcggccccaggacttgggaccctggaggactgacgctgctggcctgggcgtccccttccgctgagccatggcattgatggacgtgagtgtgcacatggaggaggtggtggtcgactcggaccgatg

SEQ ID NO: 12009 - DNA, 203 bp, Homo sapiens
ggcgcgccagtcctttctcggccgccgggcgcacacactcgcacccgcgcacgcaccgccagcaggcagcggccaccgccgcgatgctcgcccgcgggttggggaagtttcccgccggcctcggccgcgggcacccgtgctcccaggtgtagcgcccccggaatcgtttacgttccggcgcctccagccgactcggaccgatg

SEQ ID NO: 12010 - DNA, 203 bp, Homo sapiens
ggcgcgccagtcctgtgcgaatcgccgggcgcacacactcgcacccgcgcacgcaccgccagcaggcagcggccaccgccgcgatgctcgcccgcgggttggggaagtttcccgccggtaggccgaatactaacccgtgctcccaggtgtagcgcccccgcgcggcgcgggcggccggcgcctccagccgactcggaccgatg

SEQ ID NO: 12011 - DNA, 203 bp, Homo sapiens
ggcgcgccagtccttccctgtacgcctcggaattctccaaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaaccgactcggaccgatg

SEQ ID NO: 12012 - DNA, 203 bp, Homo sapiens
ggcgcgccagtccttatactgtcgcgaagacgcaaataaaaaatattgcatacgttgacgaaacaaattttcgttgcatacccaataaaagattattatattgcataccttttcttgccataccatttagccgatcaattgtgctcggcaacagtatatttgtggtgtgccaaccaacaaccaatgagcgactcggaccgatg

SEQ ID NO: 12013 - DNA, 203 bp, Homo sapiens
ggcgcgccagtcctaagagacacgcgccgggcgcagggagctgagtggacggctcgagacggcggcgcgtgcagcacacgggtgcgtttccgagttggcagagcagggctgcatttccagcaggagctgcgagcacagtgctggctcacaacaagatgctcaaggtgtcagccgtactgtgtgtgtgtcgactcggaccgatg

SEQ ID NO: 12014 - DNA, 203 bp, Homo sapiens
ggcgcgccagtcctggacaacccgcgccgggcgcagggagctgagtggacggctcgagacggcggcgcgtgcagcagctccagaaagcagcgagttggcagagcagggctgcatttccagcaggagctgcgagcacagtgctggctcacaacaagatgcttggcacacggcgtttactgtgtgtgtgtcgactcggaccgatg

SEQ ID NO: 12015 - DNA, 203 bp, Homo sapiens
ggcgcgccagtcctaattcgttcgcgccgggcgcagggagctgagtggacggctcgagacggcggcgcgtgcagcagctccagaaagcagcgagttggcagagcagggctgcatttccagcaggagctgcgagcacagtgctggctggtgctttcgaatgcaaggtgtcagccgtactgtgtgtgtgtcgactcggaccgatg

SEQ ID NO: 12016 - DNA, 203 bp, Homo sapiens
ggcgcgccagtcctccgctgcccgcgccgggcgcagggagctgagtggacggctcgagacggcggcgcgtgcagcagctccagaaagcagcgagttggcagagcagggctgcatttccttgccacatgataggcacagtgctggctcacaacaagatgctcaaggtgtcagccgtactgtgtgtgtgtcgactcggaccgatg

SEQ ID NO: 12017 - DNA, 203 bp, Homo sapiens
ggcgcgccagtcctagtattaacgcgccgggcgcagggagctgagtggctactcgttttgatcggcgcgtgcagcagctccagaaagcagcgagttggcagagcagggctgcatttccagcaggagctgcgagcacagtgctggctcacaacaagatgctcaaggtgtcagccgtactgtgtgtgtgtcgactcggaccgatg

SEQ ID NO: 12018 - DNA, 203 bp, Homo sapiens
ggcgcgccagtcctactgcgtgcgcgccgggcgccaaaccggatccaaacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtcgactcggaccgatg

SEQ ID NO: 12019 - DNA, 203 bp, Homo sapiens
ggcgcgccagtccttaagattgcgcgcgcgagagaagagagtattctcgcgagaagtccaggggtggccgtgatggcggcggcaggagcaggacctggccaggaagcgggtgccgggcctggcccaggagcgccaattcggagttaaggggcagaagagggggagatgaagccggtggcagcgggagccgactcggaccgatg

SEQ ID NO: 12020 - DNA, 203 bp, Homo sapiens
ggcgcgccagtcctgcacctcacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagaggccacttaacttaaagtggcagcgggagccgactcggaccgatg

SEQ ID NO: 12021 - DNA, 203 bp, Homo sapiens
ggcgcgccagtcctgggagccacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagccgactcggaccgatg

SEQ ID NO: 12022 - DNA, 203 bp, Homo sapiens
ggcgcgccagtccttgtcgtttcgcgctcacgtccgcgtccccaagggctgcgctccctcaagcgcagtgcccagaactcggagccagcccggcccgggggaccctgctggccaaggaggtcgtcagtccgggaaaccaccattatcccggaggaccgaagcttccggacgacgaggaaccgcccaaccgactcggaccgatg

SEQ ID NO: 12023 - DNA, 203 bp, Homo sapiens
ggcgcgccagtcctgcggatctcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaaccgactcggaccgatg

SEQ ID NO: 12024 - DNA, 203 bp, Homo sapiens
ggcgcgccagtcctattgtcttcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgtacttatagggtctcgactcggaccgatg

SEQ ID NO: 12025 - DNA, 203 bp, Homo sapiens
ggcgcgccagtcctcacctggtcgcgctcacgtccgcgtccccaagggctgcgctccctcaagcgcagtgcccagaactcggagccagcccggcccgggggaccctgctggccaaggaggtcgtcagtccggtcttgtcttccagatgtcagtatttttggcttccggacgacgaggaaccgcccaaccgactcggaccgatg

SEQ ID NO: 12026 - DNA, 203 bp, Homo sapiens
ggcgcgccagtcctgttgtaaccgcgggcagcggagcgggcgccaggcacagaaccgtcccagcgctaccgggcgtcggccctgggcagtgacggggttcgggtgaccatggagagtgcgctcaccgcccgtgaccgggtgggggtgcaggatttcgtgctgctggagaacttcaccagcgaggccgccgactcggaccgatg

SEQ ID NO: 12027 - DNA, 203 bp, Homo sapiens
ggcgcgccagtcctgcgcatgccgcgggcagcggagcgggcgccaggccggccgggcaggatgcgctaccgggcgtcggccctgggcagtcgaatctaaactcggaccatggagagtgcgctcaccgcccgtgaccgggtgggggtgcaggatttcgtgctgctggagaacttcaccagcgaggccgccgactcggaccgatg

SEQ ID NO: 12028 - DNA, 203 bp, Homo sapiens
ggcgcgccagtcctgtgtttagcgcgggcagcggagcgggcgccaggccggccgggcaggatgcgctaccgggcgtttcgatgcccatacgacggggttcgggtgaccatggagagtgcgctcaccgcccgtgaccgggtgggggtgcaggatttcgtgctgctggagaacttcaccagcgaggccgccgactcggaccgatg

SEQ ID NO: 12029 - DNA, 203 bp, Homo sapiens
ggcgcgccagtcctgggtaaggcgcgggcagcggtctaattttgcaaacggccgggcaggatgcgctaccgggcgtcggccctgggcagtgacggggttcgggtgaccatggagagtgcgctcaccgcccgtgaccgggtgggggtgcaggatttcgtgctgctggagaacttcaccagcgaggccgccgactcggaccgatg

SEQ ID NO: 12030 - DNA, 203 bp, Homo sapiens
ggcgcgccagtcctcgtgtcatcgcggggaggggagggcgttagccagcgtggcgctggctcccggaatatggagccctgggcgcgggggcggcgtgtcaggtggttgcggagctggtaagaatcatattctaagaactcagccacgttaccgctttgattggtgctgggtcctgaacagaagatgtccgactcggaccgatg

SEQ ID NO: 12031 - DNA, 203 bp, Homo sapiens
ggcgcgccagtccttgcttgtgcgcggggaggggagggcgttagccagcgtggcgctggctcccggaatatggagccctgggcgcgggggcggcgtgtcaggtggttgcggagctggtaagaatcatattctaagaactcagccactcaggtatccaccatggtgctgggtccttgcggagttccaaacgactcggaccgatg

SEQ ID NO: 12032 - DNA, 203 bp, Homo sapiens
ggcgcgccagtcctggaggcagcgcggggaggggagggcgttagccagttattgttgtcaagccggaatatggagccctgggcgcgggggcggcgtgtcaggtggttgcggagctggtaagaatcatattctaagaactcagccactcaggtatccaccatggtgctgggtcctgaacagaagatgtccgactcggaccgatg

SEQ ID NO: 12033 - DNA, 203 bp, Homo sapiens
ggcgcgccagtcctcgcaatcgcgcggggaggggttaaataggtgagacgtggcgctggctcccggaatatggagccctgggcgcgggggcggcgtgtcaggtggttgcggagctggtaagaatcatattctaagaactcagccactcaggtatccaccatggtgctgggtcctgaacagaagatgtccgactcggaccgatg

SEQ ID NO: 12034 - DNA, 203 bp, Homo sapiens
ggcgcgccagtcctccgtggtgcgcggtaagcgcgacgaatgttcaggagctaaccgcacccggttcagctcgcctttcttggccagaggcgccggttggactcacgggcggggcatgatggtggtgggtacgggcacctcgctggcgctctcctccctcctgtccctgctgctctttgctgggatgccgactcggaccgatg

SEQ ID NO: 12035 - DNA, 203 bp, Homo sapiens
ggcgcgccagtcctcttcagatcgcggtaagcgctgacgcatgcgcatagctaaccgcacccggttcagctcgcctgcacctcggtcaggcgccggttggactcacgggcggggcatgatggtggtgggtacgggcacctcgctggcgctcgttctattcctgtccctgctgctctttgctgggatgccgactcggaccgatg

SEQ ID NO: 12036 - DNA, 203 bp, Homo sapiens
ggcgcgccagtcctcggcctcccgcggtaagcgctgacgcatgcgcatagctaaccgcacccggttcagctcgcctgcacctcggtcaggcgccggttggactcacgggcggggcatgatggtggtgggtacgggcacctcgctggcgctctcctccctcctgtccctgctgctctttgctgggatgccgactcggaccgatg

SEQ ID NO: 12037 - DNA, 203 bp, Homo sapiens
ggcgcgccagtcctgcgtaattcgcggtaagcgctgacgcatgcgcatagctaaccgcacccggttcagctcgcctttcttggccagaggcgccggttggactcacgggcggggcatgatggtggtgggtacataattaatttcaacgctctcctccctcctgtccctgctgctctttgctgggatgccgactcggaccgatg

SEQ ID NO: 12038 - DNA, 203 bp, Homo sapiens
ggcgcgccagtccttcaacctacgcggtaagcgctgacgcatgcgcatagctaaccgcacccggttcagctcgcctttcttggccagaggcgccggttggactcacgggcggggcatgatggtggtgggtacgggcacctcgctggcgctcgttctattcctgtccctgctgctctttgctgggatgccgactcggaccgatg

SEQ ID NO: 12039 - DNA, 203 bp, Homo sapiens
ggcgcgccagtcctaggcgtaccgcggtaagcgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctggagttcccctgctcgactcggaccgatg

SEQ ID NO: 12040 - DNA, 203 bp, Homo sapiens
ggcgcgccagtcctaaccgacgcgcggtaagcgctgacgcatgcgcatagctaaccgcacccggttcagctcgcctttcttggccagaggcgccggttggactcacgggcggggcatgatggtggtgggtacgggcacctcgctgggagcgatacgagctctgtccctgctgctctttgctgggatgccgactcggaccgatg

SEQ ID NO: 12041 - DNA, 203 bp, Homo sapiens
ggcgcgccagtcctgtgatacgcgcggtaagcgctgacgcatgcgcatagctaaccgcacccggttcagctcgcctttcttggccagaggtcagttgactgaaaacgggcggggcatgatggtggtgggtacgggcacctcgctggcgctctcctccctcctgtccctgctgctctttgctgggatgccgactcggaccgatg

SEQ ID NO: 12042 - DNA, 203 bp, Homo sapiens
ggcgcgccagtcctttcgtctgcgcggtaagcgctgacgcatgcgcatagctaaccgcacccttacgtatctctgattcttggccagaggcgccggttggactcacgggcggggcatgatggtggtgggtacgggcacctcgctggcgctctcctccctcctgtccctgctgctctttgctgggatgccgactcggaccgatg

SEQ ID NO: 12043 - DNA, 203 bp, Homo sapiens
ggcgcgccagtcctttcatgttcgcggtaagcgctgacgcatgcgcatgtgcgttgatgtttggttcagctcgcctttcttggccagaggcgccggttggactcacgggcggggcatgatggtggtgggtacgggcacctcgctggcgctctcctccctcctgtccctgctgctctttgctgggatgccgactcggaccgatg

SEQ ID NO: 12044 - DNA, 203 bp, Homo sapiens
ggcgcgccagtcctgacggcggcgctatactgaagacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatatcgactcggaccgatg

SEQ ID NO: 12045 - DNA, 203 bp, Homo sapiens
ggcgcgccagtcctcaggaaatcgctcagcagggacgtatgacactccagctctgtggtatctgattgttgttgaaccgtctctaagacggtgatactataagtcgtggtttgtgtgtttgtttgttaccttgtgtttgttcgtcacttgtcgacagcgccctgcgaattggtgtacccacaccgcgccgactcggaccgatg

SEQ ID NO: 12046 - DNA, 203 bp, Homo sapiens
ggcgcgccagtccttccgacggcgctcagcaggggacgccctggtctgagctctgtggtatcaaggaagctgctcgccgtctctaagacggtgatactataagtcgtggtttgtgtgtttgtttgttaccttgtgtttgttcgtcacttgtcgacagcgccctgcgaattggtgtacccacaccgcgccgactcggaccgatg

SEQ ID NO: 12047 - DNA, 203 bp, Homo sapiens
ggcgcgccagtccttcatgtaccgctcagcaggggacgccctggtctgagctctgtggtatctgattgttgttgaaccgtctctaagacgaacgacgacggttacgtggtttgtgtgtttgtttgttaccttgtgtttgttcgtcacttgtcgacagcgccctgcgaattggtgtacccacaccgcgccgactcggaccgatg

SEQ ID NO: 12048 - DNA, 203 bp, Homo sapiens
ggcgcgccagtccttatgcttccgctcagcaggggacgccctggtctgagctctgtggtatctgattgttgttgaaccgtctctaagacggtgatactataagtcgtggtttgtgtgtttgtttgttaccttgtgtttgttcgtcacttgtcgacagcgcaagatcggggtacttacccacaccgcgccgactcggaccgatg

SEQ ID NO: 12049 - DNA, 203 bp, Homo sapiens
ggcgcgccagtccttgaatgtacgctcagcaggggacgccctggtctgagctctgtggtatctgattgttgttgaatgcggggagcacacgtgatactataagtcgtggtttgtgtgtttgtttgttaccttgtgtttgttcgtcacttgtcgacagcgccctgcgaattggtgtacccacaccgcgccgactcggaccgatg

SEQ ID NO: 12050 - DNA, 203 bp, Homo sapiens
ggcgcgccagtcctatgacctacgctcattctaaggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaaccgactcggaccgatg

SEQ ID NO: 12051 - DNA, 203 bp, Homo sapiens
ggcgcgccagtcctgtctgagtcgctccggcaaccttgttgtggaacgtgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaaccgactcggaccgatg

SEQ ID NO: 12052 - DNA, 203 bp, Homo sapiens
ggcgcgccagtccttgtcccagcgctccggcaacgccaaccgctccgcgagttatcttacaagctgcaggctctcggctgcagcgctgggtgtcttcaggcctatggagagcagcttgcgtgggctgggcctgcagtacctggtttgcatagatgattggcaggtggatctaggatccggcttccaaccgactcggaccgatg

SEQ ID NO: 12053 - DNA, 203 bp, Homo sapiens
ggcgcgccagtcctgcatgtcgcgctccggcaacgccaaccgctccgctgcgcgcaggctgggctgcaggctctcgaaactgtgaggacctgtcttcaggcctatggagagcagcttgcgtgggctgggcctgcagtacctggtttgcatagatgattggcaggtggatctaggatccggcttccaaccgactcggaccgatg

SEQ ID NO: 12054 - DNA, 203 bp, Homo sapiens
ggcgcgccagtcctgcccttagcgctccggcaacgccaaccgctccgctgcgcgcaggctgggctgcaggctctcggctgcagcgctgggtgtcttcaggcctatggagagcagcttgcgtgggctgggcctgcagtacctggtttagcagctaatgactcaggtggatctaggatccggcttccaaccgactcggaccgatg

SEQ ID NO: 12055 - DNA, 203 bp, Homo sapiens
ggcgcgccagtccttctatatccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggttaccaagaaccttatccggcttccaaccgactcggaccgatg

SEQ ID NO: 12056 - DNA, 203 bp, Homo sapiens
ggcgcgccagtccttattaagtcgctccggcaacgccaaccgctccgctgcgcgcaggctgggctgcaggctctcggctgcagcgctgggtgtcttcaggcctatggagagcagcttgtcctcatattctaagcagtacctggtttgcatagatgattggcaggtggatctaggatccggcttccaaccgactcggaccgatg

SEQ ID NO: 12057 - DNA, 203 bp, Homo sapiens
ggcgcgccagtcctaggctcttcgctccggcaacgccaaccgctccgctgcgcgcaggctggtgactttatgaaatgctgcagcgctgggtgtcttcaggcctatggagagcagcttgcgtgggctgggcctgcagtacctggtttgcatagatgattggcaggtggatctaggatccggcttccaaccgactcggaccgatg

SEQ ID NO: 12058 - DNA, 203 bp, Homo sapiens
ggcgcgccagtcctcgataacgcgctcctagagctcgggccgtggctccaactttggccaaccttttggctccgagggcagtcgctgggcttccgagaggggttcgggctgcgtaggggcgctttgttttgttcggttttgtttttttgagagtgcgagagaggcggtcgtgcagacccgggagaaagcgactcggaccgatg

SEQ ID NO: 12059 - DNA, 203 bp, Homo sapiens
ggcgcgccagtcctattggacccgctcctagagctcgggccgtggctcgtcggggtctgtgtcttttggctccgagggcagtcgctgggcttccgagaggggttcgggctgcgtaggggcgctttgttttgttcggttttgtttttaaattgacttataggaggcggtcgtgcagacccgggagaaagcgactcggaccgatg

SEQ ID NO: 12060 - DNA, 203 bp, Homo sapiens
ggcgcgccagtcctccaacggccgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagacgcctctagaccgtgacccgggagaaagcgactcggaccgatg

SEQ ID NO: 12061 - DNA, 203 bp, Homo sapiens
ggcgcgccagtcctggtttcggcgctcctagagctcgggccgtggctcgtcggggtctgtgtcttttggctccgagggcagtcgctgggcttccgagaggggttcgggctgcgtagggtgataggtagccactcggttttgtttttttgagagtgcgagagaggcggtcgtgcagacccgggagaaagcgactcggaccgatg

SEQ ID NO: 12062 - DNA, 203 bp, Homo sapiens
ggcgcgccagtccttcgagagacgctgggtaaccgaggaagccttaaaggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaacccgactcggaccgatg

SEQ ID NO: 12063 - DNA, 203 bp, Homo sapiens
ggcgcgccagtcctgctacggtcgctgggtaacctctatccgagccgcggccgcgaggaggacaacggctttcgaaaaaaaggaagagtgggaggaggaggggaagcggcgaaggaggaagaggaggaggaggaagaggggagcacaaaggatccaggtctcccgacgggaggttaataccaagaacccgactcggaccgatg

SEQ ID NO: 12064 - DNA, 203 bp, Homo sapiens
ggcgcgccagtcctaatcgaaccgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaacccgactcggaccgatg

SEQ ID NO: 12065 - DNA, 203 bp, Homo sapiens
ggcgcgccagtcctctggataacgctgggtaacctctatccgagccgctcatagccccgtatgggaaaaggcgagcaaaaaggaagagtgggaggaggaggggaagcggcgaaggaggaagaggaggaggaggaagaggggagcacaaaggatccaggtctcccgacgggaggttaataccaagaacccgactcggaccgatg

SEQ ID NO: 12066 - DNA, 203 bp, Homo sapiens
ggcgcgccagtcctcgaagatgcggcatgcactgacctggctttaatttcagggaagagtcgcgcccccggggagggagcagcactggcccattctgcagatggggacatcgagtcacgggctggctacgaactcctcgggggcgaaggtggcggagagggatgggttccaggacgtcctggcgcccgcgactcggaccgatg

SEQ ID NO: 12067 - DNA, 203 bp, Homo sapiens
ggcgcgccagtcctggcatgtccggcatgcactgcgggccgccgggcctcagggaagagtcgcgcccccggggagggagcagcactggcccattctgcagatggggacatcgagtcacgggctggctacgaactcctcgggggcgaaggtggcggagagggatgggttccaggatccaagattatgaacgactcggaccgatg

SEQ ID NO: 12068 - DNA, 203 bp, Homo sapiens
ggcgcgccagtcctttctaaaccggcatgcactgcgggccgccgggcctcagggaagagtcgcgcccccggggagggagcagcactggcccattctgcagatggggacatcgagtcacgggctggctacgaactcctcgggggcgagttgcaaatgtcctgatgggttccaggacgtcctggcgcccgcgactcggaccgatg

SEQ ID NO: 12069 - DNA, 203 bp, Homo sapiens
ggcgcgccagtcctcacgtcagcggccccgcccccgccgttcgcgctccactgttagattccagccagcccccgaccccgggccacctgggcccccgggttccgccggcactctcgccaccaccgcgtgggtctgacaagatgtaccaggtcccactaccactggatcgggatgggaccctggtacggcgactcggaccgatg

SEQ ID NO: 12070 - DNA, 203 bp, Homo sapiens
ggcgcgccagtcctgctaagtacggccccgcccccgccgttcgcgctctgaccagcccgcagagccagcccccgaccccgggccacctgggcccccgggttccgagctgtggtattggaccaccgcgtgggtctgacaagatgtaccaggtcccactaccactggatcgggatgggaccctggtacggcgactcggaccgatg

SEQ ID NO: 12071 - DNA, 203 bp, Homo sapiens
ggcgcgccagtcctaaccagatcggccccgcccccgccgttcgcgctctgaccagcccgcagagccagcccccgaccccgggccacctgggcccccgggttccgccggcactctcgccaccaccgcgtgggtctgacaagatgtaccaggtcccactacccactccagccttaaggaccctggtacggcgactcggaccgatg

SEQ ID NO: 12072 - DNA, 203 bp, Homo sapiens
ggcgcgccagtccttctctagtcggccccgcccccgccgttcgcgctctgaccagcccgcagcatgtcaattaaggcccgggccacctgggcccccgggttccgccggcactctcgccaccaccgcgtgggtctgacaagatgtaccaggtcccactaccactggatcgggatgggaccctggtacggcgactcggaccgatg

SEQ ID NO: 12073 - DNA, 203 bp, Homo sapiens
ggcgcgccagtcctgtgttcgtcggcccgttaaatggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtcgactcggaccgatg

SEQ ID NO: 12074 - DNA, 203 bp, Homo sapiens
ggcgcgccagtcctcgcagaatcggcgcggcaaattgcaacagtttggaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttcctacgactcggaccgatg

SEQ ID NO: 12075 - DNA, 203 bp, Homo sapiens
ggcgcgccagtccttcatagtgcggcggcggtagattagggccgcgggtcggagcactcaccgccgctgggggaccctgtcggaagcaactgccgccgccgcctctttcatctcttctggggcaggggccagccgtgctgcgccgccatccataagtagacctttttggagcctcaccagccaattcacgactcggaccgatg

SEQ ID NO: 12076 - DNA, 203 bp, Homo sapiens
ggcgcgccagtcctgaggcacccggcggcggtagattagggccgcgggtcggagcactcaccgccgctgggggacctgtaacatgagggatgccgccgccgcctctttcatctcttctggggcaggggccagggccaggttttacacatccataagtagacctttttggagcctcaccagccaattcacgactcggaccgatg

SEQ ID NO: 12077 - DNA, 203 bp, Homo sapiens
ggcgcgccagtcctttaggttccggctcccagggttttaaaaaatgtggggagccctggaggcgcagccccaccccggccggcgcggctcgctcccacgcccccgccgcggcctcgctggagcggacggactgagtcagagggggcgccagcgctgcaggagctgacatggacccaaatcctcgggcccgactcggaccgatg

SEQ ID NO: 12078 - DNA, 203 bp, Homo sapiens
ggcgcgccagtcctaacctcctcggctctccgcgccttcttttctccgcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggacccgactcggaccgatg

SEQ ID NO: 12079 - DNA, 203 bp, Homo sapiens
ggcgcgccagtcctggttccctcggctctccgcgccttcttttctccgcgcgcccggcgcgaagcctgcgattcgtgagccgagcgcagagcgcagagccgagtggcgcacgctgggcagtggcctgggcaaccccaaacgcagccagagccctcacccgagtccgctggcccgcggggaagaggacccgactcggaccgatg

SEQ ID NO: 12080 - DNA, 203 bp, Homo sapiens
ggcgcgccagtccttataacctcggctctccgcgctcctccctctccgcgcgcccggcgcgaagcctgcgattcgtatcgtagcaatctcgcgcagagccgagtggcgcacgctgggcagtggcctgggcaaccccaaacgcagccagagccctcacccgagtccgctggcccgcgcactcccggacccgactcggaccgatg

SEQ ID NO: 12081 - DNA, 203 bp, Homo sapiens
ggcgcgccagtcctaagggcgtcggctctccgcgctcctccctctccgcgcgcccggcgcgaagcctgcgattcgtgagccgagcgcagagcgcagagccgagttcaatcgtgatattagtggcctgggcaaccccaaacgcagccagagccctcacccgagtccgctggcccgcgcactcccggacccgactcggaccgatg

SEQ ID NO: 12082 - DNA, 203 bp, Homo sapiens
ggcgcgccagtcctagatatcacggctctccgcgctcctccctctccgcgcgcccggcgcgaagcctgcgattcgtgagccgagcgcagattcggacctatgcgggcgcacgctgggcagtggcctgggcaaccccaaacgcagccagagccctcacccgagtccgctggcccgcgcactcccggacccgactcggaccgatg

SEQ ID NO: 12083 - DNA, 203 bp, Homo sapiens
ggcgcgccagtcctttgctaaccggctctgggtggccgaggcggcagctgcgcggcggcaccggggcggctgcggcgcgctcggagccccattttgctagcagacgggcagctcggtgtgcgcccccgcgagagccggggccccaggcccgccggacaccatgaaccacctgaacgtgctggccaaagcgactcggaccgatg

SEQ ID NO: 12084 - DNA, 203 bp, Homo sapiens
ggcgcgccagtcctctatcttccggctgcctggtccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtcgactcggaccgatg

SEQ ID NO: 12085 - DNA, 203 bp, Homo sapiens
ggcgcgccagtcctgcgcactacgggaaaagaccaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgacgactcggaccgatg

SEQ ID NO: 12086 - DNA, 203 bp, Homo sapiens
ggcgcgccagtccttacctgcgcgggactcctgctcctcacttgtgtccccaatggggctagctcgggtccacaacagctgccgatcaatggggtctttgtctttgtttcatgggtgtccagattttatcaattaaagcctgtgggaactgccagctcggcaagaggtaggcttggtctgcgccgatacgactcggaccgatg

SEQ ID NO: 12087 - DNA, 203 bp, Homo sapiens
ggcgcgccagtcctgcaccagtcgggagctttccggagctgctggtactcccgattggagacgtagaaccgttactctagtgcacggggcgcggccgccgtgaccctctcggggatcccacgatgttcttctacctgagcaagaaaatttccattcccaataacgtgaagctgcagtgtgtatcctggcgactcggaccgatg

SEQ ID NO: 12088 - DNA, 203 bp, Homo sapiens
ggcgcgccagtcctgtttctggcgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggcgactcggaccgatg

SEQ ID NO: 12089 - DNA, 203 bp, Homo sapiens
ggcgcgccagtccttttctgcacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcttccatccgaagaccgactcggaccgatg

SEQ ID NO: 12090 - DNA, 203 bp, Homo sapiens
ggcgcgccagtcctcctctccgcgggagctttccggagctgctggtactcccgattggagacgtagaaccgttacttgtcgagggccttagcggccgccgtgaccctctcggggatcccacgatgttcttctacctgagcaagaaatgactagcaattggtaacgtgaagctgcagtgtgtatcctggcgactcggaccgatg

SEQ ID NO: 12091 - DNA, 203 bp, Homo sapiens
ggcgcgccagtcctttctggaacgggagctttccggagctgctggtactcccgattggagacgtagaaccgttacttgtcgagggccttagcggccgccgtgaccctctcggggatcccacgatgttcttctcaagttcgcctcctatttccattcccaataacgtgaagctgcagtgtgtatcctggcgactcggaccgatg

SEQ ID NO: 12092 - DNA, 203 bp, Homo sapiens
ggcgcgccagtcctattagaaacgggagggggaaggacccccaccgctgcccttcccggggaggcgggaaatgcatatccaggtatgttcccgcggcggcctacagccggggtagcccaagaaccttcgggtgagggcgggtggcattttcttttcctataccgatcatggcagtccttctgctcctacgactcggaccgatg

SEQ ID NO: 12093 - DNA, 203 bp, Homo sapiens
ggcgcgccagtccttacttcttcgggagggggaaggacccccaccgctgcccttcccggggaggcgggaaatgcatggggccacccagctccgcggcggcctacagccggggtagcccaagaaccttcgggtgagggcgggtggcattttcttttcctataccgatcatggcagtccttctgctcctacgactcggaccgatg

SEQ ID NO: 12094 - DNA, 203 bp, Homo sapiens
ggcgcgccagtccttggcgccgcgggagggggaaggacccccaccgctgcccttcccggggaggcgggaaatgcatggggccacccagctgtcacagccttcgaagccggggtagcccaagaaccttcgggtgagggcgggtggcattttcttttcctataccgatcatggcagtccttctgctcctacgactcggaccgatg

SEQ ID NO: 12095 - DNA, 203 bp, Homo sapiens
ggcgcgccagtcctaatccgagcgggagggggaattgtgtgtcagatggcccttcccggggaggcgggaaatgcatggggccacccagctccgcggcggcctacagccggggtagcccaagaaccttcgggtgagggcgggtggcattttcttttcctataccgatcatggcagtccttctgctcctacgactcggaccgatg

SEQ ID NO: 12096 - DNA, 203 bp, Homo sapiens
ggcgcgccagtcctcggcagcgcgggatgctgccttcccatatgaagcaatccttcaacaccgacttaggttcaattttctcatcatttactgttgtaattcaatcttactaaagttattccgatatttaagaaaaaataacctttatataatgtaacaatactattaagattatgatataggccagacgactcggaccgatg

SEQ ID NO: 12097 - DNA, 203 bp, Homo sapiens
ggcgcgccagtcctgtacgtaacgggcgcgcttccgcctgtgtggaggaaaccccacccaacggctgccacggcatggagaatggctccgcttctgttgcagctggcggtgctcggcgcggcgctggcggccgcagccctcgtactgatttccatcgttgcatttacaactgctacaaaaatgccagccgactcggaccgatg

SEQ ID NO: 12098 - DNA, 203 bp, Homo sapiens
ggcgcgccagtcctgttcataccgggcgcgcttccgcctgtgtggaggtgcgggattgggcgcaactagtgtaagaggagaatggctccgcttctgttgcagctggcggtgctcggcgcggcgctggcggccgcagccctcgtactgatttccatcgttgcatttacaactgctacaaaaatgccagccgactcggaccgatg

SEQ ID NO: 12099 - DNA, 203 bp, Homo sapiens
ggcgcgccagtcctcaaccacccgggcgcgcttccgcctgtgtggaggtgcgggattgggcgggctgccacggcataacagggaaaggttcttctgttgcagctggcggtgctcggcgcggcgctggcggccgcagccctcgtactgatttccatcgttgcatttacaactgctacaaaaatgccagccgactcggaccgatg

SEQ ID NO: 12100 - DNA, 203 bp, Homo sapiens
ggcgcgccagtccttcataaatcgggcgcgcttccgcctgtgtggaggtgcgggattgggcgggctgccacggcatggagaatggctccgcttctgttgcagctggcggtgctcggcggctgctgtttacaggcagccctcgtactgatttccatcgttgcatttacaactgctacaaaaatgccagccgactcggaccgatg

SEQ ID NO: 12101 - DNA, 203 bp, Homo sapiens
ggcgcgccagtcctcgctcgcccgggctgagtaaatgcaggatgaaataccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgcccgactcggaccgatg

SEQ ID NO: 12102 - DNA, 203 bp, Homo sapiens
ggcgcgccagtcctgagtgacgcgggctgagtaataaattccccccgcaccgaaacgcggtctttctctagacgcgtcttgctgggagaggacttcgactaattcgtccgtgtcgcggccctgcggttggcggcctcctcgtggagcggagcaaggccaggcggcccctgctcgagtcccgcgtcgcccgactcggaccgatg

SEQ ID NO: 12103 - DNA, 203 bp, Homo sapiens
ggcgcgccagtcctactgtaagcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccagttttagaactactaagtcccgcgtcgcccgactcggaccgatg

SEQ ID NO: 12104 - DNA, 203 bp, Homo sapiens
ggcgcgccagtcctctggaaggcgggctgagtaataaattccccccgcaccgaaacgcggtctttctctagacgcgtcttgctgggagagtgtccgttgcttcccgtccgtgtcgcggccctgcggttggcggcctcctcgtggagttccaattataatagcggcccctgctcgagtcccgcgtcgcccgactcggaccgatg

SEQ ID NO: 12105 - DNA, 203 bp, Homo sapiens
ggcgcgccagtccttcgggcttcgggctgagtaataaattccccccgccatttgctaatcattttctctagacgcgtcttgctgggagagtgtccgttgcttcccgtccgtgtcgcggccctgcggttggcggcctcctcgtggagcggagcaaggccaggcggcccctgctcgagtcccgcgtcgcccgactcggaccgatg

SEQ ID NO: 12106 - DNA, 203 bp, Homo sapiens
ggcgcgccagtcctgacgataacggggagctttctggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagagcgactcggaccgatg

SEQ ID NO: 12107 - DNA, 203 bp, Homo sapiens
ggcgcgccagtccttgtattcccggtgcctaaggccgcgctgccgggctcgagcggaggcggcgcaggcgctgaggctggcgcggagcggctagaactagcgtagtgcggaaagcgctaggtccagccctgctgggagttttctgccacacagatttgcggaagaacctgaccgtggacgagggcacccgactcggaccgatg

SEQ ID NO: 12108 - DNA, 203 bp, Homo sapiens
ggcgcgccagtccttcggcccacggtggaaaggtccattgcaatccctccaggaagcggccgcatgctgacattagtccatagacggctccccccggtggatcccgtggcgattcctgaaaaaagctgcatgcccaagaccagacgccagcgaactcgccgagcacgccgcaacagaccaccaacacccgactcggaccgatg

SEQ ID NO: 12109 - DNA, 203 bp, Homo sapiens
ggcgcgccagtcctccctgccgcggtggaaaggtccattgcaatccctccaggaagcggccggggcagccttgctcctggcgcgtcaactcccccggtggatcccgtggcgattcctgaaaaaagctgcatgcccaagaccagacgccagcgaactcgccgagcacgccgcaacagaccaccaacacccgactcggaccgatg

SEQ ID NO: 12110 - DNA, 203 bp, Homo sapiens
ggcgcgccagtcctgacagggtcggtggaaaggtccattgcaatccctccaggaagcggccggggcagccttgctctccatagacggctccccccggtggatcccgtggcgattcctgaaaaaagctgcatgcccaagaccagacgagtctcggagttatgagcacgccgcaacagaccaccaacacccgactcggaccgatg

SEQ ID NO: 12111 - DNA, 203 bp, Homo sapiens
ggcgcgccagtcctgaattaatcggtggaaaggtccattgcaatccctccaggaagcggccggggcagccttgctctccatagacggctccccccggtggatcccgtggcgattcctgaaaaaagctgcatgcccaagaccagacgccagcgaactcgccgagcacgccgcaacagaccaccaacacccgactcggaccgatg

SEQ ID NO: 12112 - DNA, 203 bp, Homo sapiens
ggcgcgccagtcctccgtccgccggtggaaaggtccattgcaatccctccaggaagcggccggggcagccttgctctccatagacggctccccccggtggatcccgtggcgattcctgttgtccttgcacatcccaagaccagacgccagcgaactcgccgagcacgccgcaacagaccaccaacacccgactcggaccgatg

SEQ ID NO: 12113 - DNA, 203 bp, Homo sapiens
ggcgcgccagtcctcgacggcacggtggaaaggtccattgcaatccctccaggaagcggccggggcagccttgctctccatagacggctcggattctgtctatacgtggcgattcctgaaaaaagctgcatgcccaagaccagacgccagcgaactcgccgagcacgccgcaacagaccaccaacacccgactcggaccgatg

SEQ ID NO: 12114 - DNA, 203 bp, Homo sapiens
ggcgcgccagtcctgggttgcgcggtggagtccatccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgacgactcggaccgatg

SEQ ID NO: 12115 - DNA, 203 bp, Homo sapiens
ggcgcgccagtcctttcattaacggtgttcctggcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgactcggaccgatg

SEQ ID NO: 12116 - DNA, 203 bp, Homo sapiens
ggcgcgccagtcctcaaatcggcggttgcgggactattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggcgactcggaccgatg

SEQ ID NO: 12117 - DNA, 203 bp, Homo sapiens
ggcgcgccagtccttattccgacgtagagggggttacgcgggtggctggacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaacgactcggaccgatg

SEQ ID NO: 12118 - DNA, 203 bp, Homo sapiens
ggcgcgccagtccttggtggttcgtatattgtcgagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgcgactcggaccgatg

SEQ ID NO: 12119 - DNA, 203 bp, Homo sapiens
ggcgcgccagtcctataccggccgtattcaacaaggggctgaaggatgcccagaaggtaccccattgtatgggatctgatctggggcctcggtgcacatgctttacatgtgtttagtcgaggttaaaaaacgatagtagtagtgctaccacggggacgtggttttcctttgaaaaacacgatgataatcgactcggaccgatg

SEQ ID NO: 12120 - DNA, 203 bp, Homo sapiens
ggcgcgccagtcctggcgaagacgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatcgactcggaccgatg

SEQ ID NO: 12121 - DNA, 203 bp, Homo sapiens
ggcgcgccagtcctcgtagggccgtattcaacaatcatggcccacgaccccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatcgactcggaccgatg

SEQ ID NO: 12122 - DNA, 203 bp, Homo sapiens
ggcgcgccagtccttctggagccgtctatctaaggaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgcgactcggaccgatg

SEQ ID NO: 12123 - DNA, 203 bp, Homo sapiens
ggcgcgccagtcctagtgaattcgtgctgttcccgccaattcctgtggcttgagcctagcgagcgagttccgcgctcaatggagacgtttgaccccaccgagctgcccgagctgcttaaactttattaccggaggctctttccctactctcagtactatcgctggctcaactacggtggagtgataaacgactcggaccgatg

SEQ ID NO: 12124 - DNA, 203 bp, Homo sapiens
ggcgcgccagtcctacacgacccgtgctgttcccgccaattcctgtggtaatccttaccgtggcgagttccgcgctcaatggagacgtttatgggagaatctgagcccgagctgcttaaactttattaccggaggctctttccctactctcagtactatcgctggctcaactacggtggagtgataaacgactcggaccgatg

SEQ ID NO: 12125 - DNA, 203 bp, Homo sapiens
ggcgcgccagtccttagaactacgtgctgttcccgccaattcctgtggtaatccttaccgtggcgagttccgcgctcaatggagacgtttgaccccaccgagctgcccgagctgcttaaactttattaccgggacgcggccagtctctctcagtactatcgctggctcaactacggtggagtgataaacgactcggaccgatg

SEQ ID NO: 12126 - DNA, 203 bp, Homo sapiens
ggcgcgccagtcctttcttactcgtggtatgacagggtagcctggcagtgtcagaagtctgaacccagcatagtggtcagcaggcaggacgaatcacactgaatgcaaaccacagggtttcgcagcgtggtaaaagaaatcattgagtcccccgccttcagaagagggtgcattttcaggaggaagcgcgactcggaccgatg

SEQ ID NO: 12127 - DNA, 203 bp, Homo sapiens
ggcgcgccagtcctaacgatttcgtggtttgtgtcacgcgagacccgattgtgtttgttcgtcacttgtcgacagcgccctgcgaattggtgtacccacaccgcgcggcttgcgaataatactttggagagtcttttgcctccagtgtcttccgtttgtactcgtcctcctctccctctccggccgggcgactcggaccgatg

SEQ ID NO: 12128 - DNA, 203 bp, Homo sapiens
ggcgcgccagtccttgagtgatcgtggtttgtgtgtttgtttgttaccggtatagcaaaaagcacttgtcgacagcgccctgcgaattggtgtacccacaccgcgcggcttgcgaataatactttggagagtcttttgcctccagtgtcttccgtttgtactcgtcctcctctccctctccggccgggcgactcggaccgatg

SEQ ID NO: 12129 - DNA, 203 bp, Homo sapiens
ggcgcgccagtcctaccatcaacgtggtttgtgtgtttgtttgttaccttgtgtttgttcgtcacttgtcgacagcgccctgcgaattggcccggatgaggttggcggcttgcgaataatactttggagagtcttttgcctccagtgtcttccgtttgtactcgtcctcctctccctctccggccgggcgactcggaccgatg

SEQ ID NO: 12130 - DNA, 203 bp, Homo sapiens
ggcgcgccagtcctagctgcggcgtggtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctcttcaatgcttaccacgactcggaccgatg

SEQ ID NO: 12131 - DNA, 203 bp, Homo sapiens
ggcgcgccagtcctcttatgtgcgtggtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtatagaagagaaaagtcctctccggccgggcgactcggaccgatg

SEQ ID NO: 12132 - DNA, 203 bp, Homo sapiens
ggcgcgccagtcctcctaaaggcgtgtgaggtctactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgcgactcggaccgatg

SEQ ID NO: 12133 - DNA, 203 bp, Homo sapiens
ggcgcgccagtccttcgttatacgttccctccctccggcgagggccgcctttataacaactgctcagagtgcgagggcgggatagctgtccaaggtctcccccaaggaatgtccctaagcctgctgccctcttgcgcgcgggaagcagcaccaagttcacggccaacgccttggcactagggtccagacgactcggaccgatg

SEQ ID NO: 12134 - DNA, 203 bp, Homo sapiens
ggcgcgccagtcctattcaccccgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagacgactcggaccgatg

SEQ ID NO: 12135 - DNA, 203 bp, Homo sapiens
ggcgcgccagtcctaacttgtccgttccctccctccggcgagggccgcctttataacaactgctcagagtgcgagggcgggatagctgtccaaggtctcccccagcactgaggagctcgcctgctgccctcttgcgcgcgggaagccagcatgttaaacgggccaacgccttggcactagggtccagacgactcggaccgatg

SEQ ID NO: 12136 - DNA, 203 bp, Homo sapiens
ggcgcgccagtcctaggtattgcgttccctccctccggcgagggccgcctttataacaactgtgggacaacatgaagcgggatagctgtccaaggtctcccccagcactgaggagctcgcctgctgccctcttgcgcgcgggaagcagcaccaagttcacggccaacgccttggcactagggtccagacgactcggaccgatg

SEQ ID NO: 12137 - DNA, 203 bp, Homo sapiens
ggcgcgccagtcctttgcgctccgttcgccccacatttgcaatcttacgggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12138 - DNA, 203 bp, Homo sapiens
ggcgcgccagtcctgtcctacacgttcgccccacctggtatagaaatcgggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12139 - DNA, 203 bp, Homo sapiens
ggcgcgccagtcctaatttcatcgttcgccccagggaccggcaggcgggggaccgcggcccaggctgaagctcagggccctgtctgctctgtggactcaacagtacactaactccaccgctcagaactgagaagctgtcaccacagtagcttggagctcggcggcacaaccagcaccatctggtcgcgcgactcggaccgatg

SEQ ID NO: 12140 - DNA, 203 bp, Homo sapiens
ggcgcgccagtcctgacgcgtacgttcgccccagggaccggcaggcgggggaccgcggcccaggctgaagctcagggccctgtctgctctgtggactcaacagtttgtggcaagacaagctcagaactgagaagctgtcaccacagtagcttggagctcgctaattgcttattgaccatctggtcgcgcgactcggaccgatg

SEQ ID NO: 12141 - DNA, 203 bp, Homo sapiens
ggcgcgccagtcctacggattacgttcgccccagggaccggcaggcgggggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12142 - DNA, 203 bp, Homo sapiens
ggcgcgccagtccttcatcggacgttcgccccagggaccggcaggcgggggaccgcggcccatctgtcgcggagttgccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12143 - DNA, 203 bp, Homo sapiens
ggcgcgccagtcctaccggcagcgttcgccccagggaccggcaggcgggtaggtagtaagtgggctgaagctcagggccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12144 - DNA, 203 bp, Homo sapiens
ggcgcgccagtcctagatcacccgttgccaagggtgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttccgactcggaccgatg

SEQ ID NO: 12145 - DNA, 203 bp, Homo sapiens
ggcgcgccagtcctcgatgcgcctaaaggtctcccctcccacctgcatgctggattcggtaatggcctcagcccttgccaactctgcctcttcccccgctgactgggcctctgcagagatgtgggcagctggtcaggatggccattcgggctcagcacagcaacgcagcccagactcagactggggaacgactcggaccgatg

SEQ ID NO: 12146 - DNA, 203 bp, Homo sapiens
ggcgcgccagtcctacaagaatctaaaggtctcccctcccacctgcattgctctacaatctgtggcctcagcccttgccaactctgcctccgtgaagatcataagggcctctgcagagatgtgggcagctggtcaggatggccattcgggctcagcacagcaacgcagcccagactcagactggggaacgactcggaccgatg

SEQ ID NO: 12147 - DNA, 203 bp, Homo sapiens
ggcgcgccagtcctgcttcttcctaaaggtctcccctcccacctgcattgctctacaatctgtggcctcagcccttgccaactctgcctcttcccccgctgactgggcctctgcagagatgtgggcagctggtcaggatggccattcgggctcagcacagtggaaagtagttttctcagactggggaacgactcggaccgatg

SEQ ID NO: 12148 - DNA, 203 bp, Homo sapiens
ggcgcgccagtcctttgtatcgctaaagtaccgctcctacaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 12149 - DNA, 203 bp, Homo sapiens
ggcgcgccagtcctactatgacctaacatatgtcatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 12150 - DNA, 203 bp, Homo sapiens
ggcgcgccagtcctccttatctctaactttaggtccaggagtgcgatcgcctgcggatctgcagctgggcaccggccgcaacgcccgccccgcgacggcagggaataaaggctcagggaccggcagttctactctagagcccaccagcctctcagagcctccggtgactggcctgtgtctccccctggcgactcggaccgatg

SEQ ID NO: 12151 - DNA, 203 bp, Homo sapiens
ggcgcgccagtcctcatcccacctacaggggagtaactcgaggaggcgaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacgactcggaccgatg

SEQ ID NO: 12152 - DNA, 203 bp, Homo sapiens
ggcgcgccagtcctgtattcacctacaggggagttttgttgaagttgcaaagtcctggagcccgagagaacgaaatggcgcagtagcagcgagcagcagagtccgcacgctccggcgaggggcagaagagcgcgagggagcgcggggcagcagaagcgagagccgagcgcggacccagccaggacccacgactcggaccgatg

SEQ ID NO: 12153 - DNA, 203 bp, Homo sapiens
ggcgcgccagtcctgcaattccctacaggggagttttgttgaagttgccctcaatccccaaatccagagggctgtcggcgcagtagcagcgagcagcagagtccgcacgctccggcgaggggcagaagagcgcgagggagcgcggggcagcagaagcgagagccgagcgcggacccagccaggacccacgactcggaccgatg

SEQ ID NO: 12154 - DNA, 203 bp, Homo sapiens
ggcgcgccagtcctatatccttctacctattaaatattgccaaagggaaaaaggatagcccaaaggacaagaaaacacttctcactatgaattggtttggaagtaacttcttcaggtgtcctgaggatctttccttactcaacatatactcacctctgttgtcacacatgtcatctgaagatgaacatcgactcggaccgatg

SEQ ID NO: 12155 - DNA, 203 bp, Homo sapiens
ggcgcgccagtcctcctctggactaccttggctggattttggttacgctataattgtaactgttttctgtttggacaacatcaaaaacatccattgcacaatggggcagttcattagcttcatgcaagaaataccaacctttttgcaggaggctctgaacattgctcttgttgcagtcagtctcattgcgactcggaccgatg

SEQ ID NO: 12156 - DNA, 203 bp, Homo sapiens
ggcgcgccagtcctttgcgtgtctactagatgaaccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 12157 - DNA, 203 bp, Homo sapiens
ggcgcgccagtcctaggatagactagactagcacgcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgcgactcggaccgatg

SEQ ID NO: 12158 - DNA, 203 bp, Homo sapiens
ggcgcgccagtccttcggcgtcctagatccccgcaagctaggccagctcctcccactgcctcccttcctctttctcctcctcttactcctcagggaaatatgtgtggctgtctacaggatgggggacaccctgagccccggacatggcaaccacagagagagcagcccttttctttcccccttggaggcgactcggaccgatg

SEQ ID NO: 12159 - DNA, 203 bp, Homo sapiens
ggcgcgccagtcctggatgcttctagatccccgcaagctaggccagctcctcccactgcctcccttcctctttctcctcctcttactcctttccagccagacctgaatatatctatccatgggggacaccctgagccccggacatggcaaccacagagagagcagcccttttctttcccccttggaggcgactcggaccgatg

SEQ ID NO: 12160 - DNA, 203 bp, Homo sapiens
ggcgcgccagtcctatatgaacctagatccccgcaagctaggccagctcctcccactgcctcccttcctctttctcctcctcttactcctttccagccagaccttggctgtctacaggatgggggacaccctgagccccggacatgcacgagtggacctcagcagcccttttctttcccccttggaggcgactcggaccgatg

SEQ ID NO: 12161 - DNA, 203 bp, Homo sapiens
ggcgcgccagtcctcgtgacgactagatccccgcaagctaggccagctcctcccactgcctcccttcctctttctcctcctcttactcctttccagccagaccttggctgtctacaggatgggggacaccctgagccccggacatggcaaccacagagagagcagcccttttctacgatagaacttttcgactcggaccgatg

SEQ ID NO: 12162 - DNA, 203 bp, Homo sapiens
ggcgcgccagtcctatgttgttctagatccccgcaagctaggccagctcctcccactgcctcccttcctctttctctcttaaaactcaagttccagccagaccttggctgtctacaggatgggggacaccctgagccccggacatggcaaccacagagagagcagcccttttctttcccccttggaggcgactcggaccgatg

SEQ ID NO: 12163 - DNA, 203 bp, Homo sapiens
ggcgcgccagtcctcgagcccgctagatccccgcaagctaggccagctcctcccactgcctctaagtgagcacgcgctcctcttactcctttccagccagaccttggctgtctacaggatgggggacaccctgagccccggacatggcaaccacagagagagcagcccttttctttcccccttggaggcgactcggaccgatg

SEQ ID NO: 12164 - DNA, 203 bp, Homo sapiens
ggcgcgccagtcctcaagcgatctagatccccgcctagccccgaccggcctcccactgcctcccttcctctttctcctcctcttactcctttccagccagaccttggctgtctacaggatgggggacaccctgagccccggacatggcaaccacagagagagcagcccttttctttcccccttggaggcgactcggaccgatg

SEQ ID NO: 12165 - DNA, 203 bp, Homo sapiens
ggcgcgccagtcctcagtacagctagattgtgtagggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcacccgactcggaccgatg

SEQ ID NO: 12166 - DNA, 203 bp, Homo sapiens
ggcgcgccagtcctttggaatcctagtattgaaccgacactcactcgttacttggcatgtacacctgattagttagcccttgtggatacgccactgccgctcaggtacagtaggacataccccaaatattgggttccactcgtagagaagaaaattagtggcgaaacgtacggtttatgtcaaaggagcgactcggaccgatg

SEQ ID NO: 12167 - DNA, 203 bp, Homo sapiens
ggcgcgccagtcctacggttatctagtattgaactttagtgatgagtgtacttggcatgtacacctgattagttagcccttgtggatacgccactgccgctcaggtacagtaggacataccccaaatattggagcttggagaagaggaagaaaattagtggcgaaacgtacggtttatgtcaaaggagcgactcggaccgatg

SEQ ID NO: 12168 - DNA, 203 bp, Homo sapiens
ggcgcgccagtcctgcgatgcactagtattgaactttagtgatgagtgtacttggcatgtacacctgattagttagcccttgtggatacgccactgccgctcaggtacagtaggacatctgatggcggaaacgttccactcgtagagaagaaaattagtggcgaaacgtacggtttatgtcaaaggagcgactcggaccgatg

SEQ ID NO: 12169 - DNA, 203 bp, Homo sapiens
ggcgcgccagtcctccaaccagctagtcatcaaaccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 12170 - DNA, 203 bp, Homo sapiens
ggcgcgccagtcctaggccaagctagtcgaatacccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 12171 - DNA, 203 bp, Homo sapiens
ggcgcgccagtcctcgttctacctataatcagtgcacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtgggccgggaaatgccgactcggaccgatg

SEQ ID NO: 12172 - DNA, 203 bp, Homo sapiens
ggcgcgccagtcctctgtcagtctatcagcccgctttaattgcaaacacaaagcgactgttgttgtgcaattaaaggatagtgatattaatgaaatggtgcttagtcttgttaggagtggtaagttgcttgtaaggggtaatggcaagtgtttgagttttagtaatcatttagtctcaactaaataaacgactcggaccgatg

SEQ ID NO: 12173 - DNA, 203 bp, Homo sapiens
ggcgcgccagtcctaagaggatctatgagaatgatgatgatgctacagactaaaatatatcgggaggaatttaacaggatacttggacaatagaagccagatcaaaagtaagaaaaacttagggtgaatgacaattcacagatcagctcaaccagacaccaccagcatacacgaaaccaaccttcacacgactcggaccgatg

SEQ ID NO: 12174 - DNA, 203 bp, Homo sapiens
ggcgcgccagtcctgagtacctctatgagaatgatgatgatgctacagcggctgcagggataggaggaatttaacaggatacttggacaacttgctagttccgcaaagtaagaaaaacttagggtgaatgacaattcacagatcagctcaaccagacaccaccagcatacacgaaaccaaccttcacacgactcggaccgatg

SEQ ID NO: 12175 - DNA, 203 bp, Homo sapiens
ggcgcgccagtcctcggccgttctatgagaatgatgatgatgctacagcggctgcagggataggaggaatttaacaggatacttggacaatagaagccagatcaaaagtaagaaaaacttagggtgaatgacaattcacagatcagctcaaccagacaccaccagcatacacgaaaccaaccttcacacgactcggaccgatg

SEQ ID NO: 12176 - DNA, 203 bp, Homo sapiens
ggcgcgccagtcctgagcgcacctatgagaatgatgatgatgctacagcggctgcagggataggaggaatttaacaggatacttggacaatagaagccagatcaaaagtaagaaaaacttagggtgaatgactcgcttgtttctgtctcaaccagacaccaccagcatacacgaaaccaaccttcacacgactcggaccgatg

SEQ ID NO: 12177 - DNA, 203 bp, Homo sapiens
ggcgcgccagtcctgctgggcgctcaacaaaaagccaccgacattaagagagagagtattgctgcttagttaactgcaggccctatttagaccccataattcttatctgcaacagcattcctgtatcatccagggcaccggtggacttggtgaggattgagttgacctcatcattagagaccagactccgactcggaccgatg

SEQ ID NO: 12178 - DNA, 203 bp, Homo sapiens
ggcgcgccagtcctcacatacgctcaacaaaaagccaccgacattaagagagagagtattgctgcttagttaactgcaggccctatttagggttaccgcccaggatctgcaacagcattcctgtatcatccagggcaccggtggacttggtgaggattgacggtctaaatgtcgtagagaccagactccgactcggaccgatg

SEQ ID NO: 12179 - DNA, 203 bp, Homo sapiens
ggcgcgccagtcctagcttcccctcaacaaaaagccaccgacattaagagagagagtattgctgcttagttaactgcaggccctatttagggttaccgcccaggatctgcaacagcattcctgtatcatccagggcaccggtggacttggtgaggattgagttgacctcatcatacacataattgaagcgactcggaccgatg

SEQ ID NO: 12180 - DNA, 203 bp, Homo sapiens
ggcgcgccagtcctgagtaaacctcaacaaaaagccaccgacattaagagagagagtattgctgcttagttaactgtttaggaagaccctggttaccgcccaggatctgcaacagcattcctgtatcatccagggcaccggtggacttggtgaggattgagttgacctcatcattagagaccagactccgactcggaccgatg

SEQ ID NO: 12181 - DNA, 203 bp, Homo sapiens
ggcgcgccagtcctgtaatggactcaccgaggcgagtcgctgtgtgttcctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12182 - DNA, 203 bp, Homo sapiens
ggcgcgccagtcctgtagaggcctcaccgaggcgcacgcgcccagcaccctgcctccggcgatgccgccccagcccctctgatggccctcctctctgctgccactcattccagaacaggaggcatgagcccggaacgcgcttgcttgacacgtgattgttctttctgtgtggtacgctggattcaaggcgactcggaccgatg

SEQ ID NO: 12183 - DNA, 203 bp, Homo sapiens
ggcgcgccagtcctaaagacgactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12184 - DNA, 203 bp, Homo sapiens
ggcgcgccagtcctaaacagtgctcaccgaggcgcacgcgcccagcaccctgcctccggcgatgccgccccagcccctctgatggccctctggatgatctatcgtcattccagaacaggaggcatgagcccggaacgcgcttgcttttaggagacagccactttctgtgtggtacgctggattcaaggcgactcggaccgatg

SEQ ID NO: 12185 - DNA, 203 bp, Homo sapiens
ggcgcgccagtcctctgccgggctcaccgaggcgcacgcgcccagcaccctgcctccggcgatgccgccccagcccgatacgccatttatctctctgctgccactcattccagaacaggaggcatgagcccggaacgcgcttgcttttaggagacagccactttctgtgtggtacgctggattcaaggcgactcggaccgatg

SEQ ID NO: 12186 - DNA, 203 bp, Homo sapiens
ggcgcgccagtcctctaaatgtctcaccgaggcgcacgcgcccagcacgtcagaatgaatcctgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12187 - DNA, 203 bp, Homo sapiens
ggcgcgccagtcctccagtggtctcagtgccagaggaggggattcccggcgccgggggacagagccccttttttctgggcatacgttcttctttctgctggggagcctcttgtgtccagcctaggcccgcgtgcagcgccgacggatgaccgtcttcttggcaagaaagtgaataaacttaattgagacgactcggaccgatg

SEQ ID NO: 12188 - DNA, 203 bp, Homo sapiens
ggcgcgccagtcctaagccggtctcagtgccagaggaggggattcccggcgccgggggacagagccccttttttcttttgccgaaagaccctttctgctggggagcctcttgtgtccagcctaggcccgcgtgcagcgccgacggatgaccgtcttcttgcggtctggacaggaaaacttaattgagacgactcggaccgatg

SEQ ID NO: 12189 - DNA, 203 bp, Homo sapiens
ggcgcgccagtcctggaacgccctcagtgccagaggaggggattcccggcgccgggggacagctttataggggagctttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 12190 - DNA, 203 bp, Homo sapiens
ggcgcgccagtcctatatctaactcagtgccagatagtcaccaaggaagcgccgggggacagagccccttttttcttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 12191 - DNA, 203 bp, Homo sapiens
ggcgcgccagtcctatttatgtctccagttgggacaagtcccaatccaagtgaacgtgtagcgccgcatttaaatgatgccgttcaatcatgagacataaagaaaaaatcaagccagaacaagcttaggatcacaatacaacacagaaccccagctgctatcataactgttctctggccgctcgaaagcgactcggaccgatg

SEQ ID NO: 12192 - DNA, 203 bp, Homo sapiens
ggcgcgccagtcctcacgcctcctccagttgggacaagtcccaatccatcattcgagaacaagccgcatttaaatgatgccgttcaatcatgagacataaagaaaaaatcaagccagaacaagcttaggatcacaatacaacacagaaccccagctgctacgcccgtgagctgttggccgctcgaaagcgactcggaccgatg

SEQ ID NO: 12193 - DNA, 203 bp, Homo sapiens
ggcgcgccagtcctcataacgcctccagttgggacaagtcccaatccatcattcgagaacaagccgcatttaaatgatgccgttcaatcatgagacataaagaaaaaatcaagccagaacaagcttaggatcacaatacaacacagctttaggctctgactcataactgttctctggccgctcgaaagcgactcggaccgatg

SEQ ID NO: 12194 - DNA, 203 bp, Homo sapiens
ggcgcgccagtcctgtcgcagcctccagttgggacaagtcccaatccatcattcgagaacaagccgcatttaaatgatgccgttcaatcatgagacataaagaagcgtgattagatcgacaagcttaggatcacaatacaacacagaaccccagctgctatcataactgttctctggccgctcgaaagcgactcggaccgatg

SEQ ID NO: 12195 - DNA, 203 bp, Homo sapiens
ggcgcgccagtcctgcacaggactccagttgggacaagtcccaatccatcattcgagaacaagccgcatttaaatggaagtcccagtgattgagacataaagaaaaaatcaagccagaacaagcttaggatcacaatacaacacagaaccccagctgctatcataactgttctctggccgctcgaaagcgactcggaccgatg

SEQ ID NO: 12196 - DNA, 203 bp, Homo sapiens
ggcgcgccagtcctttactgtcctcccctggtgcggcccgaggcaagcccaccgaggtgaccacccctcgacgccgcttggagatcccgggcatccaccctgcgccccgagcagctgatacccagggaggtgaattccgtatgagagggcgcggggtcgccggaagccaggcgggagccccggctgctcgactcggaccgatg

SEQ ID NO: 12197 - DNA, 203 bp, Homo sapiens
ggcgcgccagtcctctcgtgacctcccctggtgcggcccgaggcaagcccaccgaggtgaccacccctcgacgccgcttggagatcccggtgcgttttagccgaccccgagcagctgatacccagggaggtgtcaggacctgcccggggcgcggggtcgccggaagccaggcgggagccccggctgctcgactcggaccgatg

SEQ ID NO: 12198 - DNA, 203 bp, Homo sapiens
ggcgcgccagtcctcgggcgcactccctttctccctccatccttccacttcccctgctcggccccgccgtcaggcccacaggtgtcagattgccgtcatcaggttccccttctcccttcttggcactttcctttcgaaccatccttctggacaaactttgatggagaatttcacaccacgctggaaaacgactcggaccgatg

SEQ ID NO: 12199 - DNA, 203 bp, Homo sapiens
ggcgcgccagtccttcgcttcgctccctttctccctccatccttccacttcccctgctcggccccgccgtcaggccgggtcccccttccctgccgtcatcaggtgttagaaagtgaggcttggcactttcctttcgaaccatccttctggacaaactttgatggagaatttcacaccacgctggaaaacgactcggaccgatg

SEQ ID NO: 12200 - DNA, 203 bp, Homo sapiens
ggcgcgccagtcctcaactgacctccctttctccctccatccttccacttcccctgctcggccccgccgtcaggccgggtcccccttccctgccgtcatcaggttccccttctcccactgcaaggtcttcctttcgaaccatccacagaatgttgctttgatggagaatttcacaccacgctggaaaacgactcggaccgatg

SEQ ID NO: 12201 - DNA, 203 bp, Homo sapiens
ggcgcgccagtcctggaaagtgctccctttctccctccatccttccacttcccctgctcggccccgccgtcaggccgggtcccccttccctgccgtcatcaggttccccttctcccactgcaaggtcttcctttcgaaccatccttctggacaaactttgatggagaatttcacaccacgctggaaaacgactcggaccgatg

SEQ ID NO: 12202 - DNA, 203 bp, Homo sapiens
ggcgcgccagtcctgcctcactctccctttctccctccatccttccacttcccctgctcggccccgccgtcaggccgggtcccccttccctgccgtcatcaggttccccttctcccttagctatttaacttcttcgaaccatccttctggacaaactttgatggagaatttcacaccacgctggaaaacgactcggaccgatg

SEQ ID NO: 12203 - DNA, 203 bp, Homo sapiens
ggcgcgccagtcctgatcgccgctccctttctccctccatccttccacttcccctgctcggccccgccgtcaggccgggtcccccttccctgccgtcatcaggttccccttctcccttcttggcactttcctgaaatcaagatgcactggacaaactttgatggagaatttcacaccacgctggaaaacgactcggaccgatg

SEQ ID NO: 12204 - DNA, 203 bp, Homo sapiens
ggcgcgccagtccttgagcgtgctccctttctccctccatccttccacttcccctgctcggccccgccgtcaggccgggtcccccttccctgccgtcatcaggttccccttctcccttcttggcactttcctttcgaaccatccacagaatgttgctttgatggagaatttcacaccacgctggaaaacgactcggaccgatg

SEQ ID NO: 12205 - DNA, 203 bp, Homo sapiens
ggcgcgccagtcctcaatcattctccctttctccctccatccttccacttcccctgctcggccccgccgtcaggccgggtcccccttccctgccgtcatcaggttccccttctcccttcttggcactttcctttcgaaccatccttctggacaaactttgatggagaatttcacaccacgctggaaaacgactcggaccgatg

SEQ ID NO: 12206 - DNA, 203 bp, Homo sapiens
ggcgcgccagtcctccacaccactccctttctccctccatccttccacttcccctgctcggccccgccgtcaggccgggtcccccttccctgccgtcatcaggttccccttctcccttcttggcactttcctttcgaaccatccttctggacaaactttgatggagaatttcactaattcgattccctcgactcggaccgatg

SEQ ID NO: 12207 - DNA, 203 bp, Homo sapiens
ggcgcgccagtcctactcgctcctccctttctccctccatccttccacttcccctgctcggccccgccgtcaggccgggtcccccttccctgccgtcatcaggttccccttctcccttcttggcactttcctttcgaaccatccttctggacaaactttggaatccgtcgagtgaccacgctggaaaacgactcggaccgatg

SEQ ID NO: 12208 - DNA, 203 bp, Homo sapiens
ggcgcgccagtcctgggcgatactccctttctccctccatccttccacttcccctgctcggcgtgattaggttctggggtcccccttccctgccgtcatcaggttccccttctcccttcttggcactttcctttcgaaccatccttctggacaaactttgatggagaatttcacaccacgctggaaaacgactcggaccgatg

SEQ ID NO: 12209 - DNA, 203 bp, Homo sapiens
ggcgcgccagtcctgggaagctctccgacgtgcttactgttggcagcagcacaatgtttgggctaagacctggtcttgaaagcgccacaagcagcagctgctgagccatggctgaaggggaaatcaccaccttcacagccctgaccgagaagtttaatctgcctccagggaattacaagaagcccaaacgactcggaccgatg

SEQ ID NO: 12210 - DNA, 203 bp, Homo sapiens
ggcgcgccagtcctggccaaatctcctcctcgagcctgggaccgccgcgctcccgccgccgctatccaggtagagtactcccggcccgtgccgcgccctcccgcgtccgcagccggctcggcttcctgcccacccagacgtcgcttctcccgggctcccggtgtcggctccgcgcggagggagaggaacgactcggaccgatg

SEQ ID NO: 12211 - DNA, 203 bp, Homo sapiens
ggcgcgccagtccttgtgtgggctcctttcgaggccccatcaagaacacccaagtttgctcggtcatctgctgcgtcctcttcctgctcttcattctaggttacatcgtggtggggattgtggcctggttgtatggagacccccggcaagtcctctaccccaggaactctactggggcctactgtggccgactcggaccgatg

SEQ ID NO: 12212 - DNA, 203 bp, Homo sapiens
ggcgcgccagtcctagttggtactcctttcgaggccccatcaagaacagaagctgcacagatgtcatctgctgcgtaggaagggccacagtcattctaggttacatcgtggtggggattgtggcctggttgtatggagacccccggcaagtcctctaccccaggaactctactggggcctactgtggccgactcggaccgatg

SEQ ID NO: 12213 - DNA, 203 bp, Homo sapiens
ggcgcgccagtcctgaggagttctcctttcgaggccccatcaagaacagaagctgcacagatgtcatctgctgcgtcctcttcctgctcttcattctaggttacatcgtggtggggattgtggcctggttgtatggagacccccggcaagtcctctacccgttatgtatagtgagggcctactgtggccgactcggaccgatg

SEQ ID NO: 12214 - DNA, 203 bp, Homo sapiens
ggcgcgccagtccttgaagagtctcctttcgaggccccatcaagaacagaagctgcacagatgtcatctgctgcgtcctcttcctgctcttcattctaggttacatcgtggtggggattgtggcctggttgtatggagacccccgggggcaaagggctgtcaggaactctactggggcctactgtggccgactcggaccgatg

SEQ ID NO: 12215 - DNA, 203 bp, Homo sapiens
ggcgcgccagtcctcgagtaacctcctttcgaggccccatcaagaacagaagctgcacagatgtcatctgctgcgtcctcttcctgctcttcattctaggttacggtaataccaacggtgtggcctggttgtatggagacccccggcaagtcctctaccccaggaactctactggggcctactgtggccgactcggaccgatg

SEQ ID NO: 12216 - DNA, 203 bp, Homo sapiens
ggcgcgccagtcctgtcaaatgctcctttcgagggttttcaggaccttgaagctgcacagatgtcatctgctgcgtcctcttcctgctcttcattctaggttacatcgtggtggggattgtggcctggttgtatggagacccccggcaagtcctctaccccaggaactctactggggcctactgtggccgactcggaccgatg

SEQ ID NO: 12217 - DNA, 203 bp, Homo sapiens
ggcgcgccagtccttacgccctctcgaaggcaggagcgaccggcgcctcctcgaccctgactggagaaggaggaatcgcgccaggcggagcgtcaggtcccgttttcctctccggcgtctccaatacaaagattacggtgcagaaggaaattgcactcgtctcctccgcgcccccggtacccaacacacgactcggaccgatg

SEQ ID NO: 12218 - DNA, 203 bp, Homo sapiens
ggcgcgccagtcctgacctgaactcgaaggcaggagcgaccggcgcctttggctgaggaggaaagagcacctcccccgcgccaggcggagcgtcaggtcccgttttcctctccggcgtctccaatacaaagattacggtgcagaaggaaattgcactcgtctcctccgcgcccccggtacccaacacacgactcggaccgatg

SEQ ID NO: 12219 - DNA, 203 bp, Homo sapiens
ggcgcgccagtcctattacggactcgaaggcaggagcgaccggcgcctttggctgaggaggaggagaaggaggaatcgcgccaggcggagcgtcaggtcccgttttcctctccggcgttcatgggcacttagttacggtgcagaaggaaattgcactcgtctcctccgcgcccccggtacccaacacacgactcggaccgatg

SEQ ID NO: 12220 - DNA, 203 bp, Homo sapiens
ggcgcgccagtcctcgattccactcgcctgagggatgctggatctgcaatgatagaattggcctgccacagacattggtatttaagttgaagagcagaattcacaatgattctgctgcagagagctttaatgcactccccgtatgcgggcacagttcaattgcttcagggggaacacacagcagggagcgactcggaccgatg

SEQ ID NO: 12221 - DNA, 203 bp, Homo sapiens
ggcgcgccagtcctgtttgtctctcgcctgagggatgctggatctgcaatgatagaattggcctgccacagacattggtatttaagttgaagagcagaattcacaatgattctgctgcagagagctttaatggcaatgagactctggggcacagttcaatacagagtcaaatctcacacagcagggagcgactcggaccgatg

SEQ ID NO: 12222 - DNA, 203 bp, Homo sapiens
ggcgcgccagtcctctaaggtactcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagcgactcggaccgatg

SEQ ID NO: 12223 - DNA, 203 bp, Homo sapiens
ggcgcgccagtcctcggtcatcctcgcctgagggatgctggatctgcaatgatagaattggcctgccacagacattggtatttaagttgaagagcagaattcacccgccactaaaataagagagctttaatggcaatgagactctggggcacagttcaattgcttcagggggaacacacagcagggagcgactcggaccgatg

SEQ ID NO: 12224 - DNA, 203 bp, Homo sapiens
ggcgcgccagtcctcaattgtgctcgcctgagggatgctggatctgcaatgatagaattggcctgccacagacattggtatttaagttgagttcgtactggtgtaatgattctgctgcagagagctttaatggcaatgagactctggggcacagttcaattgcttcagggggaacacacagcagggagcgactcggaccgatg

SEQ ID NO: 12225 - DNA, 203 bp, Homo sapiens
ggcgcgccagtccttcgtgcggctcgcctgagggatgctggatctgcaatgatagaattggcgaaatgggctatccggtatttaagttgaagagcagaattcacaatgattctgctgcagagagctttaatggcaatgagactctggggcacagttcaattgcttcagggggaacacacagcagggagcgactcggaccgatg

SEQ ID NO: 12226 - DNA, 203 bp, Homo sapiens
ggcgcgccagtcctcgtgcagtctcgcctgagggatgctggatctgcatacgcgacgacaagctgccacagacattggtatttaagttgaagagcagaattcacaatgattctgctgcagagagctttaatggcaatgagactctggggcacagttcaattgcttcagggggaacacacagcagggagcgactcggaccgatg

SEQ ID NO: 12227 - DNA, 203 bp, Homo sapiens
ggcgcgccagtccttgcgttagctcgcctgaggggatagttccagtttatgatagaattggcctgccacagacattggtatttaagttgaagagcagaattcacaatgattctgctgcagagagctttaatggcaatgagactctggggcacagttcaattgcttcagggggaacacacagcagggagcgactcggaccgatg

SEQ ID NO: 12228 - DNA, 203 bp, Homo sapiens
ggcgcgccagtcctcgaggtatctcgcggctataaggggcggaggctgggcggcgttgctctgcgctctgcggctgacggcgcttttgtccgtaacgagcctctcctttcagaaggagaaggcagctctgtttctctgcagaggagtagggtcctttcagccatgaagcatgtgttgaacctctacctcgactcggaccgatg

SEQ ID NO: 12229 - DNA, 203 bp, Homo sapiens
ggcgcgccagtccttccttcagctcgcggctataaggggcggaggctgggcggcgttgctctgcgctctgcggctgacggcgcttttgtctccgggtccagaggcctttcagaaggagaaggcagctctgtttctctgcagaggagtagggtcctttcagagtccctagtcccattgaacctctacctcgactcggaccgatg

SEQ ID NO: 12230 - DNA, 203 bp, Homo sapiens
ggcgcgccagtcctcctcaaacctcgcggctataaggggcggaggctgggcggcgttgctctgcgctctgcggctgacggcgcttttgtctccgggtccagaggcctttcagaaggagaaggcagctctgtttctctgcagaggagtagggtcctttcagccatgaagcatgtgttgaacctctacctcgactcggaccgatg

SEQ ID NO: 12231 - DNA, 203 bp, Homo sapiens
ggcgcgccagtccttccaatttctcgcggctataaggggcggaggctgggcggcgttgctctgcgctctgcggctgacggcgcttttgtctccgggtccagagggggcctgttctttcaaggcagctctgtttctctgcagaggagtagggtcctttcagccatgaagcatgtgttgaacctctacctcgactcggaccgatg

SEQ ID NO: 12232 - DNA, 203 bp, Homo sapiens
ggcgcgccagtccttacgaaagctcgcggctcacggcgctcctggggcccatttacggtactcctgcccggcggccctatgccgggggtgccgctcagctggctctggacaagtcagattcccacccctctgacgctctgaccaggaaaaaaccggccaaggcggaatctaagtcctttgctgtgggacgactcggaccgatg

SEQ ID NO: 12233 - DNA, 203 bp, Homo sapiens
ggcgcgccagtcctacattattctcggcaggaagagaccgacccgccacccgccgtagcccgcgcgcccctggcactcaatccccgccatgtgggggctcctgctcgccctggccgccttcgcatgacaatacggcccggctctgggggcgcccaggaactcggtgctgggcctcgcgcagcccgggacgactcggaccgatg

SEQ ID NO: 12234 - DNA, 203 bp, Homo sapiens
ggcgcgccagtcctacgcgcctctcggcaggaagagaccgacccgccacccgccgtagcccgcgcgcccctggcactcaatccccgccatgtgggggctcctgctcgccctggccgccttcgcgccggccgtaatgattcagtaacgggcgcccaggaactcggtgctgggcctcgcgcagcccgggacgactcggaccgatg

SEQ ID NO: 12235 - DNA, 203 bp, Homo sapiens
ggcgcgccagtcctagaagccgctcggcaggaagagaccgacccgccacccgccgtagcccgcgcgcccctggcactcaatccccgccatgtgggggctcctgctcgccctggccgccttcgcgccggccgtcggcccggctctggatcattaagacttgtcggtgctgggcctcgcgcagcccgggacgactcggaccgatg

SEQ ID NO: 12236 - DNA, 203 bp, Homo sapiens
ggcgcgccagtcctgtactttgctcggcaggaagagaccgacccgccacccgccgtagcccgcgcgcccctggcactcaatccccgccatgtgggggctcctgctcgccctggccgccttcgcgccggccgtcggcccggctctgggggcgcccaggaacagatgctctaatgacgcgcagcccgggacgactcggaccgatg

SEQ ID NO: 12237 - DNA, 203 bp, Homo sapiens
ggcgcgccagtcctagtccgccctcggcaggaagagaccgacccgccacccgccgtagcccgcgcgcccctggcactcaatccccgccatgtgggggctcctgctcgccctggccgccttcgcgccggccgtcggcccggctctgggggcgcccaggaactcggtgctgggcctgcgtatcgtactagcgactcggaccgatg

SEQ ID NO: 12238 - DNA, 203 bp, Homo sapiens
ggcgcgccagtcctgcccgtgactcgtgtttatggggtttcccctggaaaatggtgagggacgattggcatgctacaggctgttgctgacggcaaggctcatttcactgagtcagtgaagccagtgctcgacctgacaaattcaatcctgtgtcgggtggaatgaataacatgtcttctgctgcgccccgactcggaccgatg

SEQ ID NO: 12239 - DNA, 203 bp, Homo sapiens
ggcgcgccagtccttcctggctctcgtgtttatggggtttcccctggactcgttcataacctcgggtcgtaagccgaggctgttgctgacggcaaggctcatttcactgagtcagtgaagccagtgctcgacctgacaaattcaatcctgtgtcgggtggaatgaataacatgtcttctgctgcgccccgactcggaccgatg

SEQ ID NO: 12240 - DNA, 203 bp, Homo sapiens
ggcgcgccagtcctgcgtgtaactcgtgtttatggggtttcccctggactcgttcataacctgattggcatgctacaggctgttgctgacggcaaggctcatttcactgagtcagtgaagccagtgctcgacctgacaaattcaatcctgtgtcgggtggttatggagcagaaccttctgctgcgccccgactcggaccgatg

SEQ ID NO: 12241 - DNA, 203 bp, Homo sapiens
ggcgcgccagtccttcagaagactcgtgtttatggggtttcccctggactcgttcataacctgattggcatgctacgattctcgcggagaggcaaggctcatttcactgagtcagtgaagccagtgctcgacctgacaaattcaatcctgtgtcgggtggaatgaataacatgtcttctgctgcgccccgactcggaccgatg

SEQ ID NO: 12242 - DNA, 203 bp, Homo sapiens
ggcgcgccagtcctatcttagcctctaagcgagctgtgtgtgggcggatgcgagtggccggagaccagggcccaacataaacaagctttggagacaaacaaccttatgacctgtcagccctgacaaaggtcagctagccccttgaggacatcagctttggcctcagggtcctaatggcagcagaaccacgactcggaccgatg

SEQ ID NO: 12243 - DNA, 203 bp, Homo sapiens
ggcgcgccagtcctctgtgggcctctaatggccatcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcaaccgactcggaccgatg

SEQ ID NO: 12244 - DNA, 203 bp, Homo sapiens
ggcgcgccagtcctggctttcactctcacgcattttagtgtcatgaattagtgtttcaaatcagttgcatatcaattaagaaaaacttaggagacaggtatagaacctctctttcagataactggtcaattaaggacagaaattctgtttctcaaatccgctagcctttgtcaatagatgagtggattcgactcggaccgatg

SEQ ID NO: 12245 - DNA, 203 bp, Homo sapiens
ggcgcgccagtcctgctctatactctcacgcattttagtgtcatgaattagtgtttcaaatcagttgcatatcaattaagaaaaacttaggagacaggtatagaacctctctttcagataactggtcaattaccccagagttgctcgtttctcaaatccgctagcctttgtcaaagaggacacaagcacgactcggaccgatg

SEQ ID NO: 12246 - DNA, 203 bp, Homo sapiens
ggcgcgccagtccttgtgaacactctgatcctctacaactcttgaaacacagatttcccacaagtctcctcttcgtcatcaagcaaccaccgcatccagcatcaagcccacctgaaatgcgacggtctccatctctggccgaacgatatcggtagttaattaaaacttagggtgcaagatcatccacacgactcggaccgatg

SEQ ID NO: 12247 - DNA, 203 bp, Homo sapiens
ggcgcgccagtcctgacatattctctgatcctctacaactcttgaaacacagatttcccacaagtctcctcttcgtgtctcttactattacgcatccagcatcaagcccacctgaaattgtctccggcttccctctggccgaacgatatcggtagttaattaaaacttagggtgcaagatcatccacacgactcggaccgatg

SEQ ID NO: 12248 - DNA, 203 bp, Homo sapiens
ggcgcgccagtcctgcctggtcctctgatcctctctgtggaaccgccaacagatttcccacaagtctcctcttcgtcatcaagcaaccaccgcatccagcatcaagcccacctgaaattgtctccggcttccctctggccgaacgatatcggtagttaattaaaacttagggtgcaagatcatccacacgactcggaccgatg

SEQ ID NO: 12249 - DNA, 203 bp, Homo sapiens
ggcgcgccagtcctaagtctgactctgcggccaaaagccacgtggataagatccacctttgtgtgcggtgcaacccagaagggggtcgaccttggtgacactctagtgaacccctgaatggcaatctcaagcgcctctgtagggaagccaagaatgtccaggaggtaccccttcctctcggaagggatcgactcggaccgatg

SEQ ID NO: 12250 - DNA, 203 bp, Homo sapiens
ggcgcgccagtcctagtctacactctgcggccaaaagccacgtggataagatccacctttgtgtgcggtgcaaccccagcaccctggtttcttggtgacactctagtgaacccctgaatggcaatctcaagcgcctctgtagggaaagactagcccggatggaggtaccccttcctctcggaagggatcgactcggaccgatg

SEQ ID NO: 12251 - DNA, 203 bp, Homo sapiens
ggcgcgccagtcctataaagttctctgcggccaaaagccacgtggataagatccacctttgtgtgcggtgcaaccccagcaccctggtttcttggtgacactctagtgaacccctgaatggcaatctcaagctttatccctacctcgccaagaatgtccaggaggtaccccttcctctcggaagggatcgactcggaccgatg

SEQ ID NO: 12252 - DNA, 203 bp, Homo sapiens
ggcgcgccagtcctaaggagcgctctgcggccaaaagccacgtggataagatccacctttgtgtgcggtgcaaccccagcaccctggtttcttggtgacactctcaaccggattgtcctggcaatctcaagcgcctctgtagggaagccaagaatgtccaggaggtaccccttcctctcggaagggatcgactcggaccgatg

SEQ ID NO: 12253 - DNA, 203 bp, Homo sapiens
ggcgcgccagtcctgtcattctctctgcggccaagcctactaatcgcgagatccacctttgtgtgcggtgcaaccccagcaccctggtttcttggtgacactctagtgaacccctgaatggcaatctcaagcgcctctgtagggaagccaagaatgtccaggaggtaccccttcctctcggaagggatcgactcggaccgatg

SEQ ID NO: 12254 - DNA, 203 bp, Homo sapiens
ggcgcgccagtcctctgcaatactcttatcccgcgtaccctgctctacttagatcttgtttatttgtagtttccttttcaagtcagtggatctcagcgatgtacgctcaatgattccaatttttctgttcttgccttcaggttgtctattacactttcatgtcctctggacttaactctgtttcccatcgactcggaccgatg

SEQ ID NO: 12255 - DNA, 203 bp, Homo sapiens
ggcgcgccagtcctcggatcgcctcttgagactggccgaaaggcagccacggggccaccaaggcggcgcagcgctgagaaactatctttcaaaaatccttcgggtgacccctggtggcaatcccttcccttaggagcatgagtgtggtcgacacattcaccatggcttggctgtggttgctggtttgccgactcggaccgatg

SEQ ID NO: 12256 - DNA, 203 bp, Homo sapiens
ggcgcgccagtccttgcaggacctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcaccatggcttggctgtggttgctggtttgccgactcggaccgatg

SEQ ID NO: 12257 - DNA, 203 bp, Homo sapiens
ggcgcgccagtcctggatgggactcttgagactggccgaaaggcagccacggggccaccaaggcggcgcagcgctgcatgcggcaagggggtgttgagacaaattgacccctggtggcaatcccttcccttaggagcatgagtgtggtcgacacattcaccatggcttggctgtggttgctggtttgccgactcggaccgatg

SEQ ID NO: 12258 - DNA, 203 bp, Homo sapiens
ggcgcgccagtcctagccagcactgaaacaagaagtttgtgcctactcaacagctttgaaagagcacttcccaacgctgctagtagtcttataggcggcatcaactgtactgtgagattgcccggtacagcagcagttgtattctttattagcttggtagatcattttctctcgctcttttttttaatcgactcggaccgatg

SEQ ID NO: 12259 - DNA, 203 bp, Homo sapiens
ggcgcgccagtcctggaatcaactgaaacaagaagtttgtgcctactcaacagctttgaaagagcacttcccaacgctgctagtagtctttgttttcttcagtgctgtactgtgagattgcccggtacagcagcagttgtattcttccgacttggacgtcatcattttctctcgctcttttttttaatcgactcggaccgatg

SEQ ID NO: 12260 - DNA, 203 bp, Homo sapiens
ggcgcgccagtcctaatcacttctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcggatgcccggccggccgactcggaccgatg

SEQ ID NO: 12261 - DNA, 203 bp, Homo sapiens
ggcgcgccagtcctcaggtacactgaatgtggctggatcgctaagcttagctagagcacgtaacccaatgtgtatctagtcgtaatgagcaattgcgggatgggaccaactactttgggtgtccgtgtttcactttttcctttatatttgcttatggtgacaatatatacaatatatatattggcacccgactcggaccgatg

SEQ ID NO: 12262 - DNA, 203 bp, Homo sapiens
ggcgcgccagtcctctatacaactgagcagccagtaggggagagagcaacccgttgggctttagcaccagctccctcctgcctgaagatgttccaccaaatttgggcagctctgctctacttctatggtattatccttaactccatctaccagtgccctgagcacagtcaactgacaactctgggcgtcgactcggaccgatg

SEQ ID NO: 12263 - DNA, 203 bp, Homo sapiens
ggcgcgccagtcctaacgcggcctgagcagccagtaggggagagagcagttaaggcacacagagcaccagctccctcctgcctgaagatgttccaccaaatttgccttctaacctgagacttctatggtattatccttaactccatctaccagtgccctgagcacagtcaactgacaactctgggcgtcgactcggaccgatg

SEQ ID NO: 12264 - DNA, 203 bp, Homo sapiens
ggcgcgccagtccttcgatcgtctgagcagccagtaggggagagagcagttaaggcacacagagcaccagctccctcctgcctgaagatgttccaccaaatttgggcagctctgctctacttctatggtattatccttaactccatagttgtaaaaatgtagcacagtcaactgacaactctgggcgtcgactcggaccgatg

SEQ ID NO: 12265 - DNA, 203 bp, Homo sapiens
ggcgcgccagtcctgatccagactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtcgactcggaccgatg

SEQ ID NO: 12266 - DNA, 203 bp, Homo sapiens
ggcgcgccagtcctcccatttgctgagcagccagtaggggagagagcagttaaggcacacagagcaccagctccctcctgcctgaagatgttccaccaaatttgggcagctctgctctacttctatggtattatccttaactccatctaccagtgccctggattggccagctgtacaactctgggcgtcgactcggaccgatg

SEQ ID NO: 12267 - DNA, 203 bp, Homo sapiens
ggcgcgccagtcctgggccggcctgagcagccagtaggggagagagcagttaaggcacacagctgtggtttattaacctgcctgaagatgttccaccaaatttgggcagctctgctctacttctatggtattatccttaactccatctaccagtgccctgagcacagtcaactgacaactctgggcgtcgactcggaccgatg

SEQ ID NO: 12268 - DNA, 203 bp, Homo sapiens
ggcgcgccagtcctccagagaactgaggcccgggcactgagctgccataccccgaaagcaggatggagctggagtgaggtggaggggccgcaagctgctgaccggcgtgtggaacactggtggtttgcagatcactgaggctggacaacgttcatggctctcgggtagaacctagtgaaacggccagacgactcggaccgatg

SEQ ID NO: 12269 - DNA, 203 bp, Homo sapiens
ggcgcgccagtcctcagacccactgatattaatatccctgatttacccatttgtgtgtatgatccgctaccagttattttgcttggcattcttttgggcgttgcgattgtaattattgtagttttgttgttatattttatggtggaagcgcgccgctttttgcatgatgcttagaccataatctaaaccgactcggaccgatg

SEQ ID NO: 12270 - DNA, 203 bp, Homo sapiens
ggcgcgccagtccttacataacctgatattaatatccctgatttacccatttgtgtgtatgatccgctaccagttattttgcttggcattcttttgggcgttgcgattgtaattattgtagttttgttgttatattttatggtggataatgttactaggctgcatgatgcttaggatgacggtacgtgcgactcggaccgatg

SEQ ID NO: 12271 - DNA, 203 bp, Homo sapiens
ggcgcgccagtcctccgccatgctgcagccgccgattttaaatcagcgcagtcagcagctcggcgccacctccggtcggcgactgcggcgggctcgacgaggcggctgacggggcggcggcgggaagacggccgggtgcgccttggggtttagtggcggcttctccatgggtccagccagccgcttcccgactcggaccgatg

SEQ ID NO: 12272 - DNA, 203 bp, Homo sapiens
ggcgcgccagtcctatacgtctctgcagccgccgccgccggccgccttcagtcagcagctcggcgccacctccggtcggcgactgcggcgggctcgacgaggcggctgacggggcggcatacatttagtcttcgggtgcgccttggggtttagtggcggcttctccatgggtccagccagccgcttcccgactcggaccgatg

SEQ ID NO: 12273 - DNA, 203 bp, Homo sapiens
ggcgcgccagtcctctccgtgcctgcagccgccgccgccggccgccttcagtcagcagctcggcgccacctccggtcggcgactgcggcgggctcgacgaggcggctgacggggcggcggcgggaagacggccgggtgcgccttggggtttagtggcggcttctccatgggtccccgtgttgttccttcgactcggaccgatg

SEQ ID NO: 12274 - DNA, 203 bp, Homo sapiens
ggcgcgccagtcctgtttaaagctgccacagaaacgcttaggactcccattcccatggagaaactcctagatgaggttcttgcccccggtgggccttataacttaaccgtcggcagttgggtaagagaccacgtccgatcaattgtcgagggcgcgtgggaagtgcgcgatgttgttaccgctgcccacgactcggaccgatg

SEQ ID NO: 12275 - DNA, 203 bp, Homo sapiens
ggcgcgccagtcctatcccgtgctgccctaaaatagcttcccatgtgagggctagagaaaggaaaagattagacccgttgctacgctagaagagaaagtgaaggagggcaggggagggggacagcgagccattgagcgatctttgtcaagcatcccagaagactgcgccatggggctcagcgacggggcgactcggaccgatg

SEQ ID NO: 12276 - DNA, 203 bp, Homo sapiens
ggcgcgccagtcctatgttccactgccctaaaatagcttcccatgtgagggctagagaaaggaaaagattagaccctccctggatgagagagagaaagtgaaggagggcaggggagggggacagcgagccattgagcgatctttgtcaagcatcccagaactactgctagcaccgctcagcgacggggcgactcggaccgatg

SEQ ID NO: 12277 - DNA, 203 bp, Homo sapiens
ggcgcgccagtcctcaccacaactgccctaaaatagcttcccatgtgagggctagagaaaggaaaagattagaccctccctggatgagagagagaaagtgaaggtctcgccctccaacggacagcgagccattgagcgatctttgtcaagcatcccagaagactgcgccatggggctcagcgacggggcgactcggaccgatg

SEQ ID NO: 12278 - DNA, 203 bp, Homo sapiens
ggcgcgccagtcctcgtttgttctgccctaaaatagcttcccatgtgagggctagagaaaggcccgcggatatggttccctggatgagagagagaaagtgaaggagggcaggggagggggacagcgagccattgagcgatctttgtcaagcatcccagaagactgcgccatggggctcagcgacggggcgactcggaccgatg

SEQ ID NO: 12279 - DNA, 203 bp, Homo sapiens
ggcgcgccagtccttggcattcctgccctaaaatcatcaaggtcaactgggctagagaaaggaaaagattagaccctccctggatgagagagagaaagtgaaggagggcaggggagggggacagcgagccattgagcgatctttgtcaagcatcccagaagactgcgccatggggctcagcgacggggcgactcggaccgatg

SEQ ID NO: 12280 - DNA, 203 bp, Homo sapiens
ggcgcgccagtcctatggtagtctgccggccggcactagtctttgacgccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 12281 - DNA, 203 bp, Homo sapiens
ggcgcgccagtcctactctgttctgccggccggcggccccgcgctcgcccgccccgcttccgaagatccgaggtgagcacgaacccttccaactctcctttcctcccccacccttgagttacccctctgtctttcctgctgttgcgcgggtgctcccacagcggagcggagattacagagccgccgggcgactcggaccgatg

SEQ ID NO: 12282 - DNA, 203 bp, Homo sapiens
ggcgcgccagtcctccggctgactgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 12283 - DNA, 203 bp, Homo sapiens
ggcgcgccagtcctccacttggctgccggccggcggccccgcgctcgcccgccccgcttccgcccgctgtcctgctgcacgaacccttccttgctatacgcaaacccccacccttgagttacccctctgtctttcctgctgttgcgcgggtgctcccacagcggagcggagattacagagccgccgggcgactcggaccgatg

SEQ ID NO: 12284 - DNA, 203 bp, Homo sapiens
ggcgcgccagtcctaatattctctgccggccggcggccccgcgctcgcccgccccgcttccgcccgctgtcctgcttactttgattccataactctcctttcctcccccacccttgagttacccctctgtctttcctgctgttgcgcgggtgctcccacagcggagcggagattacagagccgccgggcgactcggaccgatg

SEQ ID NO: 12285 - DNA, 203 bp, Homo sapiens
ggcgcgccagtcctgagcattgctgccggccggcggccccgcgctcgcgttagagcgcagttcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 12286 - DNA, 203 bp, Homo sapiens
ggcgcgccagtcctccacccttctgctataagaaaggccttattaggacacatagttagccctaggtgtgaatatcaagcaggacataactgttatcaggtagaacaatacttggcactagcagcattaataacaccaaaaaagataaagccacctttgcctagtgttacgaaactgacagaggatagcgactcggaccgatg

SEQ ID NO: 12287 - DNA, 203 bp, Homo sapiens
ggcgcgccagtcctacccaagtctgcttatggtgacaattgagagattgttaccatatagctcaactgccatagtaccggtgaccaatagagctattatatatctctttgttgggtttataccacttagcttgaaagaggttaaaacattacaattcattgttaagttgaatacagcaaaatgggagccgactcggaccgatg

SEQ ID NO: 12288 - DNA, 203 bp, Homo sapiens
ggcgcgccagtccttatgtactctgcttatggtggttccgtgcgaccggttaccatatagctattggattggccatccggtgaccaatagagctattatatatctctttgttgggtttataccacttagcttgaaagaggttaaaacattacaattcattgttaagttgaatacagcaaaatgggagccgactcggaccgatg

SEQ ID NO: 12289 - DNA, 203 bp, Homo sapiens
ggcgcgccagtcctaggtccatctggctctggaggcgcaggtggtcctgacctcctccaggtatggtgcgcgctgttttctaatcacgtggctgccacccaggtaagaagaggccgctcttcctggggttgtttctccgtgtgacgtgtggcctttgagatcaactctcctgtaccagcgtaggccgccgactcggaccgatg

SEQ ID NO: 12290 - DNA, 203 bp, Homo sapiens
ggcgcgccagtcctgcatcgatctggctctggaggcgcaggtggtccttcttctactgtcacatggtgcgcgctgtggcgcctggttcccgctgccacccaggtaagaagaggccgctcttcctggggttgtttctccgtgtgacgtgtggcctttgagatcaactctcctgtaccagcgtaggccgccgactcggaccgatg

SEQ ID NO: 12291 - DNA, 203 bp, Homo sapiens
ggcgcgccagtccttccactccctggctctggaggcgcaggtggtccttcttctactgtcacatggtgcgcgctgttttctaatcacgtggctgccacccaggtaagaagaggccgctcttcctggggttgtgggggaacaatttatgtggcctttgagatcaactctcctgtaccagcgtaggccgccgactcggaccgatg

SEQ ID NO: 12292 - DNA, 203 bp, Homo sapiens
ggcgcgccagtcctgtaagcgtctggctgagcctatgtaattagccattccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacacccgactcggaccgatg

SEQ ID NO: 12293 - DNA, 203 bp, Homo sapiens
ggcgcgccagtcctagtagttcctggctgagcctggcgggaggcggggagatgcattaacagtgccgccgcgcccccggtttctataaattgagcccgcagcctcccgcttcgctctctgctcctcctgttcgacagtcagccgcatcttcttttgcgtcgccagccgagccacatcgctcagacacccgactcggaccgatg

SEQ ID NO: 12294 - DNA, 203 bp, Homo sapiens
ggcgcgccagtcctccggtgtactggctgagcctggcgggaggcggggtccgagtcaccgcctgccgccgcgcccccggtttctataaattgagcccgcagcctcccgcttcgctctctgctcctcctgttcccagtcgtagtaagtcttcttttgcgtcgccagccgagccacatcgctcagacacccgactcggaccgatg

SEQ ID NO: 12295 - DNA, 203 bp, Homo sapiens
ggcgcgccagtccttaccgcagctggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcagttctactaagttatcgctcagacacccgactcggaccgatg

SEQ ID NO: 12296 - DNA, 203 bp, Homo sapiens
ggcgcgccagtccttgcaccggctgggtcgccagatttggttgtctttttttgaggccttgtgcgctgtacttctccaaatgggaaacaagcaagccaaagccccagaatcaaaagacagtccgagagccagcctgatcccagatgccacacatctagggccacagttctgtaagagctgctggttcgcgactcggaccgatg

SEQ ID NO: 12297 - DNA, 203 bp, Homo sapiens
ggcgcgccagtcctacttgggtctggtacttggtccaaggacgcagacctctttttgagtatcacgcctccggaagtagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12298 - DNA, 203 bp, Homo sapiens
ggcgcgccagtcctaggagtgtctggtgctgctcataaaacagacatcaatccattgaatcaactgccagaccgaacaaacaaatgtccgtcagcggaaccaccaaccaatcaatcaaccaactgatccatcagcaacctgacgaaattaacaatatagtaacaaaaaaagaacaagatggggcaaatcgactcggaccgatg

SEQ ID NO: 12299 - DNA, 203 bp, Homo sapiens
ggcgcgccagtcctttctcggcctggttaccagcaacataggaaattgtcgttgaactacatgttgtaaggctttagagaaataagggagtgtcctatttaggaccgacaagagtcaaggcagccccaccaaaacctctagcgactaggaacagctatatcgggttgctatagcagtcaggatgtcatcgactcggaccgatg

SEQ ID NO: 12300 - DNA, 203 bp, Homo sapiens
ggcgcgccagtcctctttggcgctgtcctcgccgccgtcgcgggcagtaatccagtcataagtgacaagctagccggaggagcgcctaggaacccgagccggagctcagcgagcgcagcctgcacgcccgcctcgcgtcccgggggggtcccgcctcccaccccgcctctggacttgtctctttcccccgactcggaccgatg

SEQ ID NO: 12301 - DNA, 203 bp, Homo sapiens
ggcgcgccagtccttatactgtctgtcctcgccgccgtcgcgggcagtgtctagccaggcctcactgctgagcgttgaggagcgcctaggaacccgagccggagctcagcgagcgcagcctgcacgcccgcctcgcgtcccgggggggtcccgcctcccaccccgcctctggacttgtctctttcccccgactcggaccgatg

SEQ ID NO: 12302 - DNA, 203 bp, Homo sapiens
ggcgcgccagtcctcggagaccctgtcctcgccgccgtcgcgggcagtgtctagccaggccttgacaagctagccgataagttaggctcaaacccgagccggagctcagcgagcgcagcctgcacgcccgcctcgcgtcccgggggggtcccgcctcccaccccgcctctggacttgtctctttcccccgactcggaccgatg

SEQ ID NO: 12303 - DNA, 203 bp, Homo sapiens
ggcgcgccagtcctgtacggccctgtcctcgccgccgtcgcgggcagtgtctagccaggccttgacaagctagccggaggagcgcctaggaacccgagccggagctcagcgagcgcagcctgcacgcccgccggctactagccataggtcccgcctcccaccccgcctctggacttgtctctttcccccgactcggaccgatg

SEQ ID NO: 12304 - DNA, 203 bp, Homo sapiens
ggcgcgccagtcctaattcgttctgtcctcgccgccgtcgcgggcagtgtctagccaggccttgacaagctagccggaggagcgcctaggaacccgagccggagctcagcgagcgcagcctgcacgcccgcctcgcgtcccgggggttagaacagaaaatccccgcctctggacttgtctctttcccccgactcggaccgatg

SEQ ID NO: 12305 - DNA, 203 bp, Homo sapiens
ggcgcgccagtccttcacgcatctgtcctcgccgtgcctcacttattggtctagccaggccttgacaagctagccggaggagcgcctaggaacccgagccggagctcagcgagcgcagcctgcacgcccgcctcgcgtcccgggggggtcccgcctcccaccccgcctctggacttgtctctttcccccgactcggaccgatg

SEQ ID NO: 12306 - DNA, 203 bp, Homo sapiens
ggcgcgccagtcctgtggaccactgtgagatcaactacgatccttttatgggagctggggcagggactacgagagcagccagatgggctgaaagtggaactcaaggggtttctggcacctacctacctgcttcccgctggggggtggggagttggcccagagtcttaagattggggcagggtggagagcgactcggaccgatg

SEQ ID NO: 12307 - DNA, 203 bp, Homo sapiens
ggcgcgccagtcctagggctttctgtgagatcaagggtctcttaaggggttttcgaccacgtgggactacgagagcagccagatgggctgaaagtggaactcaaggggtttctggcacctacctacctgcttcccgctggggggtggggagttggcccagagtcttaagattggggcagggtggagagcgactcggaccgatg

SEQ ID NO: 12308 - DNA, 203 bp, Homo sapiens
ggcgcgccagtcctggtgtttcctgtgagatcaagggtctcttaagggtgggagctggggcagggactacgagagcagccagatgggctgaaagtggaactcaaggggtttctggcacctacctacctgcttcccgctggggggtggggagttggcccaggtaaacccagcgttggcagggtggagagcgactcggaccgatg

SEQ ID NO: 12309 - DNA, 203 bp, Homo sapiens
ggcgcgccagtcctaggaacggctgtgagatcaagggtctcttaagggtgggagctggggcagggactacgagagcagccagatgggctgaaagtggaactcaatttaacgtacatctctacctacctgcttcccgctggggggtggggagttggcccagagtcttaagattggggcagggtggagagcgactcggaccgatg

SEQ ID NO: 12310 - DNA, 203 bp, Homo sapiens
ggcgcgccagtcctagtttggcctgtgagatcaagggtctcttaagggtgggagctggggcagggactacgagagctcatgtgcccctgaaaagtggaactcaaggggtttctggcacctacctacctgcttcccgctggggggtggggagttggcccagagtcttaagattggggcagggtggagagcgactcggaccgatg

SEQ ID NO: 12311 - DNA, 203 bp, Homo sapiens
ggcgcgccagtcctatagtgctctgtgagattgcccggtacagcagcaccatgcacaggctctagcttggtagatcattttctctcgctcttttttttaatactagcaactttcatcctttgaaacgtgtgctgaaaaagaagaatcagcaaatactactgaaagtgcaatatttgagtatcactgcgcgactcggaccgatg

SEQ ID NO: 12312 - DNA, 203 bp, Homo sapiens
ggcgcgccagtcctagcaatatctgtgagattgcccggtacagcagcagttgtattctttatgtaaagacaccgctattttctctcgctcttttttttaatactagcaactttcatcctttgaaacgtgtgctgaaaaagaagaatcagcaaatactactgaaagtgcaatatttgagtatcactgcgcgactcggaccgatg

SEQ ID NO: 12313 - DNA, 203 bp, Homo sapiens
ggcgcgccagtcctcctggcgtctgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatattgctaagatctcaatcgactcggaccgatg

SEQ ID NO: 12314 - DNA, 203 bp, Homo sapiens
ggcgcgccagtcctgggctcccctgtgagccccggccccagccgcggacagacccgcggagtcgcctcccggcccacccgcccggccgcctgtttctttcgtttggacgggaccccggcgcccccaccccatccccgggagaactctaagaaggagctgatgtggaggagcagctgagacagttcaagcgactcggaccgatg

SEQ ID NO: 12315 - DNA, 203 bp, Homo sapiens
ggcgcgccagtccttttagggtctgtgagccccggccccagccgcggacagacccgcggagtcgcctcccggcccaggtagtaatggagagaggagcgggaggaggacgggaccccggcgcccccaccccatccccgggagaactctaagaaggagctgatgtggaggagcagctgagacagttcaagcgactcggaccgatg

SEQ ID NO: 12316 - DNA, 203 bp, Homo sapiens
ggcgcgccagtcctattacatgctgtgagccccggccccagccgcggacagacccgcggagtgaatggagtcggagcccgcccggccgccgaggagcgggaggaggacgggaccccggcgcccccaccccatccccgggagaactctaagaaggagctgatgtggaggagcagctgagacagttcaagcgactcggaccgatg

SEQ ID NO: 12317 - DNA, 203 bp, Homo sapiens
ggcgcgccagtcctccagctacctgtgagccccgtaatgcttactttccagacccgcggagtcgcctcccggcccacccgcccggccgccgaggagcgggaggaggacgggaccccggcgcccccaccccatccccgggagaactctaagaaggagctgatgtggaggagcagctgagacagttcaagcgactcggaccgatg

SEQ ID NO: 12318 - DNA, 203 bp, Homo sapiens
ggcgcgccagtccttccaccatctgtgcagtcagccttaaacactgactgcacccctcccagatttcttttacattcttcccgccagggcatcacacaatctcataaaatttatgtaatttcatttaattttagccacaaatcatcaaaatgacgaggattttgacagctttcaaagtggtgaggacacgactcggaccgatg

SEQ ID NO: 12319 - DNA, 203 bp, Homo sapiens
ggcgcgccagtcctcttccctgctgtggtaggggaatgccacctgtcatttgaggagcagccgtgtggtatgattgatgattcaacacgcgttctcgccaagtccagcaaggactacatcaatgctagttatattagaatagtcaattgtggagaagagtatttttatatcgctactcaaggaccactcgactcggaccgatg

SEQ ID NO: 12320 - DNA, 203 bp, Homo sapiens
ggcgcgccagtcctctttaagcctgtggtaggggcgacagtgtcgaatcctgaggagcagccgtgtggtatgattgatgattcaacacgcgttcctcttggaaaaagcaaggactacatcaatgctagttatattagaatagtcaattgtggagaagagtatttttatatcgctactcaaggaccactcgactcggaccgatg

SEQ ID NO: 12321 - DNA, 203 bp, Homo sapiens
ggcgcgccagtcctaggcgtacctgtgtgctaataacatcttcgaatgctgcaaatcgagttgctaggcaataaacacatttggattaattttaatcgttcgttgagcgattagcagagaactgaccagaacatgtctggtcgtaaagctcagggaaaaaccctgggcgtcaatatggtacgacgaggcgactcggaccgatg

SEQ ID NO: 12322 - DNA, 203 bp, Homo sapiens
ggcgcgccagtcctccgggcccctgtgtgctaattgaggtgcattggtctgcaaatcgagttgctaggcaataaacacatttggattaatcacttcacacgtccgagcgattagcagagaactgaccagaacatgtctggtcgtaaagctcagggaaaaaccctgggcgtcaatatggtacgacgaggcgactcggaccgatg

SEQ ID NO: 12323 - DNA, 203 bp, Homo sapiens
ggcgcgccagtcctgtgatacgctgtgtgctaattgaggtgcattggtctgcaaatcgagttgctaggcaataaacacatttggattaattttaatcgttcgttgagcgattagcagagaactgaccagaacatgtctggtcgtaaagctcagggaaaaaatgcctctcgactaatggtacgacgaggcgactcggaccgatg

SEQ ID NO: 12324 - DNA, 203 bp, Homo sapiens
ggcgcgccagtcctttcgtctgctgtgtgctaattgaggtgcattggtctgcaaatcgagttgctaggcaataaacacatttggattaattttaatcgttcgttgagcgattagcagagaactgaccagaacatgtctggtcgtaaagctcagggaaaaaccctgggcgtcaatatggtacgacgaggcgactcggaccgatg

SEQ ID NO: 12325 - DNA, 203 bp, Homo sapiens
ggcgcgccagtccttatgcttcctgttgctccttaaatactgaggggactgtattgaaagcgtttgtgttcatcttatcagggacctgaccctaagagaatccttcccctgccaaggcagttccagcccccagaactcatcaccccatctcctgaggtggttcctatcctccctctcttctcctcgcccgactcggaccgatg

SEQ ID NO: 12326 - DNA, 203 bp, Homo sapiens
ggcgcgccagtcctagacggttctgttgctccttctgcctcccctctcacagggcatgtctctttgtgttcatcttatcagggacctgaccctaagagaatccttcccctgccaaggcagttccagcccccagaactcatcaccccatctcctgaggtggttcctatcctccctctcttctcctcgcccgactcggaccgatg

SEQ ID NO: 12327 - DNA, 203 bp, Homo sapiens
ggcgcgccagtcctgtgtgctactgttgctccttctgcctcccctctcctgtattgaaagcgcgcactacacgagcatcagggacctgaccctaagagaatccttcccctgccaaggcagttccagcccccagaactcatcaccccatctcctgaggtggttcctatcctccctctcttctcctcgcccgactcggaccgatg

SEQ ID NO: 12328 - DNA, 203 bp, Homo sapiens
ggcgcgccagtcctacttaatgctgttgctccttctgcctcccctctcctgtattgaaagcgtttgtgttcatcttatcagggacctgaccctaagagaatccttcccctgccaaggcagttccagcccccagaactcatcaccccatctcctgaggtggttcctatcctccctctcttctcctcgcccgactcggaccgatg

SEQ ID NO: 12329 - DNA, 203 bp, Homo sapiens
ggcgcgccagtcctatgtagacctgttgctccttctgcctcccctctcctgtattgaaagcgtttgtgttcatcttatcagggacctgaccctaagagaatccttcccctgccaaggcagttccagcccccagaactcatcaccccgctaaacccacaatttcctatcctccctctcttctcctcgcccgactcggaccgatg

SEQ ID NO: 12330 - DNA, 203 bp, Homo sapiens
ggcgcgccagtcctatctaacactgtttcctcctcctccttctcctcctcctccgtgacctcctcctcctctttctcctgagaaacttcgccccagcggtgcggagcgccgctgcgcacaactactcatcttcaggcaggcggcgggcagcgggaggcggcagcccggtgcggtccccgcggctctcgcgactcggaccgatg

SEQ ID NO: 12331 - DNA, 203 bp, Homo sapiens
ggcgcgccagtcctttcgcgcgctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggacaggatccttctgccccgcggctctcgcgactcggaccgatg

SEQ ID NO: 12332 - DNA, 203 bp, Homo sapiens
ggcgcgccagtccttattaagtctgtttcctcctcctccttctcctcctcctccgtgacctcctcctcctctttctcctgagaaacttcgccccagcggtgcggttatagctgctcgcgccggggagggacgcaggcaggcggcgggcagcgggaggcggcagcccggtgcggtccccgcggctctcgcgactcggaccgatg

SEQ ID NO: 12333 - DNA, 203 bp, Homo sapiens
ggcgcgccagtcctctagttagcttacctgcaaccacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12334 - DNA, 203 bp, Homo sapiens
ggcgcgccagtcctattggacccttactaataataacgtgcctcatgaaataaagatccgaaaggaattggaataaaaatttcctgcgtctcatgccaagagggaaacaccagaatcaagtgttccgcgtgaagtgcacgcgagtgtcgtccaagaatgcaaagcacatccaataaaatagctggattcgactcggaccgatg

SEQ ID NO: 12335 - DNA, 203 bp, Homo sapiens
ggcgcgccagtcctatgcgcaacttactaataataacgtgcctcatgaaataaagatccgaaaggaattggaataaaaatttcctgcgtctcatgccaagagggttggcgtgactaatagtgttccgcgtgattgaagacaccccctcgtccaagaatgcaaagcacatccaataaaatagctggattcgactcggaccgatg

SEQ ID NO: 12336 - DNA, 203 bp, Homo sapiens
ggcgcgccagtccttgttcgcacttactaataataacgtgcctcatgaaataaagatccgaaaggaattggaataactgcgattcatccgtcatgccaagagggaaacaccagaatcaagtgttccgcgtgattgaagacaccccctcgtccaagaatgcaaagcacatccaataaaatagctggattcgactcggaccgatg

SEQ ID NO: 12337 - DNA, 203 bp, Homo sapiens
ggcgcgccagtcctgctacggtcttactaataataacgtgcctcatgattattcctcgtaccaggaattggaataaaaatttcctgcgtctcatgccaagagggaaacaccagaatcaagtgttccgcgtgattgaagacaccccctcgtccaagaatgcaaagcacatccaataaaatagctggattcgactcggaccgatg

SEQ ID NO: 12338 - DNA, 203 bp, Homo sapiens
ggcgcgccagtcctcatttaaacttatgtattgagactcattgccttgtgactttatattcacaaaactgctggaagacaatgatctggggtatcacattccctcttaggttaagtttcgcactactaggaatttttgcgaaaattcttaattccattcttatggtgtagtgtttgttcttttcaattcgactcggaccgatg

SEQ ID NO: 12339 - DNA, 203 bp, Homo sapiens
ggcgcgccagtcctgggaaatccttatgtattgatgagagccttaaaatgactttatattcacaaaactgctggaagacaatgatctggggtatcacattccctcttaggttaagtttcgcactactaggaatttttgcgaaaattcttaattccattcttatggtgtagtgtttgttcttttcaattcgactcggaccgatg

SEQ ID NO: 12340 - DNA, 203 bp, Homo sapiens
ggcgcgccagtcctttctaaaccttcaaaacaaatcatatcaatacaatatcaagtagtgtcgatgatctcattaggtactaatcctaacattgtgattcatcctgcattgagaaaagatttagaaaaaaacggtcaacccgcaatatatcctggggtcgtaacgtctcgtgaccctgccgttgcactcgactcggaccgatg

SEQ ID NO: 12341 - DNA, 203 bp, Homo sapiens
ggcgcgccagtcctcgcgactgcttcaaaacaaatcatatcaatacaatatcaagtagtgtcgatgatctcattaggtactaatcctaacattgtgattcatcctgcattgagaaaagggactatctgttcgtaaattaagaatgaatatcctggggtcgtaacgtctcgtgaccctgccgttgcactcgactcggaccgatg

SEQ ID NO: 12342 - DNA, 203 bp, Homo sapiens
ggcgcgccagtcctcggtcgagcttcccggaactggaaggttacattgattacccacctagtacaacatcttacgggaagagcatagtatttcctagaggaatagtctgcgtcgtcccaggtatcattggctctgaattaaatttgaacttgtcccctgaatagctacaggttttggaagctgaatcacgactcggaccgatg

SEQ ID NO: 12343 - DNA, 203 bp, Homo sapiens
ggcgcgccagtcctcggattcacttcccggaactggaaggttacattgattacccacctagtacaacatcttacgggaagagcatagtatttcctagaggaatatgaacataacaggacctgcgtgggccagctgaattaaatttgaacttgtcccctgaatagctacaggttttggaagctgaatcacgactcggaccgatg

SEQ ID NO: 12344 - DNA, 203 bp, Homo sapiens
ggcgcgccagtcctgttctaggcttcccggaactggaaggttacattggacgagatttgtcgacaacatcttacgggaagagcatagtatttcctagaggaatatgaacataacaggaaggtatcattggctctgaattaaatttgaacttgtcccctgaatagctacaggttttggaagctgaatcacgactcggaccgatg

SEQ ID NO: 12345 - DNA, 203 bp, Homo sapiens
ggcgcgccagtcctggatcaagcttcttccccggcctgatctgcgcagcccggcgggcgcccagaaggagcaggcggcgcgggggcgcgctgggcgggggaggcgtggccggagctgcaaaccaggattatgtgggactgctcggccgcctcctgcccggcgagcagctcaggtcctgggctgaagagcgactcggaccgatg

SEQ ID NO: 12346 - DNA, 203 bp, Homo sapiens
ggcgcgccagtcctgcgggtggcttcttccccggcctgatctgcgcagggtcttacagctatagaaggagcaggcggcgcgggggcgcgctgggcgggggaggcgtggccggagctgcggcggcaagcgggctgggactgctcggccgcctcctgcccggcgagcagctcaggtcctgggctgaagagcgactcggaccgatg

SEQ ID NO: 12347 - DNA, 203 bp, Homo sapiens
ggcgcgccagtcctgaggcacccttgaaaaactatgccccggcgggtccgccggccggaggcgggagtcacaggaagagccctccacaaaaggaggcctcggcggatcaggacagctgcaggcttctgccaggtgggtgtgcagactggtgagctgccagcaggggcccagacgcgccaggcctggagcgactcggaccgatg

SEQ ID NO: 12348 - DNA, 203 bp, Homo sapiens
ggcgcgccagtcctcaccaaggcttgaggcaagtcaccagcccctgatcatttcgcctaaaagagcaaggactagagttcctgacctccacctgttatagaacaccctgacctaatgttatcgcggaatgatgatatatgtatctacgggggcctggggctgggcgggctcctgcttctggcagtggtcgactcggaccgatg

SEQ ID NO: 12349 - DNA, 203 bp, Homo sapiens
ggcgcgccagtcctacgactagcttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtcgactcggaccgatg

SEQ ID NO: 12350 - DNA, 203 bp, Homo sapiens
ggcgcgccagtccttataacctcttgcagccaacttcccatcagatcaccctgctggacttgcagaccggaatggggctcgcctaaggagccgagcgctgcggaggctgctgcgtgttcacactattgcctcgggggctggagcgagatttccagggcgcagtcctccggggcgttacgccgggcatacgactcggaccgatg

SEQ ID NO: 12351 - DNA, 203 bp, Homo sapiens
ggcgcgccagtcctagtaaacccttgcagccaacttcccatcagatcaccctgctggacttgcagaccggaatggggctcgcctaaggagccgagcgctgcggaggctgctgcgtgttggatgggagtgggatcccctgtacctaggatttccagggcgcagtcctccggggcgttacgccgggcatacgactcggaccgatg

SEQ ID NO: 12352 - DNA, 203 bp, Homo sapiens
ggcgcgccagtcctaagggcgtcttgcagccaacttcccatcagatcataagcactactggacagaccggaatggggctcgcctaaggagccgagcgctgcggaggctgctgcgtgttggatgggagtgggagggggctggagcgagatttccagggcgcagtcctccggggcgttacgccgggcatacgactcggaccgatg

SEQ ID NO: 12353 - DNA, 203 bp, Homo sapiens
ggcgcgccagtcctcgaacttacttgcgaggtgatcagaaggcaaagatgtcggagcgaaaagtattaaacaaatactacccgccggactttgacccatcaaagatccccaaactcaagctccccaaagaccggcagtacgtggtgcggctgatggccccgaaattgtattcccgtaagacgtgcggacgactcggaccgatg

SEQ ID NO: 12354 - DNA, 203 bp, Homo sapiens
ggcgcgccagtcctccggcactcttgcgaggtgatcagaaggcaaagatgtcggagcgaaaagtattaaacaaatactacccgccggactttgacccatcaaagtggaagtgtggatggctccccaaagaccggcagtacgtggtgcggctgatggcccccttcaacatgaggtgtaagacgtgcggacgactcggaccgatg

SEQ ID NO: 12355 - DNA, 203 bp, Homo sapiens
ggcgcgccagtcctgaggctgtcttggacagtttgtttgccatggtgacataaaggggtgtagaggaaggaaggagcaagaccagcctgtagactgtgcccctggctgggcaaaagggccaggggcccggagccttccctccactgccctcgaacgcctcacttcctaagtctctgcatttctcagtccgactcggaccgatg

SEQ ID NO: 12356 - DNA, 203 bp, Homo sapiens
ggcgcgccagtcctcctacgcacttggcgacacatccaacacgataacctcgtttcaggtagattgttatctatggcacataagaaagctactcagtatgagagacatgtgtgatgccccctttgatgacaggctccgaagagaccaaaaggcattaaagggaagaggcagcacacttggactcgattcgactcggaccgatg

SEQ ID NO: 12357 - DNA, 203 bp, Homo sapiens
ggcgcgccagtcctcgtgtgcccttgtatcacttaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 12358 - DNA, 203 bp, Homo sapiens
ggcgcgccagtccttacttcttcttgtgtcgaaataaaccacagcttgctccggctcattgccgttaaacatcattgttcttatttacaatcaaatcgctatcgccacaaggctagtgataataactaagggatacggtaagctggctccaacctaatctccataaacagtgtctaagacgaacctcacgactcggaccgatg

SEQ ID NO: 12359 - DNA, 203 bp, Homo sapiens
ggcgcgccagtccttctgcattcttgtgtcgaaataaaccacagcttgctccggctcattgccgttaaacatcattgttcttatttacaatcaaatcgctatcgccacaaggctagtgataataactaagggggcgaagtcaagccctccaacctaatctttcagcgtgtcccttaagacgaacctcacgactcggaccgatg

SEQ ID NO: 12360 - DNA, 203 bp, Homo sapiens
ggcgcgccagtcctcaaccaccctttatccgccctgtgaccgtgttggtcgctctgttaatgaaacaagccagactggttgggcattctacgtccgtgctaaacatggtgatttttctggtgttgcctctcaggagggtgttttgtcagaaagagagaagttgcttcatttaatctaaactaaacaaacgactcggaccgatg

SEQ ID NO: 12361 - DNA, 203 bp, Homo sapiens
ggcgcgccagtcctgaagggaacttttaaaaaaggtctccccagtgctagctgccgaagcacccagataagagctgcgaacttaactgctcggcagccccagcttcgcgccccgcccagtccctttcccctgctggggatcccccctcttccccgcccaccccttacccgcatgcagcccagcgccctcgactcggaccgatg

SEQ ID NO: 12362 - DNA, 203 bp, Homo sapiens
ggcgcgccagtccttcataaatcttttaaaaaaggtctccccagtgctagctgccgaagcacccagataagagctggacggaggctaaagcggcagccccagcttcgcgccccgcccagtccctttcccctgctggggatccccccgtagttggctgattcccttacccgcatgcagcccagcgccctcgactcggaccgatg

SEQ ID NO: 12363 - DNA, 203 bp, Homo sapiens
ggcgcgccagtccttgtcaagccttttaaaaaaggtctccccagtgctagctgccgaagcacccagataagagctggacggaggctaaagcggcagccccagcttcgcgccccgcccagtccctttcccctgctggggatcccccctcttccccgcccaccccttacccgcatgcagcccagcgccctcgactcggaccgatg

SEQ ID NO: 12364 - DNA, 203 bp, Homo sapiens
ggcgcgccagtcctatcgaggacttttaaaaaaggtctccccagtgctagctgccgaagcacccagataagagctggacggaggctaaagcggcagccccagcttcgcgccccgcccagtccctttcccctgctggggatcccccctcttccccgcccacgtgcgggaacggaccagcccagcgccctcgactcggaccgatg

SEQ ID NO: 12365 - DNA, 203 bp, Homo sapiens
ggcgcgccagtcctactaacatcttttaaaaaaggtctccccagtgctagctgccgaagcacgactgctcccagccgacggaggctaaagcggcagccccagcttcgcgccccgcccagtccctttcccctgctggggatcccccctcttccccgcccaccccttacccgcatgcagcccagcgccctcgactcggaccgatg

SEQ ID NO: 12366 - DNA, 203 bp, Homo sapiens
ggcgcgccagtccttgcgtcgtcttttattctgaccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgcgactcggaccgatg

SEQ ID NO: 12367 - DNA, 203 bp, Homo sapiens
ggcgcgccagtcctgagtgacgctttttcttttttctcagcaaactgtacaaaaccaaatctctttttgattttcaaggaaactaggttcctgccaaattttgaatctggacaataaacagacactttgtcctagcatctttctggaatcatttcgggatgcaaattcactttcacacagaaacaggacgactcggaccgatg

SEQ ID NO: 12368 - DNA, 203 bp, Homo sapiens
ggcgcgccagtcctaggatgccctttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaacgactcggaccgatg

SEQ ID NO: 12369 - DNA, 203 bp, Homo sapiens
ggcgcgccagtcctggagatcgctttttgctgatacttcatttctaatcttgtagaaaatttcagctgtagccctttattatcttctcacaataacagaagctgtgtacgatgcattagggtattgaagaaaattaacttttgaattaaatatttggaatataaggaaataaggaaagttgactgaaacgactcggaccgatg

SEQ ID NO: 12370 - DNA, 203 bp, Homo sapiens
ggcgcgccagtcctcatgatcccttttttagcaaggcaatctgcaccaatgcaactttgtggtttttgtaatttctttattatttcaccttcggcttacgtttataaaagaggtatgcagttgtataagtcttatagtgaacaagttataccacccacttcagattatttaatctaaatctaaacattcgactcggaccgatg

SEQ ID NO: 12371 - DNA, 203 bp, Homo sapiens
ggcgcgccagtcctgcgggatcgaaaagagggatccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgcccgactcggaccgatg

SEQ ID NO: 12372 - DNA, 203 bp, Homo sapiens
ggcgcgccagtcctccgtccgcgaaaaggcttaggcagccagcctgtcgtaacgcgcaagtccgtggcggaaccgactactttgggtgtccgtgtttccttttattcttgaatggctgcttatggtgacaatcatagattgttatcataaagcgagttggattggccatccagtgtgaatcagattaacgactcggaccgatg

SEQ ID NO: 12373 - DNA, 203 bp, Homo sapiens
ggcgcgccagtcctgtcaccaggaaaatgaagatattcctgcatcgttacaaatagtgtaagaaacagtaagcccggaagtggtgttttgcgatttcgaggccgggctcgatcctcacctttcattgtcgataggggacattttgacactacctggaaaatgtcgtctgtgctcaaagcatttgagcgcgactcggaccgatg

SEQ ID NO: 12374 - DNA, 203 bp, Homo sapiens
ggcgcgccagtcctcgacggcagaaaatgaagatgggatgttggtagaacaaatagtgtaagaaacagtaagcccggaagtggtgttttgaccccatcttaagtggctcgatcctcacctttcattgtcgataggggacattttgacactacctggaaaatgtcgtctgtgctcaaagcatttgagcgcgactcggaccgatg

SEQ ID NO: 12375 - DNA, 203 bp, Homo sapiens
ggcgcgccagtcctttcattaagaaaatgaagatgggatgttggtagaacaaatagtgtaagaaacagtaagcccggaagtggtgttttgcgatttcgaggccgggctcgatcctcacctttcattgtcgataggggacattttgacactacctggaaaatgtcgtctgtgctcaaagcatttgagcgcgactcggaccgatg

SEQ ID NO: 12376 - DNA, 203 bp, Homo sapiens
ggcgcgccagtcctagtaaggtgaaaatgaagtggtgactcaaatcatcgaagaccctcgagattacataggtccggaacctatggccttcgtgaccgacctcgagtcagagtagttcaataaggacctatcaagtttgggcaatttttcgtccccgacaacgtcggtcgtcgtgtgcttaaagcatacgactcggaccgatg

SEQ ID NO: 12377 - DNA, 203 bp, Homo sapiens
ggcgcgccagtcctgtaagacagaaaccacggctaaccacaatcaagtcatactactagtcactatacaataatcaacaattttagtcaactgattaccaagatgttatcataggtccgaactgatcaatctaacaaaaaaactaaacgttccacaataaatcaacgttcaggccaaaatattcagcccgactcggaccgatg

SEQ ID NO: 12378 - DNA, 203 bp, Homo sapiens
ggcgcgccagtcctacacgaccgaaacgagattgtgaggtgcattggtctgcaaatcgagttgctaggcaataaacacatttggattaattttaatcgttcgttgagcgattagcagagaactgaccagaacatgtctggtcgtaaagctcagggaaaaaccctgggcgtcaatatggtacgacgaggcgactcggaccgatg

SEQ ID NO: 12379 - DNA, 203 bp, Homo sapiens
ggcgcgccagtccttgagtgatgaaagatggcggcgtctgtggtttgagccttcagtagcaggccagagtctgaacaagagctggggtggagggggcggggacctggggagcccggcgggtcgctatcgcggggggtactagtggcgccgccgccacagacaccaacgctgtcgccacctctgtagcccgactcggaccgatg

SEQ ID NO: 12380 - DNA, 203 bp, Homo sapiens
ggcgcgccagtcctaagaaattgaaaggaaccggaaacgggatggggagctggaccaggtgacagcggcatggacatatgccccaggctttcctgctggggtccatccatgagcctgccctgaaaacgtctcagccccagccctgccctggaagcttggctgagagcttcctggaggaggagcttcggcgactcggaccgatg

SEQ ID NO: 12381 - DNA, 203 bp, Homo sapiens
ggcgcgccagtccttcccgttcgaaaggaaccggaaacgggatggggagctggaccaggtgatcagcagcgcacattatgccccaggctttcctgctggggtccatccatgagcctgcaggtgccctcatggagccccagccctgccctggaagcttggctgagagcttcctggaggaggagcttcggcgactcggaccgatg

SEQ ID NO: 12382 - DNA, 203 bp, Homo sapiens
ggcgcgccagtcctcctaaagggaaaggaaccggaaacgggatggggattctccggccagaccagcggcatggacatatgccccaggctttcctgctggggtccatccatgagcctgcaggtgccctcatggagccccagccctgccctggaagcttggctgagagcttcctggaggaggagcttcggcgactcggaccgatg

SEQ ID NO: 12383 - DNA, 203 bp, Homo sapiens
ggcgcgccagtcctagcccagagaaaggaaccggccggctacatcatcgctggaccaggtgacagcggcatggacatatgccccaggctttcctgctggggtccatccatgagcctgcaggtgccctcatggagccccagccctgccctggaagcttggctgagagcttcctggaggaggagcttcggcgactcggaccgatg

SEQ ID NO: 12384 - DNA, 203 bp, Homo sapiens
ggcgcgccagtcctggagtagtgaaaggcccgccgggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagacgactcggaccgatg

SEQ ID NO: 12385 - DNA, 203 bp, Homo sapiens
ggcgcgccagtccttcgttatagaaatccgcatagccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaacgactcggaccgatg

SEQ ID NO: 12386 - DNA, 203 bp, Homo sapiens
ggcgcgccagtcctagtgctgcgaaatttcgtcaagtttgtaaactggttaggcaagtgttgtattttctgtgtctaagcactggtgattctgttcactagtgcatacattgatatttaagtggtgttccgtcactgcttattgtggaagcaacgttctgggacaaatactttaaataactgctaacccgactcggaccgatg

SEQ ID NO: 12387 - DNA, 203 bp, Homo sapiens
ggcgcgccagtcctcttccactgaaatttcgtcaagtttgtaaactggttaggcaagtgttgtattttctgtgtctaagcactggtgattctgttcactagtgcatacattgatatttaagtggtgttccgttgtaaacagaacacgaagcaacgttctgtcgttgtggaaaccaataactgctaacccgactcggaccgatg

SEQ ID NO: 12388 - DNA, 203 bp, Homo sapiens
ggcgcgccagtcctaggtattggaaatttcgtcaagtttgtaaactggttaggcaagtgttgtattttctgtgtctaagcactggtgattctgttcactagtgcatacattgatatttccccaaccactttgcactgcttattgtggaagcaacgttctgtcgttgtggaaaccaataactgctaacccgactcggaccgatg

SEQ ID NO: 12389 - DNA, 203 bp, Homo sapiens
ggcgcgccagtcctctctctcggaaatttcgtcattcagccgtgagtcttaggcaagtgttgtattttctgtgtctaagcactggtgattctgttcactagtgcatacattgatatttaagtggtgttccgtcactgcttattgtggaagcaacgttctgtcgttgtggaaaccaataactgctaacccgactcggaccgatg

SEQ ID NO: 12390 - DNA, 203 bp, Homo sapiens
ggcgcgccagtcctaatttcatgaacagaccaccgattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagcccgactcggaccgatg

SEQ ID NO: 12391 - DNA, 203 bp, Homo sapiens
ggcgcgccagtcctaagtgctcgaacatatgggcgtctgagtgtgttgtgggggcaatataacaaaaaaacatgttatggtgccattaaaccgctgcatttcatcaaagtcaagttaattacctttacattttgatcctcttggatgtgaaaaaaactattaacatccctcaaaagactcaaggaaagcgactcggaccgatg

SEQ ID NO: 12392 - DNA, 203 bp, Homo sapiens
ggcgcgccagtcctacaagaatgaaccacaagttgggtagcctggcagtgtcagaagtctgaacccagcatagtggtcagcaggcaggacgaatcacactgaatgcaaaccacagggtttcgcagcgtggtacgtagcgggtgcatgtcccccgccttcagaagagggtgcattttcaggaggaagcgcgactcggaccgatg

SEQ ID NO: 12393 - DNA, 203 bp, Homo sapiens
ggcgcgccagtcctcggcgtgagaacgtgtgctgtcgcgcgagacagcggaaggagcaagagtgggaggcgcgcgcggaggccgcgacggacgcaagatggcgacggcgaccatagctctcgtcaatggccagcaaggaggggggtccgagccggcggcggcggcggcagtggtggcagcgggagacacgactcggaccgatg

SEQ ID NO: 12394 - DNA, 203 bp, Homo sapiens
ggcgcgccagtcctggctcctggaagaagtcaaacgtggtgtagtctgagattctctgggatataagaggcagccgaagagttcacaagtgtgaagcctggaagccggcgggtgccgctgtgtaggaaagaagctaaagcacttccagagcctgtccggagctcagaggttcggaagacttatcgacccgactcggaccgatg

SEQ ID NO: 12395 - DNA, 203 bp, Homo sapiens
ggcgcgccagtccttggtacgcgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttatggttacaaatccagagtcaaatggctcgactcggaccgatg

SEQ ID NO: 12396 - DNA, 203 bp, Homo sapiens
ggcgcgccagtcctgttcaattgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaatttagaggtgcttacgactcggaccgatg

SEQ ID NO: 12397 - DNA, 203 bp, Homo sapiens
ggcgcgccagtcctgatgaatcgaagacaaacaacgtctgtagcgaccctttgcaggcagcggaaccccccacctggcgacaggtgcctctgcggccaaaagccacgtgtataagatagggtcatccgttgagcacaaccccagtgccacgttgtgagttggatagttgtggaaagagtcaaatggctcgactcggaccgatg

SEQ ID NO: 12398 - DNA, 203 bp, Homo sapiens
ggcgcgccagtcctcatcccacgaagacaaacaacgtctgtagcgacctacaatccaaccacgaaccccccacctggcgacaggtgcctctgcggccaaaagccacgtgtataagatacacctgcaaaggcggcacaaccccagtgccacgttgtgagttggatagttgtggaaagagtcaaatggctcgactcggaccgatg

SEQ ID NO: 12399 - DNA, 203 bp, Homo sapiens
ggcgcgccagtcctgaggttcggaagccgcaaccggtttaagctatcgtaccattatgaaaacaattcttggttcttccgacatgtctacaggaaaagttttcatttccgtaaggcttgtcaaaatttagattgtaattgtttggggttttatgaatcttcagttgaagaatattaaactcagtgaaacgactcggaccgatg

SEQ ID NO: 12400 - DNA, 203 bp, Homo sapiens
ggcgcgccagtcctgggctgatgaagcgccccagccccgcagcgatcgcagattcggctttcaaacaaaagaggcgaagtaatctacacaaccgggacctcacccggtcctcgcagagttgcggccgcccgccccttcagccccggctctccgtatgcgcatgagcagaggcgcctccctctgttcctcgactcggaccgatg

SEQ ID NO: 12401 - DNA, 203 bp, Homo sapiens
ggcgcgccagtcctagaccctggaagcgccccagccccgcagcgatcgcagattcggctttcaaacaaaagaggcgccccggggggtgggaccgggacctcacccggtcctcgcagaggacttagtcaagagcccttcagccccggctctccgtatgcgcatgagcagaggcgcctccctctgttcctcgactcggaccgatg

SEQ ID NO: 12402 - DNA, 203 bp, Homo sapiens
ggcgcgccagtcctcgtgacgagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatggcgggcccccaagcgactcggaccgatg

SEQ ID NO: 12403 - DNA, 203 bp, Homo sapiens
ggcgcgccagtcctgcgaacccgaagctggcaacatgtcacacctggaggagcgacacggctattaatactattatttggcagtaatccagattgcttttgccaccaacctgaagacatatagaggcagaaggacaggaataattctatttgtttcctgttttgaaacttccatctgtaagtattgttcgactcggaccgatg

SEQ ID NO: 12404 - DNA, 203 bp, Homo sapiens
ggcgcgccagtcctcgagcccggaagcttctgcgaaacgtggacagtcccgactttcctccggactcctgcacgacctgctcctacagccggcgatccactcccggctgttcccccggagggtccagaggcctttcagaaggagaaggcagctctgtttctctgcagaggagtagggtcctttcagcccgactcggaccgatg

SEQ ID NO: 12405 - DNA, 203 bp, Homo sapiens
ggcgcgccagtcctgcttgagggaagcttctgcgctggtgcttagtaaccgactttcctccggactcctgcacgacctgctcctacagccggcgatccactcccggctgttcccccggagggtccagaggcctttcagaaggagaaacggtggtgtcccttctgcagaggagtagggtcctttcagcccgactcggaccgatg

SEQ ID NO: 12406 - DNA, 203 bp, Homo sapiens
ggcgcgccagtccttccacgtggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagcccgactcggaccgatg

SEQ ID NO: 12407 - DNA, 203 bp, Homo sapiens
ggcgcgccagtcctgttcgcgagaagcttctgcgctggtgcttagtaaccgactttcctccggactcctgcacgacctgctcctacagccggcgatccactcccggctgttcccccggttatcgtctttaagtttcagaaggagaaggcagctctgtttctctgcagaggagtagggtcctttcagcccgactcggaccgatg

SEQ ID NO: 12408 - DNA, 203 bp, Homo sapiens
ggcgcgccagtcctgcctaagcgaagcttctgcgctggtgcttagtaaccgactttcctccggactcctgcacgactgctggggctctgtggcgatccactcccggctgttcccccggagggtccagaggcctttcagaaggagaaggcagctctgtttctctgcagaggagtagggtcctttcagcccgactcggaccgatg

SEQ ID NO: 12409 - DNA, 203 bp, Homo sapiens
ggcgcgccagtccttcaactgggaaggaggaggcacccacaggctgctgggaggagagcataaggaatctacttgaaaatggatcggtttatgttggattaaatgctgctctttgtggaggtcgtcacgtttgtctttttcgacgcatcttgaatgtgacaaaggctcgcatagctgctggcttaccacgactcggaccgatg

SEQ ID NO: 12410 - DNA, 203 bp, Homo sapiens
ggcgcgccagtcctaaccgtaagaaggaggaggcacccacaggctgctgggaggagagcataaggaatctacttgaaaatggatcggtttatgttggattaaatgctgctctttgtggcctcatagcaaacagtctttttcgacgcatcttgaatgtgaccccaagaatacgtactgctggcttaccacgactcggaccgatg

SEQ ID NO: 12411 - DNA, 203 bp, Homo sapiens
ggcgcgccagtcctacgaagaagaaggaggaggccatgcgccaaatgagggaggagagcataaggaatctacttgaaaatggatcggtttatgttggattaaatgctgctctttgtggcctcatagcaaacagtctttttcgacgcatcttgaatgtgacaaaggctcgcatagctgctggcttaccacgactcggaccgatg

SEQ ID NO: 12412 - DNA, 203 bp, Homo sapiens
ggcgcgccagtcctggcccgctgaatactgtaccttgatcttagggccaatcggtgctgccgaggtaactctctggtcctaggtggaggtgtaggggaggttgggccagggatgccttcactgtgtctctctggtcttgccaccccagaccgagggacacacaggcactgctgtctgcaacacaagcacgactcggaccgatg

SEQ ID NO: 12413 - DNA, 203 bp, Homo sapiens
ggcgcgccagtcctggtagattgaatactgtaccttgatcttagggcctggaaaaatcaggtaggtaactctctggtcctaggtggaggtgtaggggaggttgggccagggatgccttcactgtgtctctctggtcttgccaccccagaccgagggacacacaggcactgctgttccggcgtgcgtaccgactcggaccgatg

SEQ ID NO: 12414 - DNA, 203 bp, Homo sapiens
ggcgcgccagtccttccaaggcgaatactgtaccttgatcttagggcctggaaaaatcaggtaggtaactctctggtcctaggtggaggtgtaggggaggttgggccagggatgccttcactgtgtctctctggtcttgccaccccgccttatctctgggacaggcactgctgtctgcaacacaagcacgactcggaccgatg

SEQ ID NO: 12415 - DNA, 203 bp, Homo sapiens
ggcgcgccagtcctcgtggaaggaatggctgcttatggtgacaatcatagattgttatcataaagcgagttggattggccatccagtgtgaatcagattaattactcccttgtttgttggatccactcccgaaacgttttactcctatcgggcagctccctgtttgaagacaggatttcagtgtcacacgactcggaccgatg

SEQ ID NO: 12416 - DNA, 203 bp, Homo sapiens
ggcgcgccagtcctctcagctggaatggctgcttatggtgacaatcatagattgttatcataaagcgagttggattggccatccagtgtgaatcagattaattactcccttgtttgttggatccactcccgaaacgttttactccttaacttattgaaattgtttgaagacaggcgcggctgtgagatcgactcggaccgatg

SEQ ID NO: 12417 - DNA, 203 bp, Homo sapiens
ggcgcgccagtcctttcacatagaatggctgcttatggtgacaatcatagattgttatcataaagcgagttggattggccatccagtgtgccgggcgggccagcctcccttgtttgttggatccactcccgaaacgttttactccttaacttattgaaattgtttgaagacaggatttcagtgtcacacgactcggaccgatg

SEQ ID NO: 12418 - DNA, 203 bp, Homo sapiens
ggcgcgccagtcctattcgtaggaatggctgcttatggtgacaatcatagattgttatcataaagcgagttggattggccatccagtgtgcgattctgagcgccctcccttgtttgttggatccactcccgaaacgttttactccttaacttattgaaattgtttgaagacaggatttcagtgtcacacgactcggaccgatg

SEQ ID NO: 12419 - DNA, 203 bp, Homo sapiens
ggcgcgccagtcctgtagcaaagaatggctgcttatggtgacaatcatagattgttatcataaagcgagttggatttagggcttttctgaaatcagattaattactcccttgtttgttggatccactcccgaaacgttttactccttaacttattgaaattgtttgaagacaggatttcagtgtcacacgactcggaccgatg

SEQ ID NO: 12420 - DNA, 203 bp, Homo sapiens
ggcgcgccagtcctccgcaggtgaatttctgattgaggcgctaacagctaattccacaggagttgtaaggcagcctgtgcataaactgagacagaagtttctcctcagagactctctttttattattattattattattattggcacttggcagactgattcctcagaggaataccttgttgcttaagcgactcggaccgatg

SEQ ID NO: 12421 - DNA, 203 bp, Homo sapiens
ggcgcgccagtcctatttatgtgacaccaccagcatacacgaaaccaaccttcacagtggatacctcagcatccaaaactctccttcccgaatggatcaggatgccttcttttttgagagggatcctgaagccgaaggagaggcaccacgaaaacaagaaggttaactgttatgcatcggactccttgcgactcggaccgatg

SEQ ID NO: 12422 - DNA, 203 bp, Homo sapiens
ggcgcgccagtccttggttcaagacaccaccagcatacacgaaaccaaccttcacagtggatacctcagcatccaaaactctccttcccgaatggatcaggatgccttcttttttgagagggatcctgaagccgaaggagaggcaccacgaaaacaagaatcactctcagatgtatctttcagaagctcgactcggaccgatg

SEQ ID NO: 12423 - DNA, 203 bp, Homo sapiens
ggcgcgccagtcctcataacgcgacaccaccagcatacacgaaaccaaccttcacagtggatacctcagcatccaaaactctccttcccgaatggatcaggatgttgcggcgggatgaagggatcctgaagccgaaggagaggcaccacgaaaacaagaatcactctcagatgtcatcggactccttgcgactcggaccgatg

SEQ ID NO: 12424 - DNA, 203 bp, Homo sapiens
ggcgcgccagtcctaccttacggacaccaccagcatacacgaaaccaaccttcacagtggatacctcagcatccaaaactctccttcccggcacttaggtatgcccttcttttttgagagggatcctgaagccgaaggagaggcaccacgaaaacaagaatcactctcagatgtcatcggactccttgcgactcggaccgatg

SEQ ID NO: 12425 - DNA, 203 bp, Homo sapiens
ggcgcgccagtcctgcgaggaggacaccaccagcatacacgaaaccaaccttcacagtggatacctcagcatccaatcgaagagcgggtcaatggatcaggatgccttcttttttgagagggatcctgaagccgaaggagaggcaccacgaaaacaagaatcactctcagatgtcatcggactccttgcgactcggaccgatg

SEQ ID NO: 12426 - DNA, 203 bp, Homo sapiens
ggcgcgccagtcctgtcgcagcgacaccaccagcatacacgaaaccaaccttcacagtggatcaaatcctcatggcaactctccttcccgaatggatcaggatgccttcttttttgagagggatcctgaagccgaaggagaggcaccacgaaaacaagaatcactctcagatgtcatcggactccttgcgactcggaccgatg

SEQ ID NO: 12427 - DNA, 203 bp, Homo sapiens
ggcgcgccagtcctgcacaggagacaccaccagcatacacgaaaccaatgacatgttgtttcacctcagcatccaaaactctccttcccgaatggatcaggatgccttcttttttgagagggatcctgaagccgaaggagaggcaccacgaaaacaagaatcactctcagatgtcatcggactccttgcgactcggaccgatg

SEQ ID NO: 12428 - DNA, 203 bp, Homo sapiens
ggcgcgccagtcctctacgattgacaccaccagcggctgttcctgtccccttcacagtggatacctcagcatccaaaactctccttcccgaatggatcaggatgccttcttttttgagagggatcctgaagccgaaggagaggcaccacgaaaacaagaatcactctcagatgtcatcggactccttgcgactcggaccgatg

SEQ ID NO: 12429 - DNA, 203 bp, Homo sapiens
ggcgcgccagtcctgggtccgagacactgtcccatgggtgaagagttctgcagccttacagagactggaaaagaagcccaaaccaaggcccccagagaggtcccccaggcccctttgggtccctgagcctcagctggagatccggcgcaggagaccaacgcctgccatgctgttccggctctcagagccgactcggaccgatg

SEQ ID NO: 12430 - DNA, 203 bp, Homo sapiens
ggcgcgccagtcctgtccgtcggacataatggattccaacacgataacctcgtttcaggtagattgttatctatggcacataagaaagctactcagtatgagagacatgtgtgatgccaggagatcaactcagctccgaagagaccaaaaggcattaaagggaagaggcagcacacttggactcgattcgactcggaccgatg

SEQ ID NO: 12431 - DNA, 203 bp, Homo sapiens
ggcgcgccagtcctttactgtcgacataatggattccaacacgataacctcgtttcaggtagattgttatctatggcacataagaaagctactcagtatgagagacatgtgtgatgccccctttgatgacaggctccgaagagaccaaaaggcattaaagattcagttagctcaacttggactcgattcgactcggaccgatg

SEQ ID NO: 12432 - DNA, 203 bp, Homo sapiens
ggcgcgccagtcctggttgaccgacatggtgcgaagagtctattgagctagttggtagtcctccggcccctgaatgcggctaatcctaacatgcataggatatgcctcaagccagagggcagtgtgtcgtaacgggcaactctgcagcggaaccgactactttgggtgtccgtgtttcattttattcccgactcggaccgatg

SEQ ID NO: 12433 - DNA, 203 bp, Homo sapiens
ggcgcgccagtccttctagttggacatggtgcgaagagtctattgagctagttggtagtcctccggcccctgaatgcggctaatcctaactgcggagcacacaccctcaagccagagggcagtgtgtcgtaacgggcaactctgcaatcctgagcgtctgtttgggtgtccgtgtttcattttattcccgactcggaccgatg

SEQ ID NO: 12434 - DNA, 203 bp, Homo sapiens
ggcgcgccagtcctggaaagtggacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcccgactcggaccgatg

SEQ ID NO: 12435 - DNA, 203 bp, Homo sapiens
ggcgcgccagtcctcaatcattgacatggtgcgaagagtctattgagctagttggtagtcctggattgaagatcgtcggctaatcctaactgcggagcacacaccctcaagccagagggcagtgtgtcgtaacgggcaactctgcagcggaaccgactactttgggtgtccgtgtttcattttattcccgactcggaccgatg

SEQ ID NO: 12436 - DNA, 203 bp, Homo sapiens
ggcgcgccagtcctccacaccagacatggtgcgatcctctgtaacttgtagttggtagtcctccggcccctgaatgcggctaatcctaactgcggagcacacaccctcaagccagagggcagtgtgtcgtaacgggcaactctgcagcggaaccgactactttgggtgtccgtgtttcattttattcccgactcggaccgatg

SEQ ID NO: 12437 - DNA, 203 bp, Homo sapiens
ggcgcgccagtcctgggcgatagaccacgctggggtttgccatggtgacataaaggggtgtagaggaaggaaggagcaagaccagcctgtagactgtgcccctgaaaacttgggcaaaccaggggcccggagccttccctccactgccctcgaacgcctcacttcctaagtctctgcatttctcagtccgactcggaccgatg

SEQ ID NO: 12438 - DNA, 203 bp, Homo sapiens
ggcgcgccagtcctctttattggaccacgctggggtttgccatggtgacataaaggggtgtagaggaaggaaggagcaagaccagcctgtagactgtgcccctggctgggcaaaagggaacactattgtcgcccttccctccactgccctcgaacgcctcacttcctaagtctctgcatttctcagtccgactcggaccgatg

SEQ ID NO: 12439 - DNA, 203 bp, Homo sapiens
ggcgcgccagtcctgggaagctgaccacgctggggtttgccatggtgacataaaggggtgtagaggaaggaaggagcaagaccagcctgtagactgtgcccctggctgggcaaaagggccaggggcccggagaacaggtaatctccccctcgaacgcctcacttcctaagtctctgcatttctcagtccgactcggaccgatg

SEQ ID NO: 12440 - DNA, 203 bp, Homo sapiens
ggcgcgccagtcctgatcttatgaccacgctggggtttgccatggtgacataaaggggtgtagaggaaggaaggagcaagaccagcctgtagactgtgcccctggctgggcaaaagggccaggggcccggagccttccctccactgccctcgaacgcctcacttcctaagtctctgcatttctcagtccgactcggaccgatg

SEQ ID NO: 12441 - DNA, 203 bp, Homo sapiens
ggcgcgccagtcctgactaatagaccacgctggggtttgccatggtgacataaaggggtgtagaggaaggaaggagcaagaccagcctgtccgtgtaaagatctgctgggcaaaagggccaggggcccggagccttccctccactgccctcgaacgcctcacttcctaagtctctgcatttctcagtccgactcggaccgatg

SEQ ID NO: 12442 - DNA, 203 bp, Homo sapiens
ggcgcgccagtccttttcgtccgaccacgctggggtttgccatggtgacataaaggggtgtagaggaaggaaggagtcgatggcaaagacagactgtgcccctggctgggcaaaagggccaggggcccggagccttccctccactgccctcgaacgcctcacttcctaagtctctgcatttctcagtccgactcggaccgatg

SEQ ID NO: 12443 - DNA, 203 bp, Homo sapiens
ggcgcgccagtcctatcctaaggaccacgctggggtttgccatggtgatggtctcccagcctgaggaaggaaggagcaagaccagcctgtagactgtgcccctggctgggcaaaagggccaggggcccggagccttccctccactgccctcgaacgcctcacttcctaagtctctgcatttctcagtccgactcggaccgatg

SEQ ID NO: 12444 - DNA, 203 bp, Homo sapiens
ggcgcgccagtccttgtgtggggaccggtcactaccaaggacgcagacctctttttgagtatcacgcctccggaagtagttgggcaagcccacctatatgtgttccatgatgcacttctagccatccataccgtactgcctgatagggtccttgcgaggggatctgggagtctcgtagaccgtagcaccgactcggaccgatg

SEQ ID NO: 12445 - DNA, 203 bp, Homo sapiens
ggcgcgccagtcctagttggtagaccggtcactaccaaggacgcagacctctttttgagtatcacgcctccggaagtagttgggcaagcccacctatatgtgttgggatggttggggtcgcaaccagtaggtgtactgcctgatagggtccttgcgaggggatctgggagtctcgtagaccgtagcaccgactcggaccgatg

SEQ ID NO: 12446 - DNA, 203 bp, Homo sapiens
ggcgcgccagtcctagaggagagaccggtcactaccaaggacgcagacctctttttgagtatcacgcctccggaagtagttgggcaagcccacctatatgtgttgggatggttggggttagccatccatacccgtgccaggctcgcggtccttgcgaggggatctgggagtctcgtagaccgtagcaccgactcggaccgatg

SEQ ID NO: 12447 - DNA, 203 bp, Homo sapiens
ggcgcgccagtcctgtgtcgtcgaccggtcactaccaaggacgcagacctctttttgagtatcacgcctccggaagtagttgggcaagcccacctatatgtgttgggatggttggggttagccatccataccgtactgcctgatagatatgcctattattgatctgggagtctcgtagaccgtagcaccgactcggaccgatg

SEQ ID NO: 12448 - DNA, 203 bp, Homo sapiens
ggcgcgccagtcctgacctgaagaccggtcactaccaaggacgcagacctctttttgagtatggatatcatatttatagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12449 - DNA, 203 bp, Homo sapiens
ggcgcgccagtcctagcacttggaccggtcactaccaaggacgcagactgggaggcctactgcacgcctccggaagtagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12450 - DNA, 203 bp, Homo sapiens
ggcgcgccagtcctgcgcaagggaccggtcactatatgccggatgcggctctttttgagtatcacgcctccggaagtagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12451 - DNA, 203 bp, Homo sapiens
ggcgcgccagtcctcaacgaaggaccggtcactatgtcatctatgtcactctttttgagtatcacgcctccggaagtagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12452 - DNA, 203 bp, Homo sapiens
ggcgcgccagtccttaggatcagaccggtcggaacgagctgattgcccgctacatcaagctcaaatgcactggactccgcaccaggaagcaggtctccagccacatccaggtgctggctcgtcgcaaagctcgcgagatccaggccaagctaaaggaccaggcagctaaggacaaggccctgcagagccgactcggaccgatg

SEQ ID NO: 12453 - DNA, 203 bp, Homo sapiens
ggcgcgccagtcctattacggagaccggtcggaacgagctgattgcccgctacatcaagctccggacagggaagacccgcaccaggaagcaggtctccagccacatccaggtgctggcctccacgtgtcgatgcgagatccaggccaagctaaaggaccaggcagctaaggacaaggccctgcagagccgactcggaccgatg

SEQ ID NO: 12454 - DNA, 203 bp, Homo sapiens
ggcgcgccagtcctgtttgtctgaccggtcggaacgagctgattgcccgctacatcaagctccggacagggaagacccgcaccaggaagcgcaagatacaaacgatccaggtgctggctcgtcgcaaagctcgcgagatccaggccaagctaaaggaccaggcagctaaggacaaggccctgcagagccgactcggaccgatg

SEQ ID NO: 12455 - DNA, 203 bp, Homo sapiens
ggcgcgccagtcctcctcaaacgacctgagtaaatttaattgcaaacagtggcttgagcgatttgtgcaattaaaggatagtgatattaatgaaatggtgcttagtcttgttaggagtggtaagttgcttgtaaggggtaatggcaagtgtttgagttttagtaatcatttagtctcaactaaataaacgactcggaccgatg

SEQ ID NO: 12456 - DNA, 203 bp, Homo sapiens
ggcgcgccagtcctttatttatgacgcgaggctctgcggagaccaggagtcagactgtaggaaagttaaaaccatgacgtgtccccggtactcgccggccggagcccccggcttcccggggccgggggaccttagcggcacccacacacagcctactttccaagcggagccatgtctggtaacggcaacgactcggaccgatg

SEQ ID NO: 12457 - DNA, 203 bp, Homo sapiens
ggcgcgccagtcctgtagaactgacgcgaggctctgcggagaccaggagtcagactgtaggacgacctcgggtcccacgtgtccccggtactcgccggccggagaggaacctgggagagggccgggggaccttagcggcacccacacacagcctactttccaagcggagccatgtctggtaacggcaacgactcggaccgatg

SEQ ID NO: 12458 - DNA, 203 bp, Homo sapiens
ggcgcgccagtcctctaatgatgacgcgaggctctgcggagaccaggagtcagactgtaggacgacctcgggtcccacgtgtccccggtactcgccggccggagcccccggcttcccgactatcatctggtatagcggcacccacacacagcctactttccaagcggagccatgtctggtaacggcaacgactcggaccgatg

SEQ ID NO: 12459 - DNA, 203 bp, Homo sapiens
ggcgcgccagtcctacgcgcctgacgggacccgacggtgactgcgcaagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggcgactcggaccgatg

SEQ ID NO: 12460 - DNA, 203 bp, Homo sapiens
ggcgcgccagtcctgaacctgggacgttagcgacaataaaattctgtacataaaagtcgaaagtattgctatagttaaggttgcgcttgcctatttaggcatacttctcaggatggcgcgttgcagtccaacaagatccagggactgtacagaattttcctatacctcgagtcgggtttggaatctaacgactcggaccgatg

SEQ ID NO: 12461 - DNA, 203 bp, Homo sapiens
ggcgcgccagtccttgaaaccagactccggctcggcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaacgactcggaccgatg

SEQ ID NO: 12462 - DNA, 203 bp, Homo sapiens
ggcgcgccagtcctgcagcctggactcctatcgcggacccccaccgctgcccttcccggggaggcgggaaatgcatggggccacccagctccgcggcggcctacagccggggtagcccaagaaccttcgggtgagggcgggtggcattttcttttcctataccgatcatggcagtccttctgctcctacgactcggaccgatg

SEQ ID NO: 12463 - DNA, 203 bp, Homo sapiens
ggcgcgccagtccttgttatgggactgattcatcactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtccgactcggaccgatg

SEQ ID NO: 12464 - DNA, 203 bp, Homo sapiens
ggcgcgccagtcctgcccgtgagacttattaggcggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacacccgactcggaccgatg

SEQ ID NO: 12465 - DNA, 203 bp, Homo sapiens
ggcgcgccagtccttcctggctgacttgtcagcaccgtcaggtgacactatcctaaaggcagaagccttcaggtctgacccagccaatcaaagcattataccagaccatggaatgcataccaaacattattgacactaatgacacacaaaattggttttaagaaaaaccaagagaacaataggccagacgactcggaccgatg

SEQ ID NO: 12466 - DNA, 203 bp, Homo sapiens
ggcgcgccagtccttgccgaccgactttgaaatccaacccggtcacctacccgcgcgactgtcaaacgttggacgccgaaagccaagcgagtccccctgccgagctactcgcgtccgcctcctcccaagctgagctctgctccgcccacctgagtccttcgccagttaggaggaaacacagccgcttacgactcggaccgatg

SEQ ID NO: 12467 - DNA, 203 bp, Homo sapiens
ggcgcgccagtccttttagacggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttacgactcggaccgatg

SEQ ID NO: 12468 - DNA, 203 bp, Homo sapiens
ggcgcgccagtcctaaacatacgactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggatcgtagaaataacgcgactcggaccgatg

SEQ ID NO: 12469 - DNA, 203 bp, Homo sapiens
ggcgcgccagtccttttatcatgactttgaaatccaacccggtcacctacccgcgcgactgtgtccacggatggcacgaaagccaagcgagtccccctgccgagctactcgcgtccgcctcctcccaagctggagaagtagatttgcacctgagtccttcgccagttaggaggaaacacagccgcttacgactcggaccgatg

SEQ ID NO: 12470 - DNA, 203 bp, Homo sapiens
ggcgcgccagtcctgacaaaccgactttgaaatccaacccggtcacctacccgcgcgactgtgtccacggatggcacgaaagccaagcgagtccccctgccgagctactcgcgtccgctgaggtggccatccagctctgctccgcccacctgagtccttcgccagttaggaggaaacacagccgcttacgactcggaccgatg

SEQ ID NO: 12471 - DNA, 203 bp, Homo sapiens
ggcgcgccagtcctgcaaggttgacttttacatgcgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgtcgactcggaccgatg

SEQ ID NO: 12472 - DNA, 203 bp, Homo sapiens
ggcgcgccagtccttctaacgagagaaactccgtaggagtcatagcttaagcagatgaattagaaagaatcaggttacggcccggcggaaagaaaaagtacaggctaaaacatattgtgtgggcagcgaataaattggacagattcggattagcagagagcctgttggagtcaaaagagggttgtcaacgactcggaccgatg

SEQ ID NO: 12473 - DNA, 203 bp, Homo sapiens
ggcgcgccagtcctgtttccaagagaaactccgtcttgagagggaaaaaagcagatgaattagaaagaatcaggttacggcccggcggaaagaaaaagtacagggccgcgttcgagtggtgggcagcgaataaattggacagattcggattagcagagagcctgttggagtcaaaagagggttgtcaacgactcggaccgatg

SEQ ID NO: 12474 - DNA, 203 bp, Homo sapiens
ggcgcgccagtccttactaccagagaaactccgtcttgagagggaaaactttcatcacgcacgaaagaatcaggttacggcccggcggaaagaaaaagtacaggctaaaacatattgtgtgggcagcgaataaattggacagattcggattagcagagagcctgttggagtcaaaagagggttgtcaacgactcggaccgatg

SEQ ID NO: 12475 - DNA, 203 bp, Homo sapiens
ggcgcgccagtcctccatgtttgagaatcagatgcgcataagtagatgcgaattgcaaaaagattacgtaggtccggaaccactagattcggtgccggtaacgattccagttttatactatctgatcattctctatctctattaaggatatttctagtctaaagttcaaaatgtcaagtgttttaaagcgactcggaccgatg

SEQ ID NO: 12476 - DNA, 203 bp, Homo sapiens
ggcgcgccagtcctaagtctgagagaatcagatggcatcgttatatgacgaattgcaaaaagattacgtaggtccgagctattctcgcatggtgccggtaacgattccagttttatactatctgatcattctctatctctattaaggatatttctagtctaaagttcaaaatgtcaagtgttttaaagcgactcggaccgatg

SEQ ID NO: 12477 - DNA, 203 bp, Homo sapiens
ggcgcgccagtcctgaccactcgagaatcagatggcatcgttatatgatctgccttgccgctattacgtaggtccggaaccactagattcggtgccggtaacgattccagttttatactatctgatcattctctatctctattaaggatatttctagtctaaagttcaaaatgtcaagtgttttaaagcgactcggaccgatg

SEQ ID NO: 12478 - DNA, 203 bp, Homo sapiens
ggcgcgccagtcctgtcattctgagacccctttgtcatatcaatacaatatcaagtagtgtcgatgatctcattaggtactaatcctaacattgtgattcatcctgcattgagaaaagatttagaaaaaaactaaattaagaatgaatatcctggggtcgtaacgtctcgtgaccctgccgttgcactcgactcggaccgatg

SEQ ID NO: 12479 - DNA, 203 bp, Homo sapiens
ggcgcgccagtcctctctgatcgagacctggaatttccggtctggttggtctggggccccgcggagccaggttgataccctcacctcccaaccccaggccctcggatgcccagaacctcgttcgtaagttccggacttgttcttaatcgagggggtgctggggggaccctgatgtggcaccaaatgaacgactcggaccgatg

SEQ ID NO: 12480 - DNA, 203 bp, Homo sapiens
ggcgcgccagtccttcttcacggagacctggaatttccggtctggttggtctggggccccgcggagccaggttgataccctcacctcccaaccccaggccctcggatgcccagaacctgtaggccgcaccgtggacttgttcttaactagacctcacgacgggggaccctgatgtggcaccaaatgaacgactcggaccgatg

SEQ ID NO: 12481 - DNA, 203 bp, Homo sapiens
ggcgcgccagtccttgcaggacgagacctggaatttccggtctggttggtctggggccccgcggagccaggttgataccctcacctcccaaccccaggccctcggatgcccagaacctgtaggccgcaccgtggacttgttcttaatcgagggggtgctgcactacgtagcgcatggcaccaaatgaacgactcggaccgatg

SEQ ID NO: 12482 - DNA, 203 bp, Homo sapiens
ggcgcgccagtcctatccttccgagacctggaatttccggtctggttggtctggggccccgcggagccaggttgataccctcacctcccaaccccaggccctcggatgcccagaacctgtaggccgcaccgtggacttgttcttaatcgagggggtgctggggggaccctgatgtggcaccaaatgaacgactcggaccgatg

SEQ ID NO: 12483 - DNA, 203 bp, Homo sapiens
ggcgcgccagtcctggatgggagagacctggaatttccggtctggttggtctggggccccgcggagccaggttgataccctcacctcccattgttttaaatctagatgcccagaacctgtaggccgcaccgtggacttgttcttaatcgagggggtgctggggggaccctgatgtggcaccaaatgaacgactcggaccgatg

SEQ ID NO: 12484 - DNA, 203 bp, Homo sapiens
ggcgcgccagtcctaccaactggagagccaggagactctgatgatgaattctgaccagaaggcagtgaaattcctggcaaatttttacatcaatggaggcaaacactggacccatggtcacctgaggcagacacaaccagagcccacccagcccaaggcaaggcccagtcgtcggggcccggagccggcgactcggaccgatg

SEQ ID NO: 12485 - DNA, 203 bp, Homo sapiens
ggcgcgccagtcctacgctttcgagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggcgactcggaccgatg

SEQ ID NO: 12486 - DNA, 203 bp, Homo sapiens
ggcgcgccagtcctacaagcgcgagatacactacaggcagtgagcgagcaggcggcaggcagggtccgtgcggagcaggcgagcgagcgggaagacgcagccaccttcctcaccagccagcccacagcggtttgttccccttctcgggagtgcgccaatgcctgggccgacccaaaccctgtccccaacgactcggaccgatg

SEQ ID NO: 12487 - DNA, 203 bp, Homo sapiens
ggcgcgccagtcctttaccacagagcagattcccacaactcccttggtacaataaaaaagacgagtatttacttttcattgaaagaatggagcttgcttgatatttcactagataaagaatttaaggcgagtatctatctttgttctccttggcaactgagagtctgcccttggaaacatcaggcacccgactcggaccgatg

SEQ ID NO: 12488 - DNA, 203 bp, Homo sapiens
ggcgcgccagtccttagccgccgagcccgttacccacctgggcaaacgacgcccacgtacggtccacgtcgcccttcaatgtctctcttgaccaataggcgtagccggcgagttgacaaggaccagtgggggaactcttaaaatgaagggactccaagtcccgcccttcccggtgggccgggaaatgccgactcggaccgatg

SEQ ID NO: 12489 - DNA, 203 bp, Homo sapiens
ggcgcgccagtcctcctggacagagcccgttacccacctgggcaaacgacgcccacgtacggtccacgtcgcccttcaatgtctctcttgaccaataggcgtagccggcgagttgacaaggaccagtgggggccgggggcttggagagggactccaagtctttatgggatgacggggccgggaaatgccgactcggaccgatg

SEQ ID NO: 12490 - DNA, 203 bp, Homo sapiens
ggcgcgccagtcctaactgattgagcccgttacccacctgggcaaacgacgcccacgtacggtccacgtcgcccttcaatgtctctcttgaccaataggcgtagccggcgagttgacaccctgaccgaaaccccgggggcttggagagggactccaagtcccgcccttcccggtgggccgggaaatgccgactcggaccgatg

SEQ ID NO: 12491 - DNA, 203 bp, Homo sapiens
ggcgcgccagtcctcaggtacagagcccgttacccacctgggcaaacgctttaggttatgcatccacgtcgcccttcaatgtctctcttgaccaataggcgtagccggcgagttgacaaggaccagtgggggccgggggcttggagagggactccaagtcccgcccttcccggtgggccgggaaatgccgactcggaccgatg

SEQ ID NO: 12492 - DNA, 203 bp, Homo sapiens
ggcgcgccagtcctccattagcgagcccgttaccgtagctcttgtctcacgcccacgtacggtccacgtcgcccttcaatgtctctcttgaccaataggcgtagccggcgagttgacaaggaccagtgggggccgggggcttggagagggactccaagtcccgcccttcccggtgggccgggaaatgccgactcggaccgatg

SEQ ID NO: 12493 - DNA, 203 bp, Homo sapiens
ggcgcgccagtcctggcacacggagccctgcacccctaattcccggtggaaaactcctgttgatccgcatggtgtacggcctggagtctcccagtcttgtcccggcagtgccgccctccccactaagacctaggcgcaaaggcttggctcatggttgacagctcagagagagaaagatctgagggaagcgactcggaccgatg

SEQ ID NO: 12494 - DNA, 203 bp, Homo sapiens
ggcgcgccagtcctaacgcggcgagccctgcacccctaattcccggtggaaaactcctgttgccgtttccctccaccggcctggagtctcagcacaagacaagtgcagtgccgccctccccactaagacctaggcgcaaaggcttggctcatggttgacagctcagagagagaaagatctgagggaagcgactcggaccgatg

SEQ ID NO: 12495 - DNA, 203 bp, Homo sapiens
ggcgcgccagtcctgatccagagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaacctgggtcattgttcgactcggaccgatg

SEQ ID NO: 12496 - DNA, 203 bp, Homo sapiens
ggcgcgccagtccttacataacgagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccagatcctcttgattggcgactcggaccgatg

SEQ ID NO: 12497 - DNA, 203 bp, Homo sapiens
ggcgcgccagtccttcagtgccgagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 12498 - DNA, 203 bp, Homo sapiens
ggcgcgccagtcctcccaggccgagcctccagagggctgtcggcgcagtagcagcgagcagcagagtccgcacgctccggcgaggggcagaagagcgcgagggagcgcggggcagcaggctgtgatattccacgcggacccagccaggacccacagccctccccagctgcccaggaagagccccagcccgactcggaccgatg

SEQ ID NO: 12499 - DNA, 203 bp, Homo sapiens
ggcgcgccagtccttgggcaacgagcctccagagggctgtcggcgcagtagcagcgagcagcagagtccgcacgctccggcgaggggcaggttgttctctttcggcgcggggcagcagaagcgagagccgagcgcggacccagccaggacccacagccctccccagctgcccaggaagagccccagcccgactcggaccgatg

SEQ ID NO: 12500 - DNA, 203 bp, Homo sapiens
ggcgcgccagtccttggtgtccgagcctccagagggctgtcggcgcagtagcagcgagcagcttccagtcgtgtagccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 12501 - DNA, 203 bp, Homo sapiens
ggcgcgccagtcctgcgctggggagcctggcgtggtagggctgtgctgcgcggtccttcccattcaccctagtctggcgctcgccggcgtgggcgggccggaccttcgccgcttccagagctacatcgttaagccgtcggaccacggcgcggcggccagttcctttatagttttgttcagaaaaacatcgactcggaccgatg

SEQ ID NO: 12502 - DNA, 203 bp, Homo sapiens
ggcgcgccagtcctcatatcttgagcctggcgtggtagggctgtgctgcgcggtccttcccattcaccctagtctggcgctcgccggcgtgggcgggccggaccttcgccgcttccaggaagggccacaacgcaacgacacaacgcgcgcggcggccagttcctttatagttttgttcagaaaaacatcgactcggaccgatg

SEQ ID NO: 12503 - DNA, 203 bp, Homo sapiens
ggcgcgccagtcctatgttccagagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttacaattggccgacgcgactcggaccgatg

SEQ ID NO: 12504 - DNA, 203 bp, Homo sapiens
ggcgcgccagtcctatggtagtgagcggttagagccaacaccactccctgcgagtggccggagaccagggcccaacataaacaagctttggagacaaacaaccttatgacctgtcagccctgacaaaggtcagctagccccttgaggacatcagctttggcctcagggtcctaatggcagcagaaccacgactcggaccgatg

SEQ ID NO: 12505 - DNA, 203 bp, Homo sapiens
ggcgcgccagtcctcccaccgagagcggttagagtgtgtgtgggcggatgcgagtggccggagaccagggcccaacataaacaagctttgctcctcgcagtgagtatgacctgtcagccctgacaaaggtcagctagccccttgaggacatcagctttggcctcagggtcctaatggcagcagaaccacgactcggaccgatg

SEQ ID NO: 12506 - DNA, 203 bp, Homo sapiens
ggcgcgccagtcctctcttctagagcggttagagtgtgtgtgggcggatgcgagtggccggagaccagggcccaacataaacaagctttggagacaaacaacctccgttttcagttttcctgacaaaggtcagctagccccttgaggacatcagctttggcctcagggtcctaatggcagcagaaccacgactcggaccgatg

SEQ ID NO: 12507 - DNA, 203 bp, Homo sapiens
ggcgcgccagtcctaatattctgagcggttagagtgtgtgtgggcggatgcgagtggccggagaccagggcccaacgagggtggttggacgagacaaacaaccttatgacctgtcagccctgacaaaggtcagctagccccttgaggacatcagctttggcctcagggtcctaatggcagcagaaccacgactcggaccgatg

SEQ ID NO: 12508 - DNA, 203 bp, Homo sapiens
ggcgcgccagtcctgagcattggagcggttagagtgtgtgtgggcggatgcgagtggccggattaacttcaaagctataaacaagctttggagacaaacaaccttatgacctgtcagccctgacaaaggtcagctagccccttgaggacatcagctttggcctcagggtcctaatggcagcagaaccacgactcggaccgatg

SEQ ID NO: 12509 - DNA, 203 bp, Homo sapiens
ggcgcgccagtcctggcacggagaggactcgggacagggaattggccctgggagaaaacgcgatccaacgccgatggacgccccgtgaaagccgtgccgacccttgggaggactgacaggtctagagacacgcgctgtctgttgtggtgggcctcccgggaataagtgaggggctctgtgtttcgaggcgactcggaccgatg

SEQ ID NO: 12510 - DNA, 203 bp, Homo sapiens
ggcgcgccagtcctacgtcgctgaggactcgggacagggaattggccctgggagaaaacgcgcggggggcgtccgagacgccccgtgaaagccgtgccgaccctataccacctaacttggtctagagacacgcgctgtctgttgtggtgggcctcccgggaataagtgaggggctctgtgtttcgaggcgactcggaccgatg

SEQ ID NO: 12511 - DNA, 203 bp, Homo sapiens
ggcgcgccagtccttgtaagaggaggactcgggacagggaattggccctgggagaaaacgcgcggggggcgtccgagacgccccgtgaaagccgtgccgacccttgggaggactgacaggtctagagacacgcgctgtctgttgtgcccccttatgatccaataagtgaggggctctgtgtttcgaggcgactcggaccgatg

SEQ ID NO: 12512 - DNA, 203 bp, Homo sapiens
ggcgcgccagtcctcctagtgagaggactcgggacagggaattggccctgggagaaaacgcgcggggggcgtccgagacgccccgtgaaagccgtgccgacccttgggaggactgacaggtctagagacacgtagccatcagcaatgtgggcctcccgggaataagtgaggggctctgtgtttcgaggcgactcggaccgatg

SEQ ID NO: 12513 - DNA, 203 bp, Homo sapiens
ggcgcgccagtccttaataggcgaggactcgggatgctccccgtctaatgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggcgactcggaccgatg

SEQ ID NO: 12514 - DNA, 203 bp, Homo sapiens
ggcgcgccagtcctacaatggggaggagagactaccgtcctggagataacggttccacggaggcccaaggcgaaacggaaggatcctcatgtacaaaactgagcggaatggagctgtgagcacgcatcaggtatgtacatcataaaggcacgtagtagaggtcctcagccagcagagccacgttccttcgactcggaccgatg

SEQ ID NO: 12515 - DNA, 203 bp, Homo sapiens
ggcgcgccagtcctgctgaagtgaggagagactaccgtcctggagataacggttccacggaggcccaaggcgaaacggaaggatcctcatgtacaaaactgagcggaatggagctgtgagcacgcatcaggtgctgtttcaggcctggcacgtagtagagacgtatgatttcatgagccacgttccttcgactcggaccgatg

SEQ ID NO: 12516 - DNA, 203 bp, Homo sapiens
ggcgcgccagtccttatgacacgaggagagactaccgtcctggagataacggttccacggaggcccaaggcgaaacggaaggatcctcattggtgccgggagctggaatggagctgtgagcacgcatcaggtgctgtttcaggcctggcacgtagtagaggtcctcagccagcagagccacgttccttcgactcggaccgatg

SEQ ID NO: 12517 - DNA, 203 bp, Homo sapiens
ggcgcgccagtcctcgctgtaggaggagagactagttatgaattcgatacggttccacggaggcccaaggcgaaacggaaggatcctcatgtacaaaactgagcggaatggagctgtgagcacgcatcaggtgctgtttcaggcctggcacgtagtagaggtcctcagccagcagagccacgttccttcgactcggaccgatg

SEQ ID NO: 12518 - DNA, 203 bp, Homo sapiens
ggcgcgccagtcctcctataatgaggagggaagaggactccaagcgccatggccgctgccgcccgagcccgggtcgcgtacttgctgaggcaactgcaacgcgcagcgtgccagtgcccaactcattctcatactggaaggaaagcccctggactttcaccccaccaacgtccaacagattatgccttcgactcggaccgatg

SEQ ID NO: 12519 - DNA, 203 bp, Homo sapiens
ggcgcgccagtcctagctacaagaggagggaagaggactccaagcgccatggccgctgccgcccgagcccgggtcgcgtacttgctgaggcaactgcaacgcgcagcgtgccagtgcccaactcattctcatacttactcccaagcccctggactttcaccccaccaacgtccaacagattatgccttcgactcggaccgatg

SEQ ID NO: 12520 - DNA, 203 bp, Homo sapiens
ggcgcgccagtcctaggtccatgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgccttcgactcggaccgatg

SEQ ID NO: 12521 - DNA, 203 bp, Homo sapiens
ggcgcgccagtccttgggaggtgaggagggaagaggactccaagcgccatggccgctgccgcccgagcccgggtcgcgtacttgctgaggcaactgcaacgcgcagcgtgccagtgcccaactcattctcatcaggtgaagttcaaccctggactttcaccttctgggaaaacaacagattatgccttcgactcggaccgatg

SEQ ID NO: 12522 - DNA, 203 bp, Homo sapiens
ggcgcgccagtcctacaatacagaggagggaagaggactccaagcgccatggccgctgccgcccgagcccgggtcgcgtacttgctgaggtcttgatcttatagagcgtgccagtgcccaactcattctcatacttactcccaagcccctggactttcaccttctgggaaaacaacagattatgccttcgactcggaccgatg

SEQ ID NO: 12523 - DNA, 203 bp, Homo sapiens
ggcgcgccagtcctagactcacgaggagggaagaggactccaagcgcctcattaagactgttccgagcccgggtcgcgtacttgctgaggcaactgcaacgcgcagcgtgccagtgcccaactcattctcatacttactcccaagcccctggactttcaccttctgggaaaacaacagattatgccttcgactcggaccgatg

SEQ ID NO: 12524 - DNA, 203 bp, Homo sapiens
ggcgcgccagtcctgtaagcgtgaggccgcggggacccggcggacttcggcgcgggctgggagagaccacccgcagtcccttcctccaggaacgattatcttttcgcggagactcgtccggcgctctccagccgccctggagcaactttgcttcgaagttccctgggcccgggcagggcccggcagcccgactcggaccgatg

SEQ ID NO: 12525 - DNA, 203 bp, Homo sapiens
ggcgcgccagtccttaccgcaggaggccgcggggacccggcggacttcggcgcgggctgggattttattgtgctcctcccttcctccagggctcgccccaggcccgcggagactcgtccggcgctctccagccgccctggagcaactttgcttcgaagttccctgggcccgggcagggcccggcagcccgactcggaccgatg

SEQ ID NO: 12526 - DNA, 203 bp, Homo sapiens
ggcgcgccagtccttaagtctagaggcgaagcttcagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctcgactcggaccgatg

SEQ ID NO: 12527 - DNA, 203 bp, Homo sapiens
ggcgcgccagtccttaaagtaagaggcgggacgcggggtgataacagcactacaaatacatagggcgggagctggggaggaggagcaggagaggcccacaggcttcatttggagtcaggcctggctgttgctcaggtgaccagcttgtgtctctgggagggcgctgctttccccggccacccggcgcgcgactcggaccgatg

SEQ ID NO: 12528 - DNA, 203 bp, Homo sapiens
ggcgcgccagtcctacttgggtgaggcgggacgcggggtgataacagctggctctggtgggcgggcgggagctggggaggaggagcaggacgctatattcctactcatttggagtcaggcctggctgttgctcaggtgaccagcttgtgtctctgggagggcgctgctttccccggccacccggcgcgcgactcggaccgatg

SEQ ID NO: 12529 - DNA, 203 bp, Homo sapiens
ggcgcgccagtcctggttagtcgaggcgggacgcggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgcgactcggaccgatg

SEQ ID NO: 12530 - DNA, 203 bp, Homo sapiens
ggcgcgccagtcctacttatacgaggctcacaccaaggcaggcggggtaccttccctagtccctgcactaggttggacagcccccattggctacaggaaagcgggaggggtgtgagtcccctactccctctttgcagtggccccagcccccttaccgtctgcctgggatctgagtacatattgcagtgcgactcggaccgatg

SEQ ID NO: 12531 - DNA, 203 bp, Homo sapiens
ggcgcgccagtccttaggtggagaggctcacacctttcatccttccccaccttcccggtgagttgcactaggttggacagcccccattggctacaggaaagcgggaggggtgtgagtccccatggttttctttgcagtggccccagcccccttaccgtctgcctgggatctgagtacatattgcagtgcgactcggaccgatg

SEQ ID NO: 12532 - DNA, 203 bp, Homo sapiens
ggcgcgccagtcctcaaagtcggaggctcacacctttcatccttccccaccttcccggtgagttgcactaggttggacagcccccattggctacaggaaagcgggaggggtgtgagtcccctactccctctttgcagtggccccagcccccttaccgtctgcctgggatctgagtacatattgcagtgcgactcggaccgatg

SEQ ID NO: 12533 - DNA, 203 bp, Homo sapiens
ggcgcgccagtcctcgcgtggagaggctcacacctttcatccttccccaccttccctagtccctgcactaggttggacagcccccattggctacaggaaagcggatccacgcgagagaccctactccctctttgcagtggccccagcccccttaccgtctgcctgggatctgagtacatattgcagtgcgactcggaccgatg

SEQ ID NO: 12534 - DNA, 203 bp, Homo sapiens
ggcgcgccagtcctgatgccaggaggctcacacctttcatccttccccaccttccctagtccctgcactaggttggacagcccccattggctacaggaaagcgggaggggtgtgagtcatacctgtagggcctgcagtggccccagcccccttaccgtctgcctgggatctgagtacatattgcagtgcgactcggaccgatg

SEQ ID NO: 12535 - DNA, 203 bp, Homo sapiens
ggcgcgccagtcctctgggtcggaggctcacacctttcatccttccccaccttccctagtccctgcactaggttggacagcccccattggctacaggaaagcgggaggggtgtgagtcccctactccctctttgcagtggccccagcccccttaccgtctcgtaactcatcatatacatattgcagtgcgactcggaccgatg

SEQ ID NO: 12536 - DNA, 203 bp, Homo sapiens
ggcgcgccagtcctatcatccggaggctcacacctttcatccttccccaccttccctagtccctgcactaggttggacagcccccattggctacaggaaagcgggaggggtgtgagtcccctactccctctttgcagtggccccagcccccttaccgtctgcctgggatctgagggataccactccgccgactcggaccgatg

SEQ ID NO: 12537 - DNA, 203 bp, Homo sapiens
ggcgcgccagtcctgataatcagaggctcacacctttcatccttccccaccttccctagtcctgcgtacgatacaaacagcccccattggctacaggaaagcgggaggggtgtgagtcccctactccctctttgcagtggccccagcccccttaccgtctgcctgggatctgagtacatattgcagtgcgactcggaccgatg

SEQ ID NO: 12538 - DNA, 203 bp, Homo sapiens
ggcgcgccagtcctagaaccgagaggctcacacctttcatccttccccgagccgaagctgtgctgcactaggttggacagcccccattggctacaggaaagcgggaggggtgtgagtcccctactccctctttgcagtggccccagcccccttaccgtctgcctgggatctgagtacatattgcagtgcgactcggaccgatg

SEQ ID NO: 12539 - DNA, 203 bp, Homo sapiens
ggcgcgccagtccttcccataagaggggggtagcaacagtggtgagttcgttggatggcttaagccctgagtacagggtagtcgtcagtggttcgacgccttggaataaaggtctcgagatgccacgtggacgagggcatgcccaaagcacatcttaacctgagcgggggtcgcccaggtaaaagcagcgactcggaccgatg

SEQ ID NO: 12540 - DNA, 203 bp, Homo sapiens
ggcgcgccagtcctcccgagctgaggggggtagcaacagtggtgagttcgttggatggcttaagccctgagtacagggtagtcgtcagtggttcgacgccttggaataaaggtctcgagatgccacgtggacgagggcatgcccaaagcacatcttaacctgagcgggggtcgctgcctacccctttacgactcggaccgatg

SEQ ID NO: 12541 - DNA, 203 bp, Homo sapiens
ggcgcgccagtcctctccaaccgaggggggtagcaacagtggtgagttcgttggatggcttaagccctgagtacagggtagtcgtcagtggttcgacgccttggaataaaggtctcgatcccgattaattctgagggcatgcccaaagcacatcttaacctgagcgggggtcgcccaggtaaaagcagcgactcggaccgatg

SEQ ID NO: 12542 - DNA, 203 bp, Homo sapiens
ggcgcgccagtccttagagcgcgaggggggtagcaacagtggtgagttcgttggatggcttaagccctgagtacagggtagtcgtcagtgtgcatggcagagacaataaaggtctcgagatgccacgtggacgagggcatgcccaaagcacatcttaacctgagcgggggtcgcccaggtaaaagcagcgactcggaccgatg

SEQ ID NO: 12543 - DNA, 203 bp, Homo sapiens
ggcgcgccagtcctggtccgtggaggggggtagcggtgtgttgagaggcgttggatggcttaagccctgagtacagggtagtcgtcagtggttcgacgccttggaataaaggtctcgagatgccacgtggacgagggcatgcccaaagcacatcttaacctgagcgggggtcgcccaggtaaaagcagcgactcggaccgatg

SEQ ID NO: 12544 - DNA, 203 bp, Homo sapiens
ggcgcgccagtcctagcgcgaggaggggtttcccgacgccctggtctgagctctgtggtatctgattgttgttgaaccgtctctaagacggtgatactataagtcgtggtttgtgtgtttgtttgttaccttgtgtttgttcgtcacttgtcgacagcgccctgcgaattggtgtacccacaccgcgccgactcggaccgatg

SEQ ID NO: 12545 - DNA, 203 bp, Homo sapiens
ggcgcgccagtcctatgtgagagaggttaagccgtcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggtcgactcggaccgatg

SEQ ID NO: 12546 - DNA, 203 bp, Homo sapiens
ggcgcgccagtcctcagtatttgaggttgcctaggcagaagcgggagaaggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtcgactcggaccgatg

SEQ ID NO: 12547 - DNA, 203 bp, Homo sapiens
ggcgcgccagtcctctttggcggagtcccctgggcgcccccacaccggatatatagaacctgggttcgcgacgcagccccccggccgtggatgctcactcgggctcgggatccgcccaggtagccggctcggacccaggtcctgcgcccaggtcctcccctgccccccagcgacggagccggggccggcgactcggaccgatg

SEQ ID NO: 12548 - DNA, 203 bp, Homo sapiens
ggcgcgccagtcctcataggaagagtcccctgggcgcccccacaccggtagacgcctcggctggttcgcgacgcagccccccggccgtggatgctcactcgggctcgggatccgcccaggtagccggctcggacccaggtcctgcgaagcatcgagattgtgccccccagcgacggagccggggccggcgactcggaccgatg

SEQ ID NO: 12549 - DNA, 203 bp, Homo sapiens
ggcgcgccagtcctctcaacatgagtcccctgggcgcccccacaccggtagacgcctcggctggttcgcgacgcagccccccggccgtggatgctcactcgggctcgggatccgcccaggtagccggctcggacccaggtcctgcgcccaggtcctcccctgccccccagcgacggagccggggccggcgactcggaccgatg

SEQ ID NO: 12550 - DNA, 203 bp, Homo sapiens
ggcgcgccagtcctggacaaccgagtcccctgggcgcccccacaccggtagacgcctcggctggttcgcgacgcagccccccggccgtggatgctcactcgggctcgggatccgcccatccgcagatagaaaacccaggtcctgcgcccaggtcctcccctgccccccagcgacggagccggggccggcgactcggaccgatg

SEQ ID NO: 12551 - DNA, 203 bp, Homo sapiens
ggcgcgccagtccttcacgcatgagtcccctgggtttagtttgtaacatagacgcctcggctggttcgcgacgcagccccccggccgtggatgctcactcgggctcgggatccgcccaggtagccggctcggacccaggtcctgcgcccaggtcctcccctgccccccagcgacggagccggggccggcgactcggaccgatg

SEQ ID NO: 12552 - DNA, 203 bp, Homo sapiens
ggcgcgccagtcctactgcgtggagtgtcagctctccatctgtctctgcctggcaggcgcacaacgtttttcgaaggcctccggcgatgccgccccagcccctctgatggccctcctctctgctgccactcattccagaacaggaggcatgagcccggaacgcgcttgcttttaggagacagccacttcgactcggaccgatg

SEQ ID NO: 12553 - DNA, 203 bp, Homo sapiens
ggcgcgccagtcctaaagcactgagtgtcagctctccatctgtctctgcctggcaggcgcacgcgcccagcaccctgcctccggcgatgccgccccagcccctcgtggttatagttagtctgctgccactcattccagaacaggaggcatgagcccggaacgcgcttgcttttaggagacagccacttcgactcggaccgatg

SEQ ID NO: 12554 - DNA, 203 bp, Homo sapiens
ggcgcgccagtcctctatagccgagtgtcagctctccatctgtctctgcctggcaggcgcacgcgcccagcaccctgcctccggcgatgccgccccagcccctctgatggccctcctcatccactgtcgaatttccagaacaggaggcatgagcccggaacgcgcttgcttttaggagacagccacttcgactcggaccgatg

SEQ ID NO: 12555 - DNA, 203 bp, Homo sapiens
ggcgcgccagtcctggtgtttcgagtgtcagctctccatctgtctctgcctggcaggcgcacgcgcccagcaccctgcctccggcgatgccgccccagcccctctgatggccctcctctctgctgccactcacgaacatctctactgcatgagcccggaacgcgcttgcttttaggagacagccacttcgactcggaccgatg

SEQ ID NO: 12556 - DNA, 203 bp, Homo sapiens
ggcgcgccagtcctgcacctcagagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccacttcgactcggaccgatg

SEQ ID NO: 12557 - DNA, 203 bp, Homo sapiens
ggcgcgccagtcctgggagccagagtgtcagctctccatctgtctctgcctggcaggcgcacgcgcccagcaccctgcctccggcgatgccgccccagcccctctgatggccctcctctctgctgccactcattccagaacaggagtttactaggatcggcgcgcttgcttttaggagacagccacttcgactcggaccgatg

SEQ ID NO: 12558 - DNA, 203 bp, Homo sapiens
ggcgcgccagtcctagtttggcgagtgtcagctctccatctgtctctgcctggcaggcgcacgcgcccagcaccctgcctccggcgatgcttggggcctgaaattgatggccctcctctctgctgccactcattccagaacaggaggcatgagcccggaacgcgcttgcttttaggagacagccacttcgactcggaccgatg

SEQ ID NO: 12559 - DNA, 203 bp, Homo sapiens
ggcgcgccagtcctatagtgctgagtgtcagctctccatctgtctctgcctggcaggcgcacgcgcccagcacccttgaattctgcgatacgccccagcccctctgatggccctcctctctgctgccactcattccagaacaggaggcatgagcccggaacgcgcttgcttttaggagacagccacttcgactcggaccgatg

SEQ ID NO: 12560 - DNA, 203 bp, Homo sapiens
ggcgcgccagtcctcactgtgagatactcatcctacctgaatataaactgagataaatccagtaaagaaagtgtagccttccaacaccctgagtctatcattgatttctttttgtggtaaaaatcttagttcatgtgaagaaatttcatgtgaatgttttagctatcaaacagtactgtcacctactccgactcggaccgatg

SEQ ID NO: 12561 - DNA, 203 bp, Homo sapiens
ggcgcgccagtcctaccggtgcgatactcatcctacctgaatataaactgagataaatccagtaaagaaagtgtagtaaattctacataagagtctatcattgatttctttttgtggtgctctatcgcaacaatgtgaagaaatttcatgtgaatgttttagctatcaaacagtactgtcacctactccgactcggaccgatg

SEQ ID NO: 12562 - DNA, 203 bp, Homo sapiens
ggcgcgccagtcctgcgcatgcgatagcgcctttcccctaatgtagtacccacctgccaggtgtgaagtggagtgagcggatctccaatttggtctgttctgaactacaccatttactgctgtgaagaatgccctggaggcaagctggttacagccctgaccaggccctgcccgtgactctcgaccggcgactcggaccgatg

SEQ ID NO: 12563 - DNA, 203 bp, Homo sapiens
ggcgcgccagtcctcctgggtcgatagcgccttttgggatgcaggaaccccacctgccaggtgtgaagtggagtgactactgtaatcggatggtctgttctgaactacaccatttactgctgtgaagaatgccctggaggcaagctggttacagccctgaccaggccctgcccgtgactctcgaccggcgactcggaccgatg

SEQ ID NO: 12564 - DNA, 203 bp, Homo sapiens
ggcgcgccagtcctatggtgaggatagcgccttttgggatgcaggaaccccacctgccaggtgtgaagtggagtgagcggatctccaattgctgtgacataatcctacaccatttactgctgtgaagaatgccctggaggcaagctggttacagccctgaccaggccctgcccgtgactctcgaccggcgactcggaccgatg

SEQ ID NO: 12565 - DNA, 203 bp, Homo sapiens
ggcgcgccagtcctctcccaaagatagcgccttttgggatgcaggaaccccacctgccaggtgtgaagtggagtgagcggatctccaatttggtctgttctgaactacaccatttactgctgtgaagaatgccctggaggcaagctggttacagccctgaggtacgatatggaatgactctcgaccggcgactcggaccgatg

SEQ ID NO: 12566 - DNA, 203 bp, Homo sapiens
ggcgcgccagtcctttgtagtagatagcgccttttgggatgcaggaactgactgaatgtacagtgaagtggagtgagcggatctccaatttggtctgttctgaactacaccatttactgctgtgaagaatgccctggaggcaagctggttacagccctgaccaggccctgcccgtgactctcgaccggcgactcggaccgatg

SEQ ID NO: 12567 - DNA, 203 bp, Homo sapiens
ggcgcgccagtcctatgagcccgataggatgtgaaggctccgatttgtgaataggtttttatattcgaagtaggtagtattgcgcatactattaattccacaatacgtggtcttcgtcagttttttaggttgtttcgtccctatggaaatggctcttcggacctgagtacagtgggacaaccccaacgcgactcggaccgatg

SEQ ID NO: 12568 - DNA, 203 bp, Homo sapiens
ggcgcgccagtcctcgcaatcggatatagcacagggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 12569 - DNA, 203 bp, Homo sapiens
ggcgcgccagtcctcggcctccgatcccctgcagtcggcgggagtgttggaggtcggcgccgagtaaataagataccgccccccacgggaaggaagcacccccggtattaaaacgaacggggcggaaagaagccctcagtcgccggccgggaggcgagccgatgccgagctgctccacgtccaccatgcgactcggaccgatg

SEQ ID NO: 12570 - DNA, 203 bp, Homo sapiens
ggcgcgccagtcctgcgtaattgatcccctgcagtcggcgggagtgttggaggtcggcgccggcccccgccttccgcgccccccacgggaaggaagcacccccgaagaagtgtgcgtaggggcggaaagaagccctcagtcgccggccgggaggcgagccgatgccgagctgctccacgtccaccatgcgactcggaccgatg

SEQ ID NO: 12571 - DNA, 203 bp, Homo sapiens
ggcgcgccagtccttcaacctagatcccctgcagtcggcgggagtgttggaggtcggcgccggcccccgccttccgcgccccccacgggaaggaagcacccccggtattaaaacgaacctcctatgtcagtcccctcagtcgccggccgggaggcgagccgatgccgagctgctccacgtccaccatgcgactcggaccgatg

SEQ ID NO: 12572 - DNA, 203 bp, Homo sapiens
ggcgcgccagtcctcttccctggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccataaattgcggtgcccacgtccaccatgcgactcggaccgatg

SEQ ID NO: 12573 - DNA, 203 bp, Homo sapiens
ggcgcgccagtcctccgggcccgatcccctgcagtcggcgggagtgttggaggtcggcgccggcccccgccttccgcgccccccacgggaaggaagcacccccggtattaaaacgaacggggcggaaagaagggtgactaatatctccgggaggcgagccgatgccgagctgctccacgtccaccatgcgactcggaccgatg

SEQ ID NO: 12574 - DNA, 203 bp, Homo sapiens
ggcgcgccagtcctttcatgttgatcgaagacccaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 12575 - DNA, 203 bp, Homo sapiens
ggcgcgccagtccttccgacgggatcgtgtggatgtctttgctgaccagacaaagcataccagatctcaccagagagtcctaggggactacagaaggaaaaagacaagaggcagtaggatatctgtgtgtcctcccgctgaccacacttcctttagtgacccgattgcctcctcaagtcgcagacactcgactcggaccgatg

SEQ ID NO: 12576 - DNA, 203 bp, Homo sapiens
ggcgcgccagtccttatgcttcgatgcgctaatatcctccagtggctccgctccccgttctctgtgggctcaaaatgacagaggctcacaggacacctgcatgcccaaggcactccaccgtatgtgatcaacctggatccagcagtacatgaagttccctttcctgccaatattggtgatgaaatttacgactcggaccgatg

SEQ ID NO: 12577 - DNA, 203 bp, Homo sapiens
ggcgcgccagtcctgtgtgctagatgtcctaacacggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccacgactcggaccgatg

SEQ ID NO: 12578 - DNA, 203 bp, Homo sapiens
ggcgcgccagtcctgacgtgccgattcagaccccctacgcgcgcgccaatctccacgacgccactatggttgatattacgtggggcctttaatcttacctactctaaccaggtcatcacccaccgttgtttcgccgcatctggtgggtacccaacttttgccattcgggagagccccagggtgcccgacgactcggaccgatg

SEQ ID NO: 12579 - DNA, 203 bp, Homo sapiens
ggcgcgccagtcctcaagttgagattcagaccccctacgcgcgcgccaatctccacgacgccgactaacgcccctggcttattttttccaaatcttacctactctaaccaggtcatcacccaccgttgtttcgccgcatctggtgggtacccaacttttgccattcgggagagccccagggtgcccgacgactcggaccgatg

SEQ ID NO: 12580 - DNA, 203 bp, Homo sapiens
ggcgcgccagtccttgaatgtagattcagaccccctacgcgcgcgccaatctccacgacgccgactaacgcccctgtacgtggggcctttaatcttacctactctaaccaggtcatcacccaccgttgtttcgccgcatctggtggaggatattaaacatccattcgggagagccccagggtgcccgacgactcggaccgatg

SEQ ID NO: 12581 - DNA, 203 bp, Homo sapiens
ggcgcgccagtcctatgtagacgattcagaccccctacgcgcgcgccaatctccacgacgccgactaacgcccctgtacgtggggcctttaatcttacctactctaaccaggtcatcacccaccgttgtttcgccgcatctggtgggtacccaacttttgccattcgggagagccccagggtgcccgacgactcggaccgatg

SEQ ID NO: 12582 - DNA, 203 bp, Homo sapiens
ggcgcgccagtcctgtctgagtgattcagaccccctacgcgcgcgccaatctccacgacgccgactaacgcccctgtacgtggggcctttaatcttacctactctaaccaggtcatcacccaccgttgtttcgccgcatctggtgggtacccaacttttgtttaaactagcttacccagggtgcccgacgactcggaccgatg

SEQ ID NO: 12583 - DNA, 203 bp, Homo sapiens
ggcgcgccagtcctttcgcgcggattcagacccctgttttcatgtggtatctccacgacgccgactaacgcccctgtacgtggggcctttaatcttacctactctaaccaggtcatcacccaccgttgtttcgccgcatctggtgggtacccaacttttgccattcgggagagccccagggtgcccgacgactcggaccgatg

SEQ ID NO: 12584 - DNA, 203 bp, Homo sapiens
ggcgcgccagtcctaactcctagattggctttttaagcacctcccccagttattcaagtttctggtctttaaaaaactctgtggcggtacggtaaccgaggaggttccagcgcggcggaagtacaagcgttaagggtgtgtgcgcaaggccagggccagaggggcacgtggcgccgggaggagagagacgactcggaccgatg

SEQ ID NO: 12585 - DNA, 203 bp, Homo sapiens
ggcgcgccagtccttattaagtgattggcttttttttttggcaaaccacaatcgtcgccgaatggtctttaaaaaactctgtggcggtacggtaaccgaggaggttccagcgcggcggaagtaccccgcgggtgggtgtgtgcgcaaggccagggccagaggggcacgtggcgccgggaggagagagacgactcggaccgatg

SEQ ID NO: 12586 - DNA, 203 bp, Homo sapiens
ggcgcgccagtcctctagttaggattggcttttttttttggcaaaccagttattcaagtttctggtctttaaaaaactctgtggcggtacggtaaccgaggaggttccagcgcggcggaagtaccccgcgggactaatacgtttgcaggccagggccagaggggcacgtggcgccgggaggagagagacgactcggaccgatg

SEQ ID NO: 12587 - DNA, 203 bp, Homo sapiens
ggcgcgccagtcctctgaagtcgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagacaatgcaacaattacgggaggagagagacgactcggaccgatg

SEQ ID NO: 12588 - DNA, 203 bp, Homo sapiens
ggcgcgccagtcctccaacggcgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgcttttttctatccaccgactcggaccgatg

SEQ ID NO: 12589 - DNA, 203 bp, Homo sapiens
ggcgcgccagtcctaacattgggattggcttttttttttggcaaaccagttattcaagtttctggtctttaaaaaactctgtggcggtacggtaaccgaggaggttccagcgcggcggaagtaccccgcgggtgggtgtgtgcgcactaggcaacatgttggggcacgtggcgccgggaggagagagacgactcggaccgatg

SEQ ID NO: 12590 - DNA, 203 bp, Homo sapiens
ggcgcgccagtccttgttgtaagattggcttttttttttggcaaaccagttattcaagtttctggtctttaaaaaactctgtggcggtacggtaaccgaggaggttccagcgcggcggcctctaaagtaccttgggtgtgtgcgcaaggccagggccagaggggcacgtggcgccgggaggagagagacgactcggaccgatg

SEQ ID NO: 12591 - DNA, 203 bp, Homo sapiens
ggcgcgccagtcctttattcgggatttcagagaggcttagggcaaacatcatttggccttaaatgggattctgtgagaggggatccctccattgacagctggactgttctttggggccttatgtggtgtttgcctctgaggtactcaggggcatttaggtttttcctcattcttaaataataatgaaccgactcggaccgatg

SEQ ID NO: 12592 - DNA, 203 bp, Homo sapiens
ggcgcgccagtcctatgcgcaagcaaaagggccactaatgttctattatccctccactgccctcgaacgcctcacttcctaagtctctgcatttctcagtcagtggacagcttttgggactcttgtgtgaggactttgggggaccaggccaggctgggcctctgctgattgagatcttgggatccagacgactcggaccgatg

SEQ ID NO: 12593 - DNA, 203 bp, Homo sapiens
ggcgcgccagtccttcgagagagcaaaagggccaggggcccggagccttccctccactgcccggcggactgaatggtcctaagtctctgcatttctcagtcagtggacagcttttgggactcttgtgtgaggactttgggggaccaggccaggctgggcctctgctgattgagatcttgggatccagacgactcggaccgatg

SEQ ID NO: 12594 - DNA, 203 bp, Homo sapiens
ggcgcgccagtcctgaaagctggcaaaagggccaggggcccggagccttccctccactgccctcgaacgcctcacttcctaagtctctgcatttctcagtcagtggacagcttttgggactcttgtgtgaggactttgggggaccactgtctagaactgatctgctgattgagatcttgggatccagacgactcggaccgatg

SEQ ID NO: 12595 - DNA, 203 bp, Homo sapiens
ggcgcgccagtccttcattcctgcaaaagggccaggggcccggagccttccctccactgccctcgaacgcctcacttcctaagtctctgcatttctcagtcagtggacagcttttgggttgaaacaaacgcaactttgggggaccaggccaggctgggcctctgctgattgagatcttgggatccagacgactcggaccgatg

SEQ ID NO: 12596 - DNA, 203 bp, Homo sapiens
ggcgcgccagtcctgtaaaccggcaaaagggccaggggcccggagccttccctccactgccctcgaacgcctcacttcctaagtctctgcatttctcagtcagtttcacctagacaacactcttgtgtgaggactttgggggaccaggccaggctgggcctctgctgattgagatcttgggatccagacgactcggaccgatg

SEQ ID NO: 12597 - DNA, 203 bp, Homo sapiens
ggcgcgccagtccttcctcttagcaaaattctgcctccaaggattttctgccgtctcttggcaaaaatggcaaataatgatgctgttctgaagagactggagcagaagggtgcagaggcagatcaaatcattgaatatcttaagcagcaagtttctctacttaaggagaaagcatagcaatcccttgtcgactcggaccgatg

SEQ ID NO: 12598 - DNA, 203 bp, Homo sapiens
ggcgcgccagtccttgatggcggcaaaattctgcctccaaggattttctgccgtctcttggcaaaaatggcaaataatgatgctgttctgaagagactggagcagaagggtgcagagggttcaacccggtgggaatatcttaagcagcaagtttctctacttaaggagaaagcaattttgcaggcaaccgactcggaccgatg

SEQ ID NO: 12599 - DNA, 203 bp, Homo sapiens
ggcgcgccagtcctgagcggcagcaaaattctgcctccaaggattttctgccgtctcttggcaaaaatggcaaataatgatgctgttctgaagagactggagcatccctcacggtcaacagatcaaatcattgaatatcttaagcagcaagtttctctacttaaggagaaagcaattttgcaggcaaccgactcggaccgatg

SEQ ID NO: 12600 - DNA, 203 bp, Homo sapiens
ggcgcgccagtcctggcatgtcgcaaaattctgcctccaaggattttctgccgtctcttggcaaaaatggcaaataatgatgctgttctggctgctaaacccatgaagggtgcagaggcagatcaaatcattgaatatcttaagcagcaagtttctctacttaaggagaaagcaattttgcaggcaaccgactcggaccgatg

SEQ ID NO: 12601 - DNA, 203 bp, Homo sapiens
ggcgcgccagtcctaagctcgagcaacgagagagggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagccccgactcggaccgatg

SEQ ID NO: 12602 - DNA, 203 bp, Homo sapiens
ggcgcgccagtccttgcgagtagcaagcgttttccccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagtcgactcggaccgatg

SEQ ID NO: 12603 - DNA, 203 bp, Homo sapiens
ggcgcgccagtcctggagccgcgcaaggcatatcgcgcctgcgcggtggcccttccatcccggcagtcgtggctgcagcgctgaggcgagaggttggtgggtgtctccggccataatgacccaggctgagaagggtgatacggagaacggaaaggagaagggcggcgagaaggagaaggagcagcgcgcgactcggaccgatg

SEQ ID NO: 12604 - DNA, 203 bp, Homo sapiens
ggcgcgccagtcctcgcgactggcaaggcatatcgcgcctgcgcggtggcccttccatcccggcagtcgtggctgcagcgctgaggcgagaggttggtgggtgtctccggccataatgacccaggctgagaagggtgatacggaggcgtaccgcactcggggcggcgagaaggagaaggagcagcgcgcgactcggaccgatg

SEQ ID NO: 12605 - DNA, 203 bp, Homo sapiens
ggcgcgccagtccttttgatgagcacacctgtgtaatctaaaattgacatacctaattgattagttagatggaactacagtggattccataaggttcctgcctaccatcggctttaaagaaaaaaataggcccggacgggttagcaacaagcgactgccggtgccaacagcgcaatccacaatctacacgactcggaccgatg

SEQ ID NO: 12606 - DNA, 203 bp, Homo sapiens
ggcgcgccagtcctgctaagtagcaccttgccgcgatacgttaaaatatataacgtatttttaaaacttaggaaccaagacaaacacttttggtcttggtattggatcctcaagaaatatatcatcatgagtgatatctttgaagaggcggctagttttaggagttatcaatctaagttagggagagacgactcggaccgatg

SEQ ID NO: 12607 - DNA, 203 bp, Homo sapiens
ggcgcgccagtcctaaccagatgcacgtaaccttcagagagtgcggatctgagtaggagacccatcgtggtataactacagatgcagcccggtttaaaaagcgtctatgcccctacagggtagcggtgggccgcgccctttccttttaaaactacttgttctatggtgacaatggcaggaaacatgatcgactcggaccgatg

SEQ ID NO: 12608 - DNA, 203 bp, Homo sapiens
ggcgcgccagtcctctcttggggcacgtaaccttcagagagtgcggatctgagtaggagaccgtggtgcactgcttgcgcatcattattgggtttaaaaagcgtctatgcccctacagggtagcggtgggccgcgccctttccttttaaaactacttgttctatggtgacaatggcaggaaacatgatcgactcggaccgatg

SEQ ID NO: 12609 - DNA, 203 bp, Homo sapiens
ggcgcgccagtcctttcggcacgcacgtaaccttcagagagtgcggatctgagtaggagaccgtggtgcactgctttacagatgcagcccggtttaaaaagcgttgggcaaagatggtggtagcggtgggccgcgccctttccttttaaaactacttgttctatggtgacaatggcaggaaacatgatcgactcggaccgatg

SEQ ID NO: 12610 - DNA, 203 bp, Homo sapiens
ggcgcgccagtcctcacagttcgcagatggggggcttttagccacggtctctggtctgatgaagcagaaaagaagatgaggatcagggggggtagtccttttaggtcacgaatcaatatgttaaggatacctgtaagaaaggccttagtaggcctttctaagtctcctaaaggatgtgttcgaacaaccgactcggaccgatg

SEQ ID NO: 12611 - DNA, 203 bp, Homo sapiens
ggcgcgccagtcctacatctgcgcagatggggggcttttagccacggtctctggtctgatgaagcagaaaagaagatgaggatcagggggtcctcgggaacgctgtcacgaatcaatagagcggtacccatagtaagaaaggccttagtaggcctttctaagtctcctaaaggatgtgttcgaacaaccgactcggaccgatg

SEQ ID NO: 12612 - DNA, 203 bp, Homo sapiens
ggcgcgccagtcctaagaatgcgcagatggggggcttttagccacggtctctggtctgatgaagcagaaaagaagatgaggatcagggggtcctcgggaacgctgtcacgaatcaatatgttaaggatacctgtaagaaaggccttagtaggcctttctaagtctcctaaaggatgtgttcgaacaaccgactcggaccgatg

SEQ ID NO: 12613 - DNA, 203 bp, Homo sapiens
ggcgcgccagtcctaaatcgacgcagcagcgactaagggcgtaaacagttgaggccgtccccgactccttcctcccccttccctcccccttttttttgttttccgttcccctttcccctcccttccctatccccgacgaccggatcctgaggaggcagctgcggtggcagctgctgagttctcggtgacgactcggaccgatg

SEQ ID NO: 12614 - DNA, 203 bp, Homo sapiens
ggcgcgccagtccttgggacaggcagcagcgactcctctgagctgagtagtctcaaacggtggactccttcctcccccttccctcccccttttttttgttttccgttcccctttcccctcccttccctatccccgacgaccggatcctgaggaggcagctgcggtggcagctgctgagttctcggtgacgactcggaccgatg

SEQ ID NO: 12615 - DNA, 203 bp, Homo sapiens
ggcgcgccagtccttccgtaatgcagcagcgactcctctgagctgagtttgaggccgtccccgactccttcctcccccttccctcccccttttttttgttttccgttcccctttcccccgggggtatctcgaccgacgaccggatcctgaggaggcagctgcggtggcagctgctgagttctcggtgacgactcggaccgatg

SEQ ID NO: 12616 - DNA, 203 bp, Homo sapiens
ggcgcgccagtcctcgtacgatgcagcagcgactcctctgagctgagtttgaggccgtccccgactccttcctcccccttccctcccccttttttttgttttccgttcccctttcccctcccttccctatccccgacgaccggatcaacgcagactgaaggcggtggcagctgctgagttctcggtgacgactcggaccgatg

SEQ ID NO: 12617 - DNA, 203 bp, Homo sapiens
ggcgcgccagtcctgcgggtgggcagcagcgactcctctgagctgagtttgaggccgtccccgactccttcctcccccttccctcccccttttttttgttttccgttcccctttcccctcccttccctatccccgacgaccggatcctgaggaggcagctcgttccattagcagtgagttctcggtgacgactcggaccgatg

SEQ ID NO: 12618 - DNA, 203 bp, Homo sapiens
ggcgcgccagtcctgaggcaccgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgacgactcggaccgatg

SEQ ID NO: 12619 - DNA, 203 bp, Homo sapiens
ggcgcgccagtcctcagcgtatgcagcagcgactcctctgagctgagtttgaggccgtccccgactccttcctcccccttccctcccccttttttttgttttcctccggaagcgagtgtcccttccctatccccgacgaccggatcctgaggaggcagctgcggtggcagctgctgagttctcggtgacgactcggaccgatg

SEQ ID NO: 12620 - DNA, 203 bp, Homo sapiens
ggcgcgccagtcctaacggcccgcagccggccgtgcgcctgcgcggtgagtacatttctttcgcagtcgtggctgcagcgctgaggcgagaggttggtgggtgtctccggccataatgacccaggctgagaagggtgatacggagaacggaaaggagaagggcggcgagaaggagaaggagcagcgcgcgactcggaccgatg

SEQ ID NO: 12621 - DNA, 203 bp, Homo sapiens
ggcgcgccagtcctacgactaggcagccggccgtgcgcctgcgcggtggcccttccatcccggcagtcgtggctgcagcgctgaggcgagaggttggtgggtgtctccggccataatgacccaggctgagaaccccagcgattgctacggaaaggagaagggcggcgagaaggagaaggagcagcgcgcgactcggaccgatg

SEQ ID NO: 12622 - DNA, 203 bp, Homo sapiens
ggcgcgccagtcctttaggttcgcagccggccgtgcgcctgcgcggtggcccttccatcccggcagtcgtggctgcagcgctgaggcgagaggttggtgggtgtctccggccataatgacccaggctgagaagggtgatacggagagattcctcagaggcggcggcgagaaggagaaggagcagcgcgcgactcggaccgatg

SEQ ID NO: 12623 - DNA, 203 bp, Homo sapiens
ggcgcgccagtccttgctatctgcagccggccgtgcgcctgcgcggtggcccttccatcccggcagtcgtggctgccagtaaagacaagtaggttggtgggtgtctccggccataatgacccaggctgagaagggtgatacggagaacggaaaggagaagggcggcgagaaggagaaggagcagcgcgcgactcggaccgatg

SEQ ID NO: 12624 - DNA, 203 bp, Homo sapiens
ggcgcgccagtcctgctcagctgcagctgctgctacggctggactcgttcttttccatcagattcatcatcaacagcatggaagcgagaaaccaaacagctatttcaaaattccttctcctgggactgatagaggatccggaactgcagcccgtccttttcagcctgttcctgtccatgtacttggtccgactcggaccgatg

SEQ ID NO: 12625 - DNA, 203 bp, Homo sapiens
ggcgcgccagtcctcactgcatgcagctgctgcttacagattttattatcttttccatcagacgacgacgatgattcatggaagcgagaaaccaaacagctatttcaaaattccttctcctgggactgatagaggatccggaactgcagcccgtccttttcagcctgttcctgtccatgtacttggtccgactcggaccgatg

SEQ ID NO: 12626 - DNA, 203 bp, Homo sapiens
ggcgcgccagtcctaagggcgtgcagctgctgcttacagattttattatcttttccatcagattcatcatcaacagcatggaagcgagaaaccaaacagctattgaccggagatcctacctgggactgatagaggatccggaactgcagcccgtccttttcagcctgttcctgtccatgtacttggtccgactcggaccgatg

SEQ ID NO: 12627 - DNA, 203 bp, Homo sapiens
ggcgcgccagtcctggtaacacgcaggacagccccagcgagcctctggagtccctgtggcagaactcaaatggaagactccaggtactgtcccaggggagcagggtgtcacctccgttggatagagccggccaggttgcagcgcggacacactcgcaggtcgctgtggccccagcctcgcctgacagacgactcggaccgatg

SEQ ID NO: 12628 - DNA, 203 bp, Homo sapiens
ggcgcgccagtccttactattcgcaggacagccccagcgagcctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagacgactcggaccgatg

SEQ ID NO: 12629 - DNA, 203 bp, Homo sapiens
ggcgcgccagtcctggctatacgcaggacagccccagcgagcctctggagtccctgtggcagaactcaaatggaaggaggagcagctgcacccaggggagcagggtgtcacctccgttggatagagccggccaggttgcagcgcggacacactcgcaggtgttccaaatatagtcctcgcctgacagacgactcggaccgatg

SEQ ID NO: 12630 - DNA, 203 bp, Homo sapiens
ggcgcgccagtcctgatacttggcaggtgttgcaagatactactgtccgggtgtgggcctcgctcaccggcggttggttcttcgacccgcaccagagcaccttctccaactgcttccacctctatgtgtggatcttcctgctcatctttcccttcttactgtacatggtcctgcctcccagcttgatgcgactcggaccgatg

SEQ ID NO: 12631 - DNA, 203 bp, Homo sapiens
ggcgcgccagtcctgcaccagtgcaggtgttgcagatcctgcgccaggcatctcataaagacctcaccggcggttggttcttcgacccgcaccagagcaccttctccaactgcttccacctctatgtgtggatcttcctgctcatctttcccttcttactgtacatggtcctgcctcccagcttgatgcgactcggaccgatg

SEQ ID NO: 12632 - DNA, 203 bp, Homo sapiens
ggcgcgccagtcctgacatcgagcaggtgttgcagatcctgcgccagggggtgtgggcctcgctcaattctaacgggttcttcgacccgcaccagagcaccttctccaactgcttccacctctatgtgtggatcttcctgctcatctttcccttcttactgtacatggtcctgcctcccagcttgatgcgactcggaccgatg

SEQ ID NO: 12633 - DNA, 203 bp, Homo sapiens
ggcgcgccagtcctacctagttgcaggtgttgcagatcctgcgccagggggtgtgggcctcgctcaccggcggttgcacaggaccgtaaaaccagagcaccttctccaactgcttccacctctatgtgtggatcttcctgctcatctttcccttcttactgtacatggtcctgcctcccagcttgatgcgactcggaccgatg

SEQ ID NO: 12634 - DNA, 203 bp, Homo sapiens
ggcgcgccagtcctcctctccggcaggtgttgcagatcctgcgccagggggtgtgggcctcgctcaccggcggttggttcttcgacccgcaccagagcaccttctccaactgcttccacctctatgtgtggatcttcctgctcatcgaattgggggattcgtacatggtcctgcctcccagcttgatgcgactcggaccgatg

SEQ ID NO: 12635 - DNA, 203 bp, Homo sapiens
ggcgcgccagtcctcctacgcagcaggtgttgcagatcctgcgccagggggtgtgggcctcgctcaccggcggttggttcttcgacccgcaccagagcaccttctccaactgcttccacctctatgtgtggatcttcctgctcatctttcccttcttactgtacatggtcctgctgggttcaagaggacgactcggaccgatg

SEQ ID NO: 12636 - DNA, 203 bp, Homo sapiens
ggcgcgccagtccttgatctgtgcaggtgttgcagatcctgcgccagggggtgtgggcctcgctcaccggcggttggttcttcgacccgcaccagagcaccttctccaactgcttccacctctatgtgtggatcttcctgctcatctttcccttcttacttgttcgtaggggaactcccagcttgatgcgactcggaccgatg

SEQ ID NO: 12637 - DNA, 203 bp, Homo sapiens
ggcgcgccagtcctctgaggctgcaggtgttgcagatcctgcgccagggggtgtgggcctcgctcaccggcggttggttcttcgacccgcaccagagcaccttctccaactgcttccagagagtatgcaacttcttcctgctcatctttcccttcttactgtacatggtcctgcctcccagcttgatgcgactcggaccgatg

SEQ ID NO: 12638 - DNA, 203 bp, Homo sapiens
ggcgcgccagtcctcgtgtgccgcaggtgttgcagatcctgcgccagggggtgtgggcctcgctcaccggcggttggttcttcgacccgcctagcgaaggaccgtccaactgcttccacctctatgtgtggatcttcctgctcatctttcccttcttactgtacatggtcctgcctcccagcttgatgcgactcggaccgatg

SEQ ID NO: 12639 - DNA, 203 bp, Homo sapiens
ggcgcgccagtccttcccgagggcataatctcctgaatcccgggtttgccatttaatcatacaacatccacacgggagacaccttctacttccccaacttccgcgcgtccggggcgcagcttcccgggctgccttcgctgtcctacccacgccgcgacaacgtgtgctccctgtcctggccgtcggcgcgactcggaccgatg

SEQ ID NO: 12640 - DNA, 203 bp, Homo sapiens
ggcgcgccagtcctaaactagggcataatctcctgaatcccgggtttgtggggccgctggtaaacatccacacgggagacaccttcccacaagccaacttccgcgcgtccggggcgcagcttcccgggctgccttcgctgtcctacccacgccgcgacaacgtgtgctccctgtcctggccgtcggcgcgactcggaccgatg

SEQ ID NO: 12641 - DNA, 203 bp, Homo sapiens
ggcgcgccagtccttggcgccggcataatctcctgaatcccgggtttgtggggccgctggtaaacatccacacgggagacaccttctacttccccaacttccgcatcgtatccctatggcttcccgggctgccttcgctgtcctacccacgccgcgacaacgtgtgctccctgtcctggccgtcggcgcgactcggaccgatg

SEQ ID NO: 12642 - DNA, 203 bp, Homo sapiens
ggcgcgccagtccttagcaactgcataatctcctgaatcccgggtttgtggggccgctggtaaacatccacacgggagacaccttctacttccccaacttccgcgcgtccggggcgcagcttcccgggctgccttcgctgtcctacccacgccgcgacaacgtgacacgattgtcctggccgtcggcgcgactcggaccgatg

SEQ ID NO: 12643 - DNA, 203 bp, Homo sapiens
ggcgcgccagtcctaatccgaggcataatctcctgaatcccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcgcgactcggaccgatg

SEQ ID NO: 12644 - DNA, 203 bp, Homo sapiens
ggcgcgccagtcctcggcagcggcataatctcctgaatcccgggtttgtggggccgctggtaaacatccacacgggagacaccttctacttccccaacttccgcgcgtccggggcgcagcttcccgggctgccttcgctgtcctacccacgccgcgacaacgtgtgctccctgtgtgacgatcgtcttcgactcggaccgatg

SEQ ID NO: 12645 - DNA, 203 bp, Homo sapiens
ggcgcgccagtcctgttcatacgcataatctcctgaatcccgggtttgtggggccgctggtaaacatccacacgggagacaccttctacttccccaacttccgcgcgtccggggcgcagcttcccgggctgccttcgctgtcctactgcatggcgttgtgcgtgtgctccctgtcctggccgtcggcgcgactcggaccgatg

SEQ ID NO: 12646 - DNA, 203 bp, Homo sapiens
ggcgcgccagtcctcaaccaccgcataatctcctgaatcccgggtttgtggggccgctggtaaacatccacacgggagacaccttctacttccccaacttccgcgcgtccggggcgcagcttcccgggctgcggcaagctaagctgccacgccgcgacaacgtgtgctccctgtcctggccgtcggcgcgactcggaccgatg

SEQ ID NO: 12647 - DNA, 203 bp, Homo sapiens
ggcgcgccagtcctggacgttcgcatacccaataaaagattattatatgtagccgtgtaccataataaaatacattgcataccctcttttaataaaaaatattgcatacgttgacgaaacaaattttcgttgcatacccaataaaagattattatattgcataccttttcttgccataccatttagcccgactcggaccgatg

SEQ ID NO: 12648 - DNA, 203 bp, Homo sapiens
ggcgcgccagtcctagtggccagcatacccaataaaagattattatattgcatacccgtttttaataaaatacattcgggcgagcggacaaataaaaaatattgcatacgttgacgaaacaaattttcgttgcatacccaataaaagattattatattgcataccttttcttgccataccatttagcccgactcggaccgatg

SEQ ID NO: 12649 - DNA, 203 bp, Homo sapiens
ggcgcgccagtccttcatcatcgcatgttacagaaaagcaccggttacccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 12650 - DNA, 203 bp, Homo sapiens
ggcgcgccagtcctccttagaggcatgttacagagaattgataatatgccagcttggagacaacatgtggttcttgacaactctgctcctttggggctggctactactgcaggtctccagcagagtcttcatggaaggagaacctctggccttgaggtgtcatgcgtggaaggataagctggtgtacacgactcggaccgatg

SEQ ID NO: 12651 - DNA, 203 bp, Homo sapiens
ggcgcgccagtcctcactttccgcatgttacagatttcacctggtgaaccagcttggagacaacatgtgggaacgccgctgtctgctcctttggggctggctactactgcaggtctccagcagagtcttcatggaaggagaacctctggccttgaggtgtcatgcgtggaaggataagctggtgtacacgactcggaccgatg

SEQ ID NO: 12652 - DNA, 203 bp, Homo sapiens
ggcgcgccagtcctgagtgacggcatgttacagatttcacctggtgaaccagcttggagacaacatgtggttcttgacaactctgctcctttggggctggctactactgcaggtctccagcagagtcttcatggaaggagaacctctggccttgaggtgtcatgcgtggaaggataagctggtgtacacgactcggaccgatg

SEQ ID NO: 12653 - DNA, 203 bp, Homo sapiens
ggcgcgccagtccttggccctagcatgttacagatttcactactcccaagtcgaactctcgtacatgtggttcttgacaactctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 12654 - DNA, 203 bp, Homo sapiens
ggcgcgccagtcctggcctatggcatgttacagatttcactactcccaccagcttggagacaacatgtggcaaacacgtcatctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 12655 - DNA, 203 bp, Homo sapiens
ggcgcgccagtcctctggaagggcatgttacagatttcactactcccaccagcttggagacaacatgtggttcttgacaactctgctcctacaacgagggtagcatgggcaagtggacaccacaaaggcagtgatcactttgcagcctccatgggtcagcgtgttccaagaggaaaccgtaaccttgccgactcggaccgatg

SEQ ID NO: 12656 - DNA, 203 bp, Homo sapiens
ggcgcgccagtccttcgggcttgcatgttacagatttcactactcccaccagcttggagacaacatgtggttcttgacaactctgctcctttggggctggctactactgcaggtctccagcagagtcttcatggaaggagaacctctggccttgaggtgtcatgcgtggaaggaagctagaaccgcttcgactcggaccgatg

SEQ ID NO: 12657 - DNA, 203 bp, Homo sapiens
ggcgcgccagtcctaggatgccgcatgttacagatttcactactcccaccagcttggagacaacatgtggttcttgacaactctgctcctttggggctggctactactgcaggtctcccatgttcagcattgggaaggagaacctctggccttgaggtgtcatgcgtggaaggataagctggtgtacacgactcggaccgatg

SEQ ID NO: 12658 - DNA, 203 bp, Homo sapiens
ggcgcgccagtcctggagatcggcatgttacagatttcactactcccaccagcttggagacaacatgtggttcttgacaactctgctcctttgggttccagttgatgggcaagtggacaccacaaaggcagtttctgggggcgccgctccatgggtcagcgtgttccaagaggaaaccgtaaccttgccgactcggaccgatg

SEQ ID NO: 12659 - DNA, 203 bp, Homo sapiens
ggcgcgccagtcctagaggtccgcatgttacagatttcactactcccaccagcttggagacaacatgtggttcttgctcgggaccaatgcttggggctggctactactgcaggtctccagcagagtcttcatggaaggagaacctctggccttgaggtgtcatgcgtggaaggataagctggtgtacacgactcggaccgatg

SEQ ID NO: 12660 - DNA, 203 bp, Homo sapiens
ggcgcgccagtcctggcgcattgcatgttacagatttcactactcccaccagcttggagacacggctccccgggacacaactctgctcctttggggctggctactactgcaggtctccagcagagtcttcatggaaggagaacctctggccttgaggtgtcatgcgtggaaggataagctggtgtacacgactcggaccgatg

SEQ ID NO: 12661 - DNA, 203 bp, Homo sapiens
ggcgcgccagtccttcggtagggcatgttacagatttcactactcccaccagcttggagacatgtccacaaggcccacaactctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 12662 - DNA, 203 bp, Homo sapiens
ggcgcgccagtcctcgttgtgtgcatgttacagatttcactactcccaggtataaactatggacatgtggttcttgacaactctgctcctttggggctggctactactgcaggtctccagcagagtcttcatggaaggagaacctctggccttgaggtgtcatgcgtggaaggataagctggtgtacacgactcggaccgatg

SEQ ID NO: 12663 - DNA, 203 bp, Homo sapiens
ggcgcgccagtccttagaaggggcattctgtgtttgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgccgactcggaccgatg

SEQ ID NO: 12664 - DNA, 203 bp, Homo sapiens
ggcgcgccagtccttcggcccagcattgcccccaaatgaggaggggggtgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 12665 - DNA, 203 bp, Homo sapiens
ggcgcgccagtcctgaattaatgcattgcccccagtctcccccaaatttgggcattgtccccgggtcttccaacggactgggcgttgctcccggacactgaggactggccccggggtctcgctcaccttcagcagcgtccaccgccgcttgatccctaagcgatcgctcgctgcctgagctcctggtgcgactcggaccgatg

SEQ ID NO: 12666 - DNA, 203 bp, Homo sapiens
ggcgcgccagtcctgcgggatcgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgctgtgtagaaaatcacgactcggaccgatg

SEQ ID NO: 12667 - DNA, 203 bp, Homo sapiens
ggcgcgccagtcctttcattaagccaaggaacttcagtgctgtgaactcacaactctaaggacgtggtttttcactcagtctccaggtgctgttactcaactcagtcctaggaacgtcgggtcctgggaaggagcccaagcgctcccagccagcttccaggcgctaagaaaccccggtgcttcccatccgactcggaccgatg

SEQ ID NO: 12668 - DNA, 203 bp, Homo sapiens
ggcgcgccagtcctaacgttcagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaacccttcattccgaaggtcgactcggaccgatg

SEQ ID NO: 12669 - DNA, 203 bp, Homo sapiens
ggcgcgccagtcctgctagtatgccaaggaacttcagtgctgtgaactcacaactctaaggagccctccaaagttccagtctccaggtgctgttactcaactcagtcctaggaacgtcgggtcctgggaaggcaggattttttggacagccagcttccaggcgctaagaaaccccggtgcttcccatccgactcggaccgatg

SEQ ID NO: 12670 - DNA, 203 bp, Homo sapiens
ggcgcgccagtcctaagcctcggccacccctcctagtctagtcgtgtaggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtcgactcggaccgatg

SEQ ID NO: 12671 - DNA, 203 bp, Homo sapiens
ggcgcgccagtcctgttggcatgccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagccgtagcttactagttcaaattctagcagtcgactcggaccgatg

SEQ ID NO: 12672 - DNA, 203 bp, Homo sapiens
ggcgcgccagtccttctggagcgccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccaacctaatacaagtgcgactcggaccgatg

SEQ ID NO: 12673 - DNA, 203 bp, Homo sapiens
ggcgcgccagtccttccgcgaagccacccctcctgcgtctccacaaatggtccgacccgcaagcaagggggcgggtccggctttgaaaagccggcgggtcgggctggaccaccccttacgggaaaatggcggattcctcggggcgaggcgctgggaagcctgcaaccggccccacaaattctagcagtcgactcggaccgatg

SEQ ID NO: 12674 - DNA, 203 bp, Homo sapiens
ggcgcgccagtcctacagccaagccacccctcctgcgtctccacaaatggtccgacccgcaagcaagggggcgggtccggctttgaaaagggcaataagtaatacttgaggtggaaggcgggaaaatggcggattcctcggggcgaggcgctgggaagcctgcaaccggccccacaaattctagcagtcgactcggaccgatg

SEQ ID NO: 12675 - DNA, 203 bp, Homo sapiens
ggcgcgccagtcctcccttgcagccacctccggtcggcgactgcggcgggctcgacgaggcgagccttcttcgcttggcgggaagacggccgggtgcgccttggggtttagtggcggcttctccatgggtccagccagccgcttccctgtgctgtgagtgtttccaccactccaggagacagcattcacgactcggaccgatg

SEQ ID NO: 12676 - DNA, 203 bp, Homo sapiens
ggcgcgccagtcctcttaccgtgccacctccggtcggcgactgcggcgggctcgacgaggcggctgacggggcggcggcgggaagacggcactagcatggcgttggtttagtggcggcttctccatgggtccagccagccgcttccctgtgctgtgagtgtttccaccactccaggagacagcattcacgactcggaccgatg

SEQ ID NO: 12677 - DNA, 203 bp, Homo sapiens
ggcgcgccagtcctcctttcacgccacctccggtcggcgactgcggcgggctcgacgaggcggctgacggggcggcggcgggaagacggccgggtgcgccttggggtttagtggcggcttctccatgggtccagccagccgcttccctgtgctgtgagtgtttccaccactccaggagacagcattcacgactcggaccgatg

SEQ ID NO: 12678 - DNA, 203 bp, Homo sapiens
ggcgcgccagtcctaacgatttgccacctccggtcggcgactgcggcgggctcgacgaggcggctgacggggcggcggcgggaagacggccgggtgcgccttggggtttagtggcggcttctccatgggtccagccagccgcttccgcagcggcgtttgctttccaccactccaggagacagcattcacgactcggaccgatg

SEQ ID NO: 12679 - DNA, 203 bp, Homo sapiens
ggcgcgccagtcctaccatcaagccacctccggtcggcgactgcggcgtaagtctacctaatgctgacggggcggcggcgggaagacggccgggtgcgccttggggtttagtggcggcttctccatgggtccagccagccgcttccctgtgctgtgagtgtttccaccactccaggagacagcattcacgactcggaccgatg

SEQ ID NO: 12680 - DNA, 203 bp, Homo sapiens
ggcgcgccagtcctgaatcctcgccaggaacgattactattcttggttctctggaattactcagtttcaaaagggaaaggagtttgagtttgtagaaggacaaggtgtgcctattgcaccaggagtcccagctactgaagctaaggggtactggtacagacacaacagacgttcttttaaaacagccgcgactcggaccgatg

SEQ ID NO: 12681 - DNA, 203 bp, Homo sapiens
ggcgcgccagtcctaatcgtgtgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctccggctgttaaaggacgactcggaccgatg

SEQ ID NO: 12682 - DNA, 203 bp, Homo sapiens
ggcgcgccagtcctggagtagtgccaggacgaccgggtcctttcttggataaacccgctcaatgcctggagatttgggcgtgcccccgcatccacttattaaaggtagtgttgggtcgcgaaaggccttgtggtactgcctgatagggtgcttgcgagtgccccgggaggtctcgtagaccgtgcacccgactcggaccgatg

SEQ ID NO: 12683 - DNA, 203 bp, Homo sapiens
ggcgcgccagtcctctgtgaaggccaggacgaccgggtcctttcttggtccgcggtcaggcgtgcctggagatttgggcgtgcccccgcaagactgctagccgagtagtgttgggtcgcgaaaggccttgtggtactgcctgatagggtgcttgcgagtgccccgggaggtctcgtagaccgtgcacccgactcggaccgatg

SEQ ID NO: 12684 - DNA, 203 bp, Homo sapiens
ggcgcgccagtcctgcagtcgagccatggtaagcatatgaattgaatcaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactcgactcggaccgatg

SEQ ID NO: 12685 - DNA, 203 bp, Homo sapiens
ggcgcgccagtccttgaggtgggccatggtaagcgcggacgccatggtaagcgcggacgccatggtaagcgcggacgccatggtaagcgcggacgccatggtaagcgcggacgccatgcattcactattgaacatggtaagcgcggacgccatggtaagcgcggacgccatgcacacggaccctgactcgactcggaccgatg

SEQ ID NO: 12686 - DNA, 203 bp, Homo sapiens
ggcgcgccagtcctttgcgctcgccatggtaagcgcggacgccatggtaagcgcggacgccatggtaagcgcggacgccatggtaagcgcggacgccatggtaagcgcggacgccatggtaagcgcggacgccatggtaagcgcggtaaagcctagggatgcggacgccatgcacacggaccctgactcgactcggaccgatg

SEQ ID NO: 12687 - DNA, 203 bp, Homo sapiens
ggcgcgccagtcctgtcctacagccatggtaagcgcggacgccatggtaagcgcggacgccatggtaagcgcggacgccatggtaagcgcggacgccatggtaagcgcggacgccatggtaagcgcggacgctgatcattcaagcaacgccatggtaagcgcggacgccatgcacacggaccctgactcgactcggaccgatg

SEQ ID NO: 12688 - DNA, 203 bp, Homo sapiens
ggcgcgccagtcctaagtgctcgcccacgtacggtccacgtcgcccttcaatgtctctcttgaccaataggcgtagccggcgagttgacaaggaccagtgggggccgggcgggaggggacgcctgttgtgaagctgcccttcccggggaggcgggaaatgcatggggccacccagctccgcggcggcccgactcggaccgatg

SEQ ID NO: 12689 - DNA, 203 bp, Homo sapiens
ggcgcgccagtcctacatggaggcccacgtacggtccacgtcgcccttcaatgtctctcttgaccaataggcgtagccggcgagttgacaaggaccagtgggggccgggcgggagggggaaggacccccaccgctgcccttcccggggaggcgggaaatgcatggggccacccagctccgcggcggcccgactcggaccgatg

SEQ ID NO: 12690 - DNA, 203 bp, Homo sapiens
ggcgcgccagtcctgtgagtacgcccacgtacggtccacgtcgcccttcaatgtctctcttgaccaataggcgtagccggcgagttgacaaggaccagtggggggttacgatattaacgaaggacccccaccgctgcccttcccggggaggcgggaaatgcatggggccacccagctccgcggcggcccgactcggaccgatg

SEQ ID NO: 12691 - DNA, 203 bp, Homo sapiens
ggcgcgccagtcctagctggatgcccacgtacggtccacgtcgcccttcaatgtctctcttgaccaataggcgtagccggcgagttgacacttgtattaattctccgggcgggagggggaaggacccccaccgctgcccttcccggggaggcgggaaatgcatggggccacccagctccgcggcggcccgactcggaccgatg

SEQ ID NO: 12692 - DNA, 203 bp, Homo sapiens
ggcgcgccagtcctcagggtgcgcccattccctgaggtaaggaaggggccttaacctctgctggtgaccagaagcctgcatttctgcattctgcttaattccctttccttagatttgaaagaagccaacactaaaccacaaatatacaacaaggccattttctcaaacgagagtcagcctttaacgaacgactcggaccgatg

SEQ ID NO: 12693 - DNA, 203 bp, Homo sapiens
ggcgcgccagtcctaacagagcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaaacaccagtaaggcgcacagtaggaactccgactcggaccgatg

SEQ ID NO: 12694 - DNA, 203 bp, Homo sapiens
ggcgcgccagtcctcttgcgttgccccactgcgcatggcacgttgcgtactcccctcccagcaaccggtctggcggcggcgcggcagtaacctgacaacttaccagccaagacggtcggggctgcttgctaactccaggaacaggtttaagtttttgaaactgaagtaggcctacacagtaggaactccgactcggaccgatg

SEQ ID NO: 12695 - DNA, 203 bp, Homo sapiens
ggcgcgccagtcctccgaacttgccccactgcgcatggcacgttgcgtactcccctcccagcaaccggtctggcggtctgtaacggactgaactgaggaggcggagccaagacggtcggggctgcttgctaactccaggaacaggtttaagtttttgaaactgaagtaggcctacacagtaggaactccgactcggaccgatg

SEQ ID NO: 12696 - DNA, 203 bp, Homo sapiens
ggcgcgccagtcctaatgagaagccccactgcgccatagtacaattcaactcccctcccagcaaccggtctggcggcggcgcggcagtaaaactgaggaggcggagccaagacggtcggggctgcttgctaactccaggaacaggtttaagtttttgaaactgaagtaggcctacacagtaggaactccgactcggaccgatg

SEQ ID NO: 12697 - DNA, 203 bp, Homo sapiens
ggcgcgccagtcctcacgctgggccccctggctggttcggtgtcttttactggtaacgcccatgctcccagggggccctgacgccctggggcacttttgctctgcacaggaccacgctggggtttgccatggtgacataaaggggtgtagaggaaggaaggagcaagaccagcctgtagactgtgccccgactcggaccgatg

SEQ ID NO: 12698 - DNA, 203 bp, Homo sapiens
ggcgcgccagtcctcgtcagtagccccctggctggttcggtgtcttttgacctgctgttgacgagagggttttccgcctgacgccctggggcacttttgctctgcacaggaccacgctggggtttgccatggtgacataaaggggtgtagaggaaggaaggagcaagaccagcctgtagactgtgccccgactcggaccgatg

SEQ ID NO: 12699 - DNA, 203 bp, Homo sapiens
ggcgcgccagtcctttaaggaggccccctggctggttcggtgtcttttgacctgctgttgactgctcccagggggccctgacgccctggggcacttttgctctgacggaagagtactcggggtttgccatggtgacataaaggggtgtagaggaaggaaggagcaagaccagcctgtagactgtgccccgactcggaccgatg

SEQ ID NO: 12700 - DNA, 203 bp, Homo sapiens
ggcgcgccagtcctttgggactgccccctggctggttcggtgtcttttgacctgctgttgactgctcccagggggccctgacgccctggggcacttttgctctgcacaggaccacgctggggtttgccatggtgacataaaggggtcactttcgtcacgagagcaagaccagcctgtagactgtgccccgactcggaccgatg

SEQ ID NO: 12701 - DNA, 203 bp, Homo sapiens
ggcgcgccagtcctgggtagaagccccctggctggttcggtgtcttttgacctgctgttgactgctcccagggggccctgacgccctggggcacttttgctctgcacaggaccacgctggggtttgccatggtgacataaaggggtgtagaggaaggaaggagcaagaccagcctgtagactgtgccccgactcggaccgatg

SEQ ID NO: 12702 - DNA, 203 bp, Homo sapiens
ggcgcgccagtcctaagatcacgccccgacccgtgggtcccggccaccagcgccccagccccgaggctcagaagcggcaggcggaggcggggtccgggcgctatggccatgcccggcgggtctcacgcggctgcccctcgccccgcgcgccttcggtaggaccatgtgctttatcagctggcccggcccgactcggaccgatg

SEQ ID NO: 12703 - DNA, 203 bp, Homo sapiens
ggcgcgccagtcctaggatagagccccgcctcctgcaggcggcccggccaccaacagcatgtcggtgcatggtggggcggtctccttcggcaaccccggccgaacggccacccagaggctgtgctgagctggcgcagcggcagcagcatgagccggaccctcgcatcggccgtgcccctgtcgagtcccgactcggaccgatg

SEQ ID NO: 12704 - DNA, 203 bp, Homo sapiens
ggcgcgccagtcctatatgaacgccccgcctcctgcaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgagaaaagacctcgacgactcggaccgatg

SEQ ID NO: 12705 - DNA, 203 bp, Homo sapiens
ggcgcgccagtcctgccgtcctgcccgactcgccctcagaaactcactcccccatcgacgcaactttctcgtcgtgccccacaaaagtaaagcttggggacctggggggagccggaagtatcgcttcgagatccccaaatactatcggggaaacggaagtggccgtcggtggcagagacctgtcggcccgactcggaccgatg

SEQ ID NO: 12706 - DNA, 203 bp, Homo sapiens
ggcgcgccagtcctcagtacaggcccgactcgccctcagaaactcactgtttggggctgcggactttctcgtcgtgccccacaaaagtaaagcttggggacctgattatcaattaggttatcgcttcgagatccccaaatactatcggggaaacggaagtggccgtcggtggcagagacctgtcggcccgactcggaccgatg

SEQ ID NO: 12707 - DNA, 203 bp, Homo sapiens
ggcgcgccagtcctttggaatcgcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggcccgactcggaccgatg

SEQ ID NO: 12708 - DNA, 203 bp, Homo sapiens
ggcgcgccagtcctacggttatgcccgactcgccctcagaaactcactgtttggggctgcggcgaccgctaggcctccccacaaaagtaaagcttggggacctggggggagccggaagtatcgcttcgagatccccaaatactatcggggaaacggaagtggccgtcggtggcagagacctgtcggcccgactcggaccgatg

SEQ ID NO: 12709 - DNA, 203 bp, Homo sapiens
ggcgcgccagtccttgctcaaagcccgactcgccggtcttgtggtctagtttggggctgcggactttctcgtcgtgccccacaaaagtaaagcttggggacctggggggagccggaagtatcgcttcgagatccccaaatactatcggggaaacggaagtggccgtcggtggcagagacctgtcggcccgactcggaccgatg

SEQ ID NO: 12710 - DNA, 203 bp, Homo sapiens
ggcgcgccagtccttgaatacggcccggaaccacaactatagttctcagcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccgactcggaccgatg

SEQ ID NO: 12711 - DNA, 203 bp, Homo sapiens
ggcgcgccagtccttcaactgggcccggaaccacgtgatgcaggaggtctaaataaacctttggctcgcgcgggtggagccgcctcggcgttcgagcggggtgggggctgcccggttgagatttcccggcgggtcccggcctctgcgtgcacgcgcctgcgtgctcgcgctcgcggttctggcgctgccgactcggaccgatg

SEQ ID NO: 12712 - DNA, 203 bp, Homo sapiens
ggcgcgccagtcctaaccgtaagcccggaaccacgtgatgcaggaggtgcccgaggcggcggggctcgcgcgggtggagccgcctcggcgcaatgcaacaccccgggctgcccggttgagatttcccggcgggtcccggcctctgcgtgcacgcgcctgcgtgctcgcgctcgcggttctggcgctgccgactcggaccgatg

SEQ ID NO: 12713 - DNA, 203 bp, Homo sapiens
ggcgcgccagtcctcgtcttgcgcccggaaccacgtgatgcaggaggtgcccgaggcggcggggctcgcgcgggtggagccgcctcggcgttcgagcggggtgggggctgcccggttgagatttcccggcgggtcccggcctctgcactacgcatagctagtgctcgcgctcgcggttctggcgctgccgactcggaccgatg

SEQ ID NO: 12714 - DNA, 203 bp, Homo sapiens
ggcgcgccagtcctccaaccaggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcagttgtcattgactggttctggcgctgccgactcggaccgatg

SEQ ID NO: 12715 - DNA, 203 bp, Homo sapiens
ggcgcgccagtcctaggccaaggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccgactcggaccgatg

SEQ ID NO: 12716 - DNA, 203 bp, Homo sapiens
ggcgcgccagtcctgcgttctggcccggaaccacgtgatgcaggaggtgcccgaggcggcggggctcgcgcgggtggagccgcctcggcgttcgagcggggtggttatgtgagttcccagatttcccggcgggtcccggcctctgcgtgcacgcgcctgcgtgctcgcgctcgcggttctggcgctgccgactcggaccgatg

SEQ ID NO: 12717 - DNA, 203 bp, Homo sapiens
ggcgcgccagtcctgtcgatccgccctcacgctcagcaccccagcctgcctgcccgcccgcctgccctgccgctgcatatgacgggcttgtgtagcgcgggagcttctcgcagcgccccgggccttctcgtggtaccctgcctgctgcctttgcccccgcactgactgcccggctccagcagccatggcgactcggaccgatg

SEQ ID NO: 12718 - DNA, 203 bp, Homo sapiens
ggcgcgccagtcctggcccgctgccctcacgctcagcaccccagcctgcctgcccgcccgcctgccctgccgctgcccgctgtcacaccctgtagcgcgggagcgctctaatcaagggcgggccttctcgtggtaccctgcctgctgcctttgcccccgcactgactgcccggctccagcagccatggcgactcggaccgatg

SEQ ID NO: 12719 - DNA, 203 bp, Homo sapiens
ggcgcgccagtcctccagtatggccctcacgctcagcaccccagcctgcctgcccgcccgcctgccctgccgctgcccgctgtcacaccctgtagcgcgggagcttctcgcagcgccccgggccttctcgtggtaccctgcctgctgcctttgcccccgcactgactgcccggctccagcagccatggcgactcggaccgatg

SEQ ID NO: 12720 - DNA, 203 bp, Homo sapiens
ggcgcgccagtcctcggccgttgccctcacgctcagcaccccagcctgcctgcccgcccgcctgccctgccgctgcccgctgtcacaccctgtagcgcgggagcttctcgcagcgcccttaatgcatataatgtaccctgcctgctgcctttgcccccgcactgactgcccggctccagcagccatggcgactcggaccgatg

SEQ ID NO: 12721 - DNA, 203 bp, Homo sapiens
ggcgcgccagtccttccaaggcgccctcacgctcagcaccccagcctgtacctttcgtgtggtgccctgccgctgcccgctgtcacaccctgtagcgcgggagcttctcgcagcgccccgggccttctcgtggtaccctgcctgctgcctttgcccccgcactgactgcccggctccagcagccatggcgactcggaccgatg

SEQ ID NO: 12722 - DNA, 203 bp, Homo sapiens
ggcgcgccagtcctgttatccagccctcacgctctcgcttgagtgagccctgcccgcccgcctgccctgccgctgcccgctgtcacaccctgtagcgcgggagcttctcgcagcgccccgggccttctcgtggtaccctgcctgctgcctttgcccccgcactgactgcccggctccagcagccatggcgactcggaccgatg

SEQ ID NO: 12723 - DNA, 203 bp, Homo sapiens
ggcgcgccagtcctgagcgcacgccgattgatgtggagcaggtggtcacaaaccagtgattggcctgtcgtaacgcgcaagtccgtggcggaaccgactactttgggtgtccgtgtttccttttattttattgtggctgcttatggtgacaatcacagattgttatcataaagcgaattggattggcccgactcggaccgatg

SEQ ID NO: 12724 - DNA, 203 bp, Homo sapiens
ggcgcgccagtcctccaggctagccgcagtcagactggtatcagctcgcccctctgagtcaggaaacattttcagacctatggaaactacttcctgaaaacaacgttctgtcccccttgccgtcccaagcaatggatgatttgatgctgtccccggacgatattgaacaatggttcactgaagacccacgactcggaccgatg

SEQ ID NO: 12725 - DNA, 203 bp, Homo sapiens
ggcgcgccagtcctacgtcagggccgcagtcagatcctagcgtcgagccccctctgagtcaggaaacattttcagaatggaaccgtagttttcctgaaaacaacgttctgtcccccttgccgtcccaagcaatggatgatttgatgctgtccccggacgatattgaacaatggttcactgaagacccacgactcggaccgatg

SEQ ID NO: 12726 - DNA, 203 bp, Homo sapiens
ggcgcgccagtcctgctgggcggccgcagtcagatcctagcgtcgagccccctctgagtcaggaaacattttcagacctatggaaactacgcaggtttgcggcggttctgtcccccttgccgtcccaagcaatggatgatttgatgctgtccccggacgatattgaacaatggttcactgaagacccacgactcggaccgatg

SEQ ID NO: 12727 - DNA, 203 bp, Homo sapiens
ggcgcgccagtcctcgtggaaggccgcagtcagatcctagcgtcgagccccctctgagtcaggaaacattttcagacctatggaaactacttcctgaaaacaacgttctgtcccccttcggaataaggaaggtggatgatttgatgctgtccccggacgatattgaacaatggttcactgaagacccacgactcggaccgatg

SEQ ID NO: 12728 - DNA, 203 bp, Homo sapiens
ggcgcgccagtcctagcttcccgccgcagtcagatcctagcgtcgagccccctctgagtcaggaaacattttcagacctatggaaactacttcctgaaaacaacgttctgtcccccttgccgtcccaagcaatggatgatttgatgctgtccccggacgactaactgaccgttctcactgaagacccacgactcggaccgatg

SEQ ID NO: 12729 - DNA, 203 bp, Homo sapiens
ggcgcgccagtcctcagattaggccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggtgagggccgtcaagccgactcggaccgatg

SEQ ID NO: 12730 - DNA, 203 bp, Homo sapiens
ggcgcgccagtcctgagtaaacgccgcagtcagatcctagcgtcgagccccctctgagtcagtctgaggaaatgttcctatggaaactacttcctgaaaacaacgttctgtcccccttgccgtcccaagcaatggatgatttgatgctgtccccggacgatattgaacaatggttcactgaagacccacgactcggaccgatg

SEQ ID NO: 12731 - DNA, 203 bp, Homo sapiens
ggcgcgccagtccttcgtagccgccgcggcagccgaagcgcagcgagagaacgcgccaccgcggggcccgggtgcaatagagatttggtacgccacctgcgcgcagcccgaggtgagcagtgagcggcgagcgggagggcagcgaggcgttcgcgggccccctcctgctgcccgggcccggcccgctccgactcggaccgatg

SEQ ID NO: 12732 - DNA, 203 bp, Homo sapiens
ggcgcgccagtccttagtgaatgccgcggcagccgaagcgcagcgagagaacgcgccaccgcggggcccgggtgcagctagcgaccctctcgccacctgcgcgcagcccgaggtgagcagtgagcggcgagccttccctgccgtcagcgttcgcgggccccctcctgctgcccgggcccggcccgctccgactcggaccgatg

SEQ ID NO: 12733 - DNA, 203 bp, Homo sapiens
ggcgcgccagtcctctaaatgtgccgcggggggtcaggtcagcttctaggcgtgcgctcccgacatgccccgccgcgcgccattaaccgccagatttgaatcgcgggacccgttggcagaggtggcggcggcggcatgggtgccccgacgttgccccctgcctggcagccctttctcaaggaccaccgcgactcggaccgatg

SEQ ID NO: 12734 - DNA, 203 bp, Homo sapiens
ggcgcgccagtcctccagtggtgccgcggggggtggaccgcctaagagggcgtgcgctcccgacatgccccgccgcgcgccattaaccgccagatttgaatcgcgggacccgttggcagaggtggcggcggcggcatgggtgccccgacgttgccccctgcctggcagccctttctcaaggaccaccgcgactcggaccgatg

SEQ ID NO: 12735 - DNA, 203 bp, Homo sapiens
ggcgcgccagtccttatccatggccgcggggggtggaccgcctaagagggcgtgcgctcccgacatgccccgccgcgcgccattaaccgccagatttgaatcgcgggacccgttggcagaggtggcggcggcggcatgggtgccccgacgttgccccctgcctggcagcccttttagtgcttaatgaccgactcggaccgatg

SEQ ID NO: 12736 - DNA, 203 bp, Homo sapiens
ggcgcgccagtccttaacacgtgccgcggggggtggaccgcctaagagggcgtgcgctcccgacatgccccgccgcgcgccattaaccgctgaccgattcagttgggacccgttggcagaggtggcggcggcggcatgggtgccccgacgttgccccctgcctggcagccctttctcaaggaccaccgcgactcggaccgatg

SEQ ID NO: 12737 - DNA, 203 bp, Homo sapiens
ggcgcgccagtcctcttggtacgccgcggggggtggaccgcctaagagggcgtgcgctcccgacatgccccgcggcctcagggctgtttgcagatttgaatcgcgggacccgttggcagaggtggcggcggcggcatgggtgccccgacgttgccccctgcctggcagccctttctcaaggaccaccgcgactcggaccgatg

SEQ ID NO: 12738 - DNA, 203 bp, Homo sapiens
ggcgcgccagtcctccgcaggtgccgcggggggtggaccgcctaagagttttctaagatttcacatgccccgccgcgcgccattaaccgccagatttgaatcgcgggacccgttggcagaggtggcggcggcggcatgggtgccccgacgttgccccctgcctggcagccctttctcaaggaccaccgcgactcggaccgatg

SEQ ID NO: 12739 - DNA, 203 bp, Homo sapiens
ggcgcgccagtcctatatctaagccgctcaccccgccgttctcagcgcattatcgtagatgccgcgcgccctcccgccgccagtcccggcagcgccctcagttgtcctccgactcgccctcggccttccgcgccagccgcagccacagccgcaacgccacccgcagccacagccacagccacagcccccgactcggaccgatg

SEQ ID NO: 12740 - DNA, 203 bp, Homo sapiens
ggcgcgccagtccttacaggcagccgctcaccccgccgttctcagcgctgcccgaccccgctaatctattactgtaccgccagtcccggcagcgccctcagttgtcctccgactcgccctcggccttccgcgccagccgcagccacagccgcaacgccacccgcagccacagccacagccacagcccccgactcggaccgatg

SEQ ID NO: 12741 - DNA, 203 bp, Homo sapiens
ggcgcgccagtcctatttatgtgccgctcaccccgccgttctcagcgctgcccgaccccgctcgcgcgccctcccgccgccagtcccggcagcgccctcagttgattattataatattctcggccttccgcgccagccgcagccacagccgcaacgccacccgcagccacagccacagccacagcccccgactcggaccgatg

SEQ ID NO: 12742 - DNA, 203 bp, Homo sapiens
ggcgcgccagtccttagatttcgccgctcaccccgccgttctcagcgctgcccgaccccgctcgcgcgccctcccgccgccagtcccggcagcgccctcagttgtcctccgactcgccctcggccttccgcgccagccgcagccacagccgcaacgccacttagtttgttgttaacagccacagcccccgactcggaccgatg

SEQ ID NO: 12743 - DNA, 203 bp, Homo sapiens
ggcgcgccagtcctatagcgtagccgctcaccccgccgttctcagcgctgcccgaccccgctcgcgcgccctcccgccgccagtcccggcagcgccctcagttgtcctccgactcgccctcggccttccgcgccagccgcagccactaaacactgtttgtccgcagccacagccacagccacagcccccgactcggaccgatg

SEQ ID NO: 12744 - DNA, 203 bp, Homo sapiens
ggcgcgccagtcctcataacgcgccgctcaccccgccgttctcagcgctgcccgaccccgctcgcgcgccctcccgccgccagtcccggcagcgccctcagttgtcctccgactcgccctcggccttccgcgtattttcagcaactagccgcaacgccacccgcagccacagccacagccacagcccccgactcggaccgatg

SEQ ID NO: 12745 - DNA, 203 bp, Homo sapiens
ggcgcgccagtcctgtcgcagcgccgctcaccccgccgttctcagcgctgcccgaccccgctcgcgcgccctcccgttaagtccgggttgagcgccctcagttgtcctccgactcgccctcggccttccgcgccagccgcagccacagccgcaacgccacccgcagccacagccacagccacagcccccgactcggaccgatg

SEQ ID NO: 12746 - DNA, 203 bp, Homo sapiens
ggcgcgccagtcctgcacaggagccgctgtttttagacattgacgttgaccccgaaagcaggatggagctggagtgaggtggaggggccgcaagctgctgaccggcgtgtggaacactggtggtttgcagatcactgaggctggacaacgttcatggctctcgggtagaacctagtgaaacggccagacgactcggaccgatg

SEQ ID NO: 12747 - DNA, 203 bp, Homo sapiens
ggcgcgccagtcctctacgattgccgctgtttttcactgagctgccataccccgaaagcaggatggagctggagtgaggtggaggggccgcaagctgctgaccgcgtaacaattgtagggtggtttgcagatcactgaggctggacaacgttcatggctctcgggtagaacctagtgaaacggccagacgactcggaccgatg

SEQ ID NO: 12748 - DNA, 203 bp, Homo sapiens
ggcgcgccagtcctggcgggcagccgctgtttttcactgagctgccataccccgaaagcaggatggagctggagtgaggtggaggggccgcaagctgctgaccggcgtgtggaacactggtggtttgcagatcactgaggctggacgtgtgcaggactggtcgggtagaacctagtgaaacggccagacgactcggaccgatg

SEQ ID NO: 12749 - DNA, 203 bp, Homo sapiens
ggcgcgccagtcctattcaggggccgctgtttttcactgagctgccataccccgaaagcaggatggagctggagtgttcgtcgatatattcaagctgctgaccggcgtgtggaacactggtggtttgcagatcactgaggctggacaacgttcatggctctcgggtagaacctagtgaaacggccagacgactcggaccgatg

SEQ ID NO: 12750 - DNA, 203 bp, Homo sapiens
ggcgcgccagtcctactgtgcagccgctgtttttcactgagctgccataccccgaaagcaggtacttatgcactgaaggtggaggggccgcaagctgctgaccggcgtgtggaacactggtggtttgcagatcactgaggctggacaacgttcatggctctcgggtagaacctagtgaaacggccagacgactcggaccgatg

SEQ ID NO: 12751 - DNA, 203 bp, Homo sapiens
ggcgcgccagtcctgcttaacagccgctgtttttcactgagctgccatcagttatttattatatggagctggagtgaggtggaggggccgcaagctgctgaccggcgtgtggaacactggtggtttgcagatcactgaggctggacaacgttcatggctctcgggtagaacctagtgaaacggccagacgactcggaccgatg

SEQ ID NO: 12752 - DNA, 203 bp, Homo sapiens
ggcgcgccagtcctggttgaccgccggcagaggggcgctaggccgccctcgatcccctcgccgcggtcccatggaggaggaggcgagccgcagcgccgcggcgacgaacccagggagtaatggattaaatgcgccgcctcctgacaagcgggagggatccgcggtggacccagggaagcggaggagcccgactcggaccgatg

SEQ ID NO: 12753 - DNA, 203 bp, Homo sapiens
ggcgcgccagtcctcaatcattgccggccaagacagcacagacagattgacctattggggtgagcgaatgacaaccgagggaagcgccgcggcctgtatttctagacctgcccttcgcctggttcgtggcgccttgtgaccccgggcccctgccgcctgcaagtcggaaattgcgctgtgctcctgtgcgactcggaccgatg

SEQ ID NO: 12754 - DNA, 203 bp, Homo sapiens
ggcgcgccagtcctactcgctcgccggccaagacagcacagacagattgacctattggggtgtttcgcgagtgtgagagggaagcgccgcggcctgtatttctagacctgcccttcgcctggttcgtggcgccttgtgaccccgggagaaacggtaagctaagtcggaaattgcgctgtgctcctgtgcgactcggaccgatg

SEQ ID NO: 12755 - DNA, 203 bp, Homo sapiens
ggcgcgccagtcctgggaagctgccggccaagacagcacagacagattgacctattggggtgtttcgcgagtgtgagagggaagcgccgcggcctgtatttctagacctgcccttcgcctggttcgtggcgctaatgtgtagatttcccctgccgcctgcaagtcggaaattgcgctgtgctcctgtgcgactcggaccgatg

SEQ ID NO: 12756 - DNA, 203 bp, Homo sapiens
ggcgcgccagtcctgatggtgagccggccaagacagcacagacagattgacctattggggtgtttcgcgagtgtgagagggaagcgccgcggcctgtatttctagacctgcccttcgcgcaccaacacagaacttgtgaccccgggcccctgccgcctgcaagtcggaaattgcgctgtgctcctgtgcgactcggaccgatg

SEQ ID NO: 12757 - DNA, 203 bp, Homo sapiens
ggcgcgccagtcctgatcttatgccggccaagacagcacagacagattgacctattggggtgtttcgcgagtgtgagagggaagcgccgcttggaaagacaaaggacctgcccttcgcctggttcgtggcgccttgtgaccccgggcccctgccgcctgcaagtcggaaattgcgctgtgctcctgtgcgactcggaccgatg

SEQ ID NO: 12758 - DNA, 203 bp, Homo sapiens
ggcgcgccagtcctatcctaaggccggcggctggcggaggagggagggcgagggcgggcgcgaatgtagacttaatcggaagagggaggagaggcgcggggagccaggcctcggggcctcggagcaaccacccgagcagacggagtacacggagcagcggccccggccccgccaacgctgccgccgggcgactcggaccgatg

SEQ ID NO: 12759 - DNA, 203 bp, Homo sapiens
ggcgcgccagtcctcctcgcaagccggcggctggcggaggagggagggcgagggcgggcgcgggccggcgggcgggcggaagagggaggagaggcgcggggagccaggcctcggggcctcggagcaaccaccgcctgctcttagtaacacggagcagcggccccggccccgccaacgctgccgccgggcgactcggaccgatg

SEQ ID NO: 12760 - DNA, 203 bp, Homo sapiens
ggcgcgccagtcctttctgttggccgggaagactctacggggataatcataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcacccgactcggaccgatg

SEQ ID NO: 12761 - DNA, 203 bp, Homo sapiens
ggcgcgccagtcctgtgtcgtcgccgggaagactgggtcctttcttggataaacccactctatgcccggccatttgggcgtgcccccgcaagactgctagccgacacaaaaccctaaccgaaaggccttgtggtactgcctgatagggtgcttgcgagtgccccgggaggtctcgtagaccgtgcacccgactcggaccgatg

SEQ ID NO: 12762 - DNA, 203 bp, Homo sapiens
ggcgcgccagtcctaccgcacagccgggaagactgggtcctttcttggataaacccactctatgcccggccatttgggcgtgcccccgcaagactgctagccgagtagcgttgggttgcgaaaggccttgtgcagggcgtactattggtgcttgcgagtgccccgggaggtctcgtagaccgtgcacccgactcggaccgatg

SEQ ID NO: 12763 - DNA, 203 bp, Homo sapiens
ggcgcgccagtcctgagatggcgccgggaagactgggtcctttcttggataaacccactctatgcccggccatttgggcgtgcccccgcaagactgctagccgagtagcgttgggttgcgaaaggccttgtggtactgcctgatagggtgcttgcgagtgaaaaactgtacaatgtagaccgtgcacccgactcggaccgatg

SEQ ID NO: 12764 - DNA, 203 bp, Homo sapiens
ggcgcgccagtccttgaagagtgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctctcgcggaccatgtacgactcggaccgatg

SEQ ID NO: 12765 - DNA, 203 bp, Homo sapiens
ggcgcgccagtcctcttgacaggccgggaagactgggtcctttcttggataaacccactctatgcccggccatttgggcgtgcccccgcaagactgctagccgagtagcgttgggttgcgaaaggccttgtggtactgcctgatagtcataaacactagaccccgggaggtctcgtagaccgtgcacccgactcggaccgatg

SEQ ID NO: 12766 - DNA, 203 bp, Homo sapiens
ggcgcgccagtccttacgccctgccgggaagactgggtcctttcttgggacgcataggcaattgcccggccatttgggcgtgcccccgcaagactgctagccgagtagcgttgggttgcgaaaggccttgtggtactgcctgatagggtgcttgcgagtgccccgggaggtctcgtagaccgtgcacccgactcggaccgatg

SEQ ID NO: 12767 - DNA, 203 bp, Homo sapiens
ggcgcgccagtcctgacctgaagccgggatgaccaatgttgagtcgaaattaacccgctcaatgcccggaaatttgggcgtgcccccgcaagactgctagccgagtagtgttgggtcgcgaaaggccttgcggtactgcctgatagggtgcttgcgagtgccccgggaggtctcgtagaccgtgcacccgactcggaccgatg

SEQ ID NO: 12768 - DNA, 203 bp, Homo sapiens
ggcgcgccagtcctcccggaacgccgggatgaccgggtcctttcttggataaacccgctcaaactgaatgccccgcggcgtgcccccgcgagactgctagccgagtagtgttgggtcgcgaaaggccttgtggtactgcctgatagggtgcttgcgagtgccccgggaggtctcgtagaccgtgcacccgactcggaccgatg

SEQ ID NO: 12769 - DNA, 203 bp, Homo sapiens
ggcgcgccagtcctgcgcaacggccgggatgaccgggtcctttcttggataaacccgctcaatgcccggagatttgggcgtgcccccgcgagactgctagccgagtagtgttgggtcgcgaaaggccttgtgagctacgggacgttggtgcttgcgagtgccccgggaggtctcgtagaccgtgcacccgactcggaccgatg

SEQ ID NO: 12770 - DNA, 203 bp, Homo sapiens
ggcgcgccagtcctattacggagccgggatgaccgggtcctttcttggataaacccgctcaatgcccggagatttgggcgtgcccccgcgagactgctagccgagtagtgttgggtcgcgaaaggccttgtggtactgcctgatagtaatagcttagagaccccgggaggtctcgtagaccgtgcacccgactcggaccgatg

SEQ ID NO: 12771 - DNA, 203 bp, Homo sapiens
ggcgcgccagtcctccgtctatgccgggatgaccgggtcctttcttggataaacccgctcaatgcccggagatttgggcgtgcccccgcggatgatacgcgtcggtagtgttgggtcgcgaaaggccttgtggtactgcctgatagggtgcttgcgagtgccccgggaggtctcgtagaccgtgcacccgactcggaccgatg

SEQ ID NO: 12772 - DNA, 203 bp, Homo sapiens
ggcgcgccagtcctcgattccagccgggatgaccgggtcctttcttggattaacccgctcaatgcccggaaatttgccgcatgagtgaggagactgctagccgagtagtgttgggtcgcgaaaggccttgcggtactgcctgatagggtgcttgcgagtgccccgggaggtctcgtagaccgtgcacccgactcggaccgatg

SEQ ID NO: 12773 - DNA, 203 bp, Homo sapiens
ggcgcgccagtcctgtttgtctgccgggatgaccgggtcctttcttggattaacccgctcaatgcccggaaatttgggcgtgcccccgcaagactgctagccgagtagtgttgggtcgcgaaaggccttgcgcctgaaaagctgcaggtgcttgcgagtgccccgggaggtctcgtagaccgtgcacccgactcggaccgatg

SEQ ID NO: 12774 - DNA, 203 bp, Homo sapiens
ggcgcgccagtcctaacactacgccgggatgaccgggtcctttcttggattaacccgctcaatgcccggaaatttgggcgtgcccccgcaagactgctagccgagtagtgttgggtcgcgaaaggccttgcggtactgcctgatagggtgcttgcgagtgaaggacattaaaaagtagaccgtgcacccgactcggaccgatg

SEQ ID NO: 12775 - DNA, 203 bp, Homo sapiens
ggcgcgccagtcctcaattgtggccgggatgaccgggtcctttcttggattaacccgctcaatgcccggaaatttgggcgtgcccccgcaagactgctagccgagtagtgttgggtcggtgtttctacccacgtactgcctgatagggtgcttgcgagtgccccgggaggtctcgtagaccgtgcacccgactcggaccgatg

SEQ ID NO: 12776 - DNA, 203 bp, Homo sapiens
ggcgcgccagtcctatacatgagccgggatgaccgggtcctttcttggattaacccgctcaatgcccggaaatttgggcgtgcccccgcagttggtaactttttgtagtgttgggtcgcgaaaggccttgcggtactgcctgatagggtgcttgcgagtgccccgggaggtctcgtagaccgtgcacccgactcggaccgatg

SEQ ID NO: 12777 - DNA, 203 bp, Homo sapiens
ggcgcgccagtcctcgtgcagtgccgggatgaccgggtcctttcttggtggctgataggggttgcccggaaatttgggcgtgcccccgcaagactgctagccgagtagtgttgggtcgcgaaaggccttgcggtactgcctgatagggtgcttgcgagtgccccgggaggtctcgtagaccgtgcacccgactcggaccgatg

SEQ ID NO: 12778 - DNA, 203 bp, Homo sapiens
ggcgcgccagtccttgcgttaggccgggatgaccttaatagacacgatataaacccgctcaatgcccggagatttgggcgtgcccccgcgagactgctagccgagtagtgttgggtcgcgaaaggccttgtggtactgcctgatagggtgcttgcgagtgccccgggaggtctcgtagaccgtgcacccgactcggaccgatg

SEQ ID NO: 12779 - DNA, 203 bp, Homo sapiens
ggcgcgccagtcctcgaggtatgccgggccccggatcgcccttttgatctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 12780 - DNA, 203 bp, Homo sapiens
ggcgcgccagtccttagggcaagccgggccccggccgctgtccagccgctccgtgccccgcgcgtcctgcgccgccgccaccgcctcctggggagacgcagccaaggtatgctgtgctatactcccagggtcctgctctcggccgtcttcctcatcagttttctgtgggatttgcccggtttccagcacgactcggaccgatg

SEQ ID NO: 12781 - DNA, 203 bp, Homo sapiens
ggcgcgccagtcctcctcaaacgccgggccccggccgctgtccagccgctccgtgccccgcgcgtcctgcgccgccgccaccgcctcctggggagacgcagccacttgcccgccatggatactcccagggtcctgctctcggccgtcttcctcatcagttcctgaaattgcccccccggtttccagcacgactcggaccgatg

SEQ ID NO: 12782 - DNA, 203 bp, Homo sapiens
ggcgcgccagtcctatcacgctgccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 12783 - DNA, 203 bp, Homo sapiens
ggcgcgccagtcctttatttatgccgggccccggccgctgtccagccgctccgtgccccgcgcgtcctgcgccgccgccaccgcctcctggggagacgcagccacttgcccgccatggatactcccagggtcctgctctcggccgtgcatgcatcactcattctgtgggatttgcccggtttccagcacgactcggaccgatg

SEQ ID NO: 12784 - DNA, 203 bp, Homo sapiens
ggcgcgccagtcctcattgactgccgggccccggccgctgtccagccgctccgtgccccgcgcgtcctgcgccgccgccaccgcctcctggggagacgcagccacttgcccgccatggatactcccagggtcggtaatgtaataaacttcctcatcagttttctgtgggatttgcccggtttccagcacgactcggaccgatg

SEQ ID NO: 12785 - DNA, 203 bp, Homo sapiens
ggcgcgccagtcctctaatgatgccgggccccggccgctgtccagccgtgatcccgaggcttcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 12786 - DNA, 203 bp, Homo sapiens
ggcgcgccagtcctagcgacctgccgggggacgggtaaggggggggtgaagaaggggccggccttcaagcaagagccgttgtcctgttgcgccaccacgggctcgggagtaaaagtccctcgcaatttccgactgttggaagaactcgaagaaggccagaaaggagtaggagatggcacagttagctgcgactcggaccgatg

SEQ ID NO: 12787 - DNA, 203 bp, Homo sapiens
ggcgcgccagtccttttagctagccgggggacgggtaaggggggggtgaagaaggggccggccttcaagcaagagcgacgcaagatggcagccaccacgggctcgggagtaaaagtccaataggccgcgaatctgttggaagaactcgaagaaggccagaaaggagtaggagatggcacagttagctgcgactcggaccgatg

SEQ ID NO: 12788 - DNA, 203 bp, Homo sapiens
ggcgcgccagtcctgccgcggggccgggggacgggtaaggggggggtgaagaaggggccggccttcaagcaagagcgacgcaagatggcagccaccacgggctcgggagtaaaagtccctcgcaatttccgactgttggaagaactcgaagaaggccagaaaggagtaggagatggcacagttagctgcgactcggaccgatg

SEQ ID NO: 12789 - DNA, 203 bp, Homo sapiens
ggcgcgccagtcctagatcggggccgggggacgggtaaggggggggtgaagaaggggccggccttcaagcaagagcgacgcaagatggcagccaccacgggctcgggagtaaaagtccctcgcaatttccgactgttggaagaactcgaagaaggccagattctcaatatgtcgggcacagttagctgcgactcggaccgatg

SEQ ID NO: 12790 - DNA, 203 bp, Homo sapiens
ggcgcgccagtccttcgccaatgccgtattctgtgtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccgactcggaccgatg

SEQ ID NO: 12791 - DNA, 203 bp, Homo sapiens
ggcgcgccagtccttcacccgcgcctacgattcccgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagcgactcggaccgatg

SEQ ID NO: 12792 - DNA, 203 bp, Homo sapiens
ggcgcgccagtcctgagctagtgcctccccgtatataagacttcgccgagcgctctcactcgcacaagtggaccggggtgttgggtgctagtcggcaccagaggcaagggtgcgaggaccacggccggctcgataaccctgagtgacctagggggtggcagcgggcagtgcggggcggcaaggcgacccgactcggaccgatg

SEQ ID NO: 12793 - DNA, 203 bp, Homo sapiens
ggcgcgccagtcctaatacccggcctccccgtatataagacttcgccggcaagcaattagatcacaagtggaccggggtgttgggtgctagtcggcaccagaggcaagggtgcgaggaccacggccggctcggacgtgtgaccgcgcctagggggtggcagcgggcagtgcggggcggcaaggcgacccgactcggaccgatg

SEQ ID NO: 12794 - DNA, 203 bp, Homo sapiens
ggcgcgccagtcctgtgatctcgcctccctgctgagctcgcggctcacgctgagagggacacgcagtgacgagcggccgaagcagctttgcggtgagagcacgctgggccgggggccgccgaatcagtctagggcgggtaacgccggactcgagggttttgtagtgcatccctgagcatgagcacagacgactcggaccgatg

SEQ ID NO: 12795 - DNA, 203 bp, Homo sapiens
ggcgcgccagtcctaaacatacgcctccctgctgagctcgcggctcacgctgagagggacacgcagtgacgagcggccgaagcagctttgcggtgagagcacgctgggccgggggccgggcgggagcctggtggcgggtaacgccggactcgagggttttgtagtgcatccctggcgcactcactgaccgactcggaccgatg

SEQ ID NO: 12796 - DNA, 203 bp, Homo sapiens
ggcgcgccagtcctgcgtgtaagcctccctgctgagctcgcggctcacgctgagagggacacgcagtgacgagcggtgttcaatctgggccggtgagagcacgctgggccgggggccgggcgggagcctggtggcgggtaacgccggactcgagggttttgtagtgcatccctgagcatgagcacagacgactcggaccgatg

SEQ ID NO: 12797 - DNA, 203 bp, Homo sapiens
ggcgcgccagtcctgacaaaccgcctccctgctggctatattaggtcggctgagagggacacgcagtgacgagcggccgaagcagctttgcggtgagagcacgctgggccgggggccgggcgggagcctggtggcgggtaacgccggactcgagggttttgtagtgcatccctgagcatgagcacagacgactcggaccgatg

SEQ ID NO: 12798 - DNA, 203 bp, Homo sapiens
ggcgcgccagtcctctcgttgtgcctcctgacgacgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactaccgactcggaccgatg

SEQ ID NO: 12799 - DNA, 203 bp, Homo sapiens
ggcgcgccagtcctgtttccaagcctgacagccaggaccccaggcagcagcgagtgacaggacgtctggacccgcgcgccgctagcagctctgccgggccgcggcggtgatcgatgggactgattcactcatgacccagcgagtgagggcgcacagccgggacgccgaggcggcgggcgggagacccgcgactcggaccgatg

SEQ ID NO: 12800 - DNA, 203 bp, Homo sapiens
ggcgcgccagtcctttgctttagcctgacagccaggaccccaggcagcagcgagtgacaggacgtctggacccgcgcgccgctagcagctctgccgggccgcggcggtgatcgatggggagcggctggagcggacccagcgagtgagggcgcacagccggatttttttatttttgggcgggagacccgcgactcggaccgatg

SEQ ID NO: 12801 - DNA, 203 bp, Homo sapiens
ggcgcgccagtccttactaccagcctgacagccaggaccccaggcagcagcgagtgacaggacgtctggacccgcgcgccgctagcagctctgccgggccgcggcggtgatcgatggggagcggctggagcggacccagcgagtgagggcgcacagccgggacgccgaggcggcaaattaatcgattacgactcggaccgatg

SEQ ID NO: 12802 - DNA, 203 bp, Homo sapiens
ggcgcgccagtcctaactatcggcctggcaggcgcacgcgcccagcaccctgcctccggcgatgccgccccagcccctctgatggccctcctctctgctgccaccgcccatttcctgagaggcatgagcccggaacgcgcttgcttttaggagacagccactttctgtgtggtacgctggattcaaggcgactcggaccgatg

SEQ ID NO: 12803 - DNA, 203 bp, Homo sapiens
ggcgcgccagtcctccatgtttgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12804 - DNA, 203 bp, Homo sapiens
ggcgcgccagtcctaagtctgagcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtagcagaccgagctcacgactcggaccgatg

SEQ ID NO: 12805 - DNA, 203 bp, Homo sapiens
ggcgcgccagtcctctcagagagcctggcaggcgcacgcgcccagcaccctgcctccggcgatgccgccccagcccctctgatggccctcctctctgctgccactcattccagaacaggaggcatgagcccggaacgcgcttgcttttaggagacagccagcaagatatgtaagcgctggattcaaggcgactcggaccgatg

SEQ ID NO: 12806 - DNA, 203 bp, Homo sapiens
ggcgcgccagtcctagcagcttgcctggcaggcgcacgcgcccagcacgacagacgaataattgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12807 - DNA, 203 bp, Homo sapiens
ggcgcgccagtcctgtcattctgcctgtgtgagctgacaaacttagtagtgtttgtgaggattaacaacaattaacacagtgcgagctgtttcttagcacgaagatctcgatgtctaagaaaccaggagggcccggcaagagccggcgaccaggccctgcaaaacgcggaatgccccgcgtgttgtcccgactcggaccgatg

SEQ ID NO: 12808 - DNA, 203 bp, Homo sapiens
ggcgcgccagtcctctgcaatagcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgcaaatgagccatctgcgactcggaccgatg

SEQ ID NO: 12809 - DNA, 203 bp, Homo sapiens
ggcgcgccagtcctacttcgaagcctgtgtgagctgacaaacttagtagtgtttgtgaggattaacaacaattaacacagtgcgagctgtttcttagcacgaagatctcgatgtctaagaaaccaggagggcttccgcctttgattgctgtcaatatgctaaaacgcggaatgccccgcgtgttgtcccgactcggaccgatg

SEQ ID NO: 12810 - DNA, 203 bp, Homo sapiens
ggcgcgccagtcctctctgatcgcctgtgtgagctgacaaacttagtagtgtttgtgaggattaacaacaattaacacagtgcgagctgtttcttagcacgaagatctcgatgtctaattcttatcctactgccggcaagagccgggctgtcaatatgctaaaacgcggaatgccccgcgtgttgtcccgactcggaccgatg

SEQ ID NO: 12811 - DNA, 203 bp, Homo sapiens
ggcgcgccagtcctcaatgggtgccttacactccagagcaaatgtacggtgtcactctcgcagctgccacccgaccatgaccatcctgcaggccccgaccccggccccctccaccatcccgggaccccggcggggctccggtcctgagatcttcaccttcgaccctctcccggagcccgcagcggccccgactcggaccgatg

SEQ ID NO: 12812 - DNA, 203 bp, Homo sapiens
ggcgcgccagtcctgattcgccgccttacactccgctcggctcaccatgtgtcactctcgcacgacaattgtccgaatgaccatcctgcaggccccgaccccggccccctccaccatcccgggaccccggcggggctccggtcctgagatcttcaccttcgaccctctcccggagcccgcagcggccccgactcggaccgatg

SEQ ID NO: 12813 - DNA, 203 bp, Homo sapiens
ggcgcgccagtcctggatgggagccttacactccgctcggctcaccatgtgtcactctcgcagctgccacccgaccatgaccatcctgcaggccccgaccccggatgggcgacgttcaccgggaccccggcggggctccggtcctgagatcttcaccttcgaccctctcccggagcccgcagcggccccgactcggaccgatg

SEQ ID NO: 12814 - DNA, 203 bp, Homo sapiens
ggcgcgccagtcctcgatagatgccttacactccgctcggctcaccatgtgtcactctcgcagctgccacccgaccatgaccatcctgcaggccccgaccccggccccctccaccatcagttcctattcatcgggctccggtcctgagatcttcaccttcgaccctctcccggagcccgcagcggccccgactcggaccgatg

SEQ ID NO: 12815 - DNA, 203 bp, Homo sapiens
ggcgcgccagtcctttcatcgcgccttacactccgctcggctcaccatgtgtcactctcgcagctgccacccgaccatgaccatcctgcaggccccgaccccggccccctccaccatcccgggaccccggcggggctccggtcctgagatcttcaccttcattgacgggggtctgcccgcagcggccccgactcggaccgatg

SEQ ID NO: 12816 - DNA, 203 bp, Homo sapiens
ggcgcgccagtcctaccaactggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggccccgactcggaccgatg

SEQ ID NO: 12817 - DNA, 203 bp, Homo sapiens
ggcgcgccagtcctaatcacttgcgaaccacgtctccggcagcctccagacagtttcttccgcttcctgtaccacccggctcaagtagcggacacggaacagggaactatcagcccgtcggcctccgggccctgcattctctagccatggaccgggaccttttgcggcagtcgctaaattgccacgggcgactcggaccgatg

SEQ ID NO: 12818 - DNA, 203 bp, Homo sapiens
ggcgcgccagtccttgtttaacgcgacatgaagtgcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctgacatccgactcggaccgatg

SEQ ID NO: 12819 - DNA, 203 bp, Homo sapiens
ggcgcgccagtcctagttcctcgcgactagcctcccaagccagccacccagggcgagtcatcgacccaaaaggtcagaccgtctcacacaaacaatcccaagtactccgcgatggtgatccccctttttttaggaactgaaaccacggccctgacgtccctcccccctaggaacaggaacagctctcccgactcggaccgatg

SEQ ID NO: 12820 - DNA, 203 bp, Homo sapiens
ggcgcgccagtcctcctggacagcgactagcctcccaagccagccacccagggcgagtcatcgacccaaaaggtcagaccgtctcacacatcagccttggtcccaaggctctgacgtctccccctttttttaggaactgaaaccacggccctgacgtccctcccccctaggaacaggaacagctctcccgactcggaccgatg

SEQ ID NO: 12821 - DNA, 203 bp, Homo sapiens
ggcgcgccagtcctaactgattgcgagttggactgtgaagaaacatggcggccgcgacgttgacttcgaaattgtactccctgctgttccagtatcggattgtattcgccctcaccatcatcgtgggcgtcatgttcttcgagcgcgccttcgatcaaggcgcggacgctatctacgaccacatcaaccgactcggaccgatg

SEQ ID NO: 12822 - DNA, 203 bp, Homo sapiens
ggcgcgccagtcctttacctacgcgagttggactgtgaagaaacatggcggccgcgacgttgacttcgaaattgtactccctgctgttccgcaggacctccaccgctcaagattagggcatcgtgggcgtcatgttcttcgagcgcgccttcgatcaaggcgcggacgctatctacgaccacatcaaccgactcggaccgatg

SEQ ID NO: 12823 - DNA, 203 bp, Homo sapiens
ggcgcgccagtcctaacgcggcgcgagttggactgtgaagaaacatggcggccgcgacgttgacttcgaaattgtactccctgctgttccgcaggacctccaccttcgccctcaccattcaacgttctaatgtgttcttcgagcgcgccttcgatcaaggcgcggacgctatctacgaccacatcaaccgactcggaccgatg

SEQ ID NO: 12824 - DNA, 203 bp, Homo sapiens
ggcgcgccagtcctgatccagagcgagttggactgtgaagaaacatggcggccgcgacgttggtcgaagttcgtgcctccctgctgttccgcaggacctccaccttcgccctcaccatcatcgtgggcgtcatgttcttcgagcgcgccttcgatcaaggcgcggacgctatctacgaccacatcaaccgactcggaccgatg

SEQ ID NO: 12825 - DNA, 203 bp, Homo sapiens
ggcgcgccagtcctcccatttggcgagttggacttaatctggtgggtacggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaaccgactcggaccgatg

SEQ ID NO: 12826 - DNA, 203 bp, Homo sapiens
ggcgcgccagtcctgtcgtcaagcgcccgggggccatgcgggtgagccgcggctgcagaggcctgagcgcctgatcgccgcggacccgagccgagcccacccccctccccagccccccgttgatatgtactaggcggcgcgctcgatctacgcgtccggggccccgcggggccgggcccggagtcggccgactcggaccgatg

SEQ ID NO: 12827 - DNA, 203 bp, Homo sapiens
ggcgcgccagtcctctactgcggcgccggtaagtaagtacttgattttggtacctcgcgaggcaaatcatcctggtgagtggcgggacgctgccgggaagctccacctccgctcagcaggggacgccctggtctgagctctgtggtatctgattgttgttgaaccgtctctaagacggtgatactatacgactcggaccgatg

SEQ ID NO: 12828 - DNA, 203 bp, Homo sapiens
ggcgcgccagtccttacataacgcgccggtaagtaagtacttgattttggtacctcgcgagggtttgggaggatcgcctcccgctttacgtgccgggaagctccacctccgctcagcaggggacgccctggtctgagctctgtggtatctgattgttgttgaaccgtctctaagacggtgatactatacgactcggaccgatg

SEQ ID NO: 12829 - DNA, 203 bp, Homo sapiens
ggcgcgccagtcctaatggtcggcgccggtaagtaagtacttgattttggtacctcgcgagggtttgggaggatcggagtggcgggacgctgccgggaagctccacctccgctcagcaggggacgccctggtctgagctctgtggtatctgattgttgttgaaccgtctctaagacggtgatactatacgactcggaccgatg

SEQ ID NO: 12830 - DNA, 203 bp, Homo sapiens
ggcgcgccagtcctgaatgttagcgccggtaagtaagtacttgattttggtacctcgcgagggtttgggaggatcggagtggcgggacgctgccgggaagctccacctccgctcagcaggggacgccctggtctgagctctgtggtatctgattgttgttgaaccgtctctaagtaaagctccggcctcgactcggaccgatg

SEQ ID NO: 12831 - DNA, 203 bp, Homo sapiens
ggcgcgccagtccttggtgtccgcgcctgctgctgagcagatgcagtagccgaaactgcgcggaggcacagaggccggggagagcgttctgggtccgagggtccaggtaggggttgagccaccatctgaccgatgcgattcgaaaatcgccggttctgcaggcaccatgagccaggacaccgaggtggcgactcggaccgatg

SEQ ID NO: 12832 - DNA, 203 bp, Homo sapiens
ggcgcgccagtccttaaggaacgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggcgactcggaccgatg

SEQ ID NO: 12833 - DNA, 203 bp, Homo sapiens
ggcgcgccagtcctgtttaaaggcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccattcggttcgatacacgactcggaccgatg

SEQ ID NO: 12834 - DNA, 203 bp, Homo sapiens
ggcgcgccagtcctatcccgtggcgcctgctgctgagcagatgcagtagccgaaactgcgcggaggcacagaggccggggagagcgttctgggtccgagggtccaggtaggggttgaggactttctaatggacaagctgcgtcgtgtcgccggttctgcaggcaccatgagccaggacaccgaggtggcgactcggaccgatg

SEQ ID NO: 12835 - DNA, 203 bp, Homo sapiens
ggcgcgccagtcctatgttccagcgcctgctgcttgcgcagacgcaccgccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggcgactcggaccgatg

SEQ ID NO: 12836 - DNA, 203 bp, Homo sapiens
ggcgcgccagtcctaatgctatgcgcgcccgacctccatcttcccggggccgcgccgcgcgcgcgcgcgggctttgggcgggaccctgcagaggcggcggggctccagtgggggctcctcctcggcctccccttcgggcgctctcgcgctaactgtgctcctccggggccctccgccacacgagagcccgactcggaccgatg

SEQ ID NO: 12837 - DNA, 203 bp, Homo sapiens
ggcgcgccagtccttactctatgcgctgcaaggacaaccggctggggtccttgcgcgccgcgcgaagtcccaatcaaccgactgcgccgcgtaagtgccgcctgccctgcgtgggtcgtgccagctcagcgggacaggtcctcgcctcggtccctcggacttagggagcgcggggcagaccctgagagcgactcggaccgatg

SEQ ID NO: 12838 - DNA, 203 bp, Homo sapiens
ggcgcgccagtccttagttgaggcgctgcaaggacaaccggctggggtccttgcgcgccgcggctcagggaggagcaccgactgcgccgcgtaagtgccgcctgccctgcgtgggtcgtgccagctcagcggccacctaaagaaaatcggtccctcggacttagggagcgcggggcagaccctgagagcgactcggaccgatg

SEQ ID NO: 12839 - DNA, 203 bp, Homo sapiens
ggcgcgccagtcctccacccttgcgctgcaaggacaaccggctggggttgcgctattggtttgctcagggaggagcaccgactgcgccgcgtaagtgccgcctgccctgcgtgggtcgtgccagctcagcgggacaggtcctcgcctcggtccctcggacttagggagcgcggggcagaccctgagagcgactcggaccgatg

SEQ ID NO: 12840 - DNA, 203 bp, Homo sapiens
ggcgcgccagtcctgccaagatgcgctggcctgctgccccggcgggtccgccggccggaggcgggagtcacaggaatgaatacgtgatgcaggaggcctcggcggatcaggacagctgcaggcttctgccaggtgggtgtgcagactggtgagctgccagcaggggcccagacgcgccaggcctggagcgactcggaccgatg

SEQ ID NO: 12841 - DNA, 203 bp, Homo sapiens
ggcgcgccagtccttccaaacggcgcttaagaggagggtcgggctcggccggggagtcccagtggcggaggctacgaaacttgggggagtgcacagaagaacttcgggagcgcacgcgggaccagggaccaggctgagactcggggcgccagtccgggcacccaggaatcagtacggccggagatgcccgactcggaccgatg

SEQ ID NO: 12842 - DNA, 203 bp, Homo sapiens
ggcgcgccagtcctaggaggtggcgcttaagaggagggtcgggctcggccggggagtcccagtggcggaggctacgtgtgcaatcatccggcacagaagaacttcgggagcgcacgcgggaccagggaccaggctgagactcggggcgccagtccgggcaggggcagcgggagccggccggagatgcccgactcggaccgatg

SEQ ID NO: 12843 - DNA, 203 bp, Homo sapiens
ggcgcgccagtcctgggcatcagcggaagcggcggcggcggcgaaggcaatcaagaaatctcctggagggccgggcaccgcggccatggagggtcaacgctggctgccgctggaggccaatcccgaggtcaccaaccagtttcttaaacaattaggtctacatcctaactggcaattcgttgatgtatcgactcggaccgatg

SEQ ID NO: 12844 - DNA, 203 bp, Homo sapiens
ggcgcgccagtccttaccgcaggcggaagcggcggcggcggcgaaggcggcggctgtcagagacctgtaatgctcgaccgcggccatggagggtcaacgctggctgccgctggaggccaatcccgaggtcaccaaccagtttcttaaacaattaggtctacatcctaactggcaattcgttgatgtatcgactcggaccgatg

SEQ ID NO: 12845 - DNA, 203 bp, Homo sapiens
ggcgcgccagtcctacttgggtgcggaagcggcggcggcggcgaaggcggcggctgtcagagctggagggccgggcaccgcggccatggagggtcaacgctggctgccgctggaggccaatcccgaggtcacgtcatgccacaactaacaattaggtctacatcctaactggcaattcgttgatgtatcgactcggaccgatg

SEQ ID NO: 12846 - DNA, 203 bp, Homo sapiens
ggcgcgccagtcctggttagtcgcggcactaaaacagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgcgactcggaccgatg

SEQ ID NO: 12847 - DNA, 203 bp, Homo sapiens
ggcgcgccagtccttcaccgctgcggcggcgggaccggcagcagcagcagcagcagcagcagcaaccactagcctcctgccccgcggcgcccttcgtatgcggtcacgagccgctcaccccgccgttctcagcgctgcccgaccccgctcgcgcgccctcccgccgccagtcccggcagcgccctcagcgactcggaccgatg

SEQ ID NO: 12848 - DNA, 203 bp, Homo sapiens
ggcgcgccagtcctgatgccaggcggcggcgggaccggcagcagcagcagcagcagcagcagcaaccactagcctcctgccccgcggcgctgccgcacgagccccacgagccgctcaccccgccgttctcaggatgctgtcggtgagctcgcgcgccctcccgccgccagtcccggcagcgccctcagcgactcggaccgatg

SEQ ID NO: 12849 - DNA, 203 bp, Homo sapiens
ggcgcgccagtcctccagaaccgcggcggtggtggtggtggcggcggcggcggcgaagggggcggagaggaaggagcgcggcgggaccgggccgggacagcgcgcggccctcctggtaggattcgctccgcgcccgcggttgtagcagctgccgctgcagccatagcagcaggtcagtcattggcacccgactcggaccgatg

SEQ ID NO: 12850 - DNA, 203 bp, Homo sapiens
ggcgcgccagtcctagaaccgagcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagtatcgctttagtcacagtcattggcacccgactcggaccgatg

SEQ ID NO: 12851 - DNA, 203 bp, Homo sapiens
ggcgcgccagtcctagcctggggcggcggtggtggtggtggcggcggcggcggcgaagggggcggagaggaaggagcgcggcgggaccgggccgggacagcgcgtactttgggctccgggattcgctccgcgttatattgccagtgagctgccgctgcagccatagcagcaggtcagtcattggcacccgactcggaccgatg

SEQ ID NO: 12852 - DNA, 203 bp, Homo sapiens
ggcgcgccagtcctggtccgtggcggctggagcggacccagcgagtgagggcgcacagccgggacgccgaggcggcgggcgggagacccgagaagtgcaccatcgccctcggcgggacgtgacgcagcgcccggggcgcgggtgtatttgatatagtgtttgcaacaaattcgacccaggtgatcaaacgactcggaccgatg

SEQ ID NO: 12853 - DNA, 203 bp, Homo sapiens
ggcgcgccagtcctccgctgccgcggctggagcggacccagcgagtgatcctatcagtaatagacgccgaggcggcgggcgggagacccgcaccagcgcagccggccctcggcgggacgtgacgcagcgcccggggcgcgggtgtatttgatatagtgtttgcaacaaattcgacccaggtgatcaaacgactcggaccgatg

SEQ ID NO: 12854 - DNA, 203 bp, Homo sapiens
ggcgcgccagtcctgtggaccagcgggcgacactctcgggctcgcgcaagatagagcatgatcggcgcccgaggcctcgcgcgcccggagttgctggttctgtgaggtagcggcggcaacgaccatggaggccacgtcccgggaggcggcgccagcgaagagctcggcctcgggccccaacgctcccccgactcggaccgatg

SEQ ID NO: 12855 - DNA, 203 bp, Homo sapiens
ggcgcgccagtcctgcacctcagcgggcgacactctcgggctcgcgcacctccccaagatggcggcgcccgaggcctcgcgcgcccggagttgctggttctgtgaggtagcggcggcatgcggttatagcaacacgtcccgggaggcggcgccagcgaagagctcggcctcgggccccaacgctcccccgactcggaccgatg

SEQ ID NO: 12856 - DNA, 203 bp, Homo sapiens
ggcgcgccagtcctattcccatgcgggcgcggggctgaaggcggaaccacgacgggcagagagcacggagccgggaagcccctgggcgcccgtcggagggctatggagcagcggccgcggggctgcgcggcgagatgccacaatagcctcctggtgctgctgggggcccgggcccagggcggcactcgcgactcggaccgatg

SEQ ID NO: 12857 - DNA, 203 bp, Homo sapiens
ggcgcgccagtcctattgtcttgcgggcgggccccgtccatcctcagcgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtggcgactcggaccgatg

SEQ ID NO: 12858 - DNA, 203 bp, Homo sapiens
ggcgcgccagtcctgttgtaacgcgggcgggcccgcagtcctgcagttgcagtcgtgttctccgagttcctgtctctctgccaacgccgcccggatggcttcccaaaaccgcgacccacagcaacaacttcacgccgccgcccgtaaaggagctgagccgagcgggggcgccgcccggggtccggtggcgactcggaccgatg

SEQ ID NO: 12859 - DNA, 203 bp, Homo sapiens
ggcgcgccagtcctgcgcatgcgcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtggcgactcggaccgatg

SEQ ID NO: 12860 - DNA, 203 bp, Homo sapiens
ggcgcgccagtcctccagctacgcgggcgggcccgcagtcctgcagttgcagtcgtgttctccgagttcctgtctctctgccaacgccgcgtaatgataacttgaaaaccgcgacccagccgccactagcgtcgccgccgcccgtaaaggagctgagccgagcgggggcgccgcccggggtccggtggcgactcggaccgatg

SEQ ID NO: 12861 - DNA, 203 bp, Homo sapiens
ggcgcgccagtcctaccagttagcggggctgggaagtagtcgggcggggttgtgagacgccgcgctcagcttccatcgctgggcggtcaacaagtgcgggcctgctcagcaagctttaggcgcggagaccgcgaggcgaccgggagcggctgggttcccggctgcgcgcccttcggccaggccgggagcgactcggaccgatg

SEQ ID NO: 12862 - DNA, 203 bp, Homo sapiens
ggcgcgccagtcctgtgtttaggcggggctgggaagtagtcgggcggggttgtgagacgccgcgctcagcttccatcgctgggcggtcaacaagtgcgggcctggctcagcgcgggggggcgcggagaccgcatcttctaataagtcggctgggttcccggctgcgcgcccttcggccaggccgggagcgactcggaccgatg

SEQ ID NO: 12863 - DNA, 203 bp, Homo sapiens
ggcgcgccagtcctatgggctggcggggctgggaagtagtcgggcggggttgtgagacgccgcgctcagcttccatgttgtccgtcaacgcaagtgcgggcctggctcagcgcgggggggcgcggagaccgcgaggcgaccgggagcggctgggttcccggctgcgcgcccttcggccaggccgggagcgactcggaccgatg

SEQ ID NO: 12864 - DNA, 203 bp, Homo sapiens
ggcgcgccagtccttgcttgtggcggggctgggatcacaagttcgacagttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagcgactcggaccgatg

SEQ ID NO: 12865 - DNA, 203 bp, Homo sapiens
ggcgcgccagtcctaggcgtacgcgggtggacgctttttggagatctagatcattactatatgtgtctcctataatcacatcataggagtgaaccataatacacatctttgggtaggggaaggaaagtattgttgacgtactgattgatctgcttgagtcaaataatcagtcataacaattcaagaaacgactcggaccgatg

SEQ ID NO: 12866 - DNA, 203 bp, Homo sapiens
ggcgcgccagtcctaaccgacggcgggtgtaggattagtgtcatgaattagtgtttcaaatcagttgcatatcaattaagaaaaacttaggagacaggtatagaacctctctttcagataactggtcaattaaggacagaaattctgtttctcaaatccgctagcctttgtcaaagaggacacaagcacgactcggaccgatg

SEQ ID NO: 12867 - DNA, 203 bp, Homo sapiens
ggcgcgccagtcctcgagatgcgcggtccctgaggggcgggcggggcccgaccggcgctctgtgtggccgaggccacatcaagaactttacccggctaggccccgggcggctctagcccagggcggcccgcggggcgctgggcctggctcccggctccggtttccgggccggcgggtggccgctcacccgactcggaccgatg

SEQ ID NO: 12868 - DNA, 203 bp, Homo sapiens
ggcgcgccagtcctcaagttgagcgtagccgagacacacgcatggtgctccggaggcggcggcgggtgagctcaacttcgcacagcccttcccagctccagccccggctggcccggcacttctcggagggtcccggcagccgggaccagtgagtgcctctacggaccagcgccccggcgggcgggaagcgactcggaccgatg

SEQ ID NO: 12869 - DNA, 203 bp, Homo sapiens
ggcgcgccagtcctgtctgagtgcgtagccgagatcaggcgtacagagtccggaggcggcggcgggtgagctcaacttcgcacagcccttcccagctccagccccggctggcccggcacttctcggagggtcccggcagccgggaccagtgagtgcctctacggaccagcgcccatagctataatttacgactcggaccgatg

SEQ ID NO: 12870 - DNA, 203 bp, Homo sapiens
ggcgcgccagtccttattaagtgcgtattcaacaaggggctgaaggatgcccagaaggtaccaggaaccgaatttactgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 12871 - DNA, 203 bp, Homo sapiens
ggcgcgccagtcctaggctcttgcgtattcaacaaggggctgaaggatgcccagaaggtaccccattgtatgggatctgatctggggcctacaattcagcaggatacatgtgtttagtcgaggttaaaaaacgtctaggccccccgaaccacggggacgtggttttcctttgaaaaacacgatgataacgactcggaccgatg

SEQ ID NO: 12872 - DNA, 203 bp, Homo sapiens
ggcgcgccagtcctatgcgcaagcgtccggaaagctcagccgtgattgcacaagagagctacaagagcctggaagaagctgaagactgctaccctccatccttactcaccctggacctgagagacctcttcaatcaggtggagcaaggccctctcctgtcctgccccaaggctggcacagacttgagccgactcggaccgatg

SEQ ID NO: 12873 - DNA, 203 bp, Homo sapiens
ggcgcgccagtccttgttcgcagcgtccggaaagtcagtagaattcatcacaagagagctacaagagcctggaagaagctgaagactgctaccctccatccttactcaccctggacctcctcactgagggatatcaggtggagcaaggccctctcctgtcctgccccaaggctggcacagacttgagccgactcggaccgatg

SEQ ID NO: 12874 - DNA, 203 bp, Homo sapiens
ggcgcgccagtcctgctacggtgcgtccggaaagtcagtagaattcatcacaagagagctacaagagcctggaagaagctgaagactgctaccctccatccttactcaccctggacctgagagacctcttcaatcaggtggagcaaggccctctcctgtcctgccccaaggctggcacagacttgagccgactcggaccgatg

SEQ ID NO: 12875 - DNA, 203 bp, Homo sapiens
ggcgcgccagtcctcatttaaagcgtccggaaagtcagtagaattcatcacaagagagctacaagagcctggaagaagctgaagactgctaccctccatccttactcaccctggacctgagagacctcttcaatcaggtggagcaatcatactcaactgactgccccaaggctggcacagacttgagccgactcggaccgatg

SEQ ID NO: 12876 - DNA, 203 bp, Homo sapiens
ggcgcgccagtcctaatcgaacgcgtccggaaagtcagtagaattcatcacaagagagctacaagagcctggaagaagctgaagactgctcttgagacgagccgctcaccctggacctgagagacctcttcaatcaggtggagcaaggccctctcctgtcctgccccaaggctggcacagacttgagccgactcggaccgatg

SEQ ID NO: 12877 - DNA, 203 bp, Homo sapiens
ggcgcgccagtccttaaatggtgcgtccggaaagtcagtagaattcatggttgatctcagcaaagagcctggaagaagctgaagactgctaccctccatccttactcaccctggacctgagagacctcttcaatcaggtggagcaaggccctctcctgtcctgccccaaggctggcacagacttgagccgactcggaccgatg

SEQ ID NO: 12878 - DNA, 203 bp, Homo sapiens
ggcgcgccagtcctgggaaatcgcgtgcttaggcttttgaagatggcttcattttggtgggattctcagattggccgcaactggagcccatcctgtttgtctttatttttattttctactccctaactctctttggcaacaccatcatcatcgctctctcctggctagaccttcggctgcacacacctcgactcggaccgatg

SEQ ID NO: 12879 - DNA, 203 bp, Homo sapiens
ggcgcgccagtccttcctcttagcgttactcgacagaggagagcaagaaatggagccagtagatcctagactagagccctggaagcatccaggaagtcagcctaaaactgcttgtaccaattgctattgtaacgctctactgcgctattgccaagtttgtttcataacaaaagccttaggcatctcctcgactcggaccgatg

SEQ ID NO: 12880 - DNA, 203 bp, Homo sapiens
ggcgcgccagtcctgcccagtggctatcggacctcgcttaggactcccattcccatggagaaactcctagatgaggcatcatgagtgcaagggccttataacttaaccgtcggcagttgggtaagagaccacgtccgatcaattgtcgagggcgcgtgggaagtgcgcgatgttgttaccgctgcccacgactcggaccgatg

SEQ ID NO: 12881 - DNA, 203 bp, Homo sapiens
ggcgcgccagtcctttcggcacgctatcggacctcgcttaggactcccattcccatggagaaactcctagatgaggttcttgcccccggtgggccttataacttaaccgtcggcagttattgctctcgtagggtccgatcaattgtcgagggcgcgtgggaagtgcgcgatgttgttaccgctgcccacgactcggaccgatg

SEQ ID NO: 12882 - DNA, 203 bp, Homo sapiens
ggcgcgccagtcctcattctcagctatcggacctcgcttaggactcccattcccatggagaaactcctagatgaggttcttgcccccggtgggccttataacttaaccgtcggcagttgggtaagagaccacgtccgatcaattgtcgagggcgcgtgggaagtgcgcgatgttagactgcaacgggtcgactcggaccgatg

SEQ ID NO: 12883 - DNA, 203 bp, Homo sapiens
ggcgcgccagtcctcggaacaagctatcggacctcgcttaggactcccattcccatggagaaactcctagatgaggttcttgcccccggtgggccttataacttaaccgtcggcagttgggtaagagaccacgtccgatcaattgtttttctgcacacaaaagtgcgcgatgttgttaccgctgcccacgactcggaccgatg

SEQ ID NO: 12884 - DNA, 203 bp, Homo sapiens
ggcgcgccagtcctggatcaaggctatcggacctcgcttaggactcccattcccatggagaaactcctagatgaggttcttgcccccggtgggccttataacttcttaagactggaccgggtaagagaccacgtccgatcaattgtcgagggcgcgtgggaagtgcgcgatgttgttaccgctgcccacgactcggaccgatg

SEQ ID NO: 12885 - DNA, 203 bp, Homo sapiens
ggcgcgccagtcctatgcttgggctatcggacctcgcttaggactcccattcccatggagaaggcgtggacgacccttcttgcccccggtgggccttataacttaaccgtcggcagttgggtaagagaccacgtccgatcaattgtcgagggcgcgtgggaagtgcgcgatgttgttaccgctgcccacgactcggaccgatg

SEQ ID NO: 12886 - DNA, 203 bp, Homo sapiens
ggcgcgccagtcctaagaatgcgctatcggacctcgcttaggactccctccgtagcctccttactcctagatgaggttcttgcccccggtgggccttataacttaaccgtcggcagttgggtaagagaccacgtccgatcaattgtcgagggcgcgtgggaagtgcgcgatgttgttaccgctgcccacgactcggaccgatg

SEQ ID NO: 12887 - DNA, 203 bp, Homo sapiens
ggcgcgccagtcctgtgttcgtgctattttgcttccctattcagtctcccgtggcaaggaggtgtacagccctgactttcatagcctcggaggagaaggtcttggtggccgacaagtctggagacgtctactccttttcggtgctggagccacacgggtgtggccgtctagagctggggcacctgtctcgactcggaccgatg

SEQ ID NO: 12888 - DNA, 203 bp, Homo sapiens
ggcgcgccagtcctcgcagaatgctattttgctttaaccgatgacagaccgtggcaaggagggacgtgttggctcatttcatagcctcggaggagaaggtcttggtggccgacaagtctggagacgtctactccttttcggtgctggagccacacgggtgtggccgtctagagctggggcacctgtctcgactcggaccgatg

SEQ ID NO: 12889 - DNA, 203 bp, Homo sapiens
ggcgcgccagtcctgggcgcgtgctattttgctttaaccgatgacagaccgtggcaaggaggtgtacagccctgaccgcgtagaggaaccaggagaaggtcttggtggccgacaagtctggagacgtctactccttttcggtgctggagccacacgggtgtggccgtctagagctggggcacctgtctcgactcggaccgatg

SEQ ID NO: 12890 - DNA, 203 bp, Homo sapiens
ggcgcgccagtccttaacgcccgctattttgctttaaccgatgacagaccgtggcaaggaggtgtacagccctgactttcatagcctcggaggagaaggtcttggtggccgacaagtctggagacgtctactccttttcggtgctggagccacacgggtgtggccgtctagagctggggcacctgtctcgactcggaccgatg

SEQ ID NO: 12891 - DNA, 203 bp, Homo sapiens
ggcgcgccagtcctcgtacgatgctattttgctttaaccgatgacagaccgtggcaaggaggtgtacagccctgactttcatagcctcgggaagcccacagcgcgtggccgacaagtctggagacgtctactccttttcggtgctggagccacacgggtgtggccgtctagagctggggcacctgtctcgactcggaccgatg

SEQ ID NO: 12892 - DNA, 203 bp, Homo sapiens
ggcgcgccagtcctgcgggtgggctattttgctttaaccgatgacagaggtcccagtcatcatgtacagccctgactttcatagcctcggaggagaaggtcttggtggccgacaagtctggagacgtctactccttttcggtgctggagccacacgggtgtggccgtctagagctggggcacctgtctcgactcggaccgatg

SEQ ID NO: 12893 - DNA, 203 bp, Homo sapiens
ggcgcgccagtcctgaggcaccgctcagcgcgggaatataaacgagatgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgcgactcggaccgatg

SEQ ID NO: 12894 - DNA, 203 bp, Homo sapiens
ggcgcgccagtccttcctttgcgctcagcgcgggggggcgcggagaccgcgaggcgaccgggagcggctgggttcctcttcctatttttctcggccaggccgggagccgcgccagtcggagcccccggcccagcgtggtccgcctccctctgggcgtccacctgcccggagtactgccagcgggcatgcgactcggaccgatg

SEQ ID NO: 12895 - DNA, 203 bp, Homo sapiens
ggcgcgccagtcctttaggttcgctcatctttgcggggttagctagccaaatctgtagccggtccttggcaagacagtagcttagagaaacgagatcgaatgcacccggaaggtggccaatttgtgcctcaactccttggccatctcctggctaccaaactcaagcgtttcctccttagcaaaggcggcgactcggaccgatg

SEQ ID NO: 12896 - DNA, 203 bp, Homo sapiens
ggcgcgccagtcctggttccctgctcatctttgcggggttagctagccgttgagtccaagtcggacaccaggaacagtagcttagagaaacgagatcgaatgcacccggaaggtggccaatttgtgcctcaactccttggccatctcctggctaccaaactcaagcgtttccgttgggaattgggcggcgactcggaccgatg

SEQ ID NO: 12897 - DNA, 203 bp, Homo sapiens
ggcgcgccagtccttgctgctagctcatctttgcggggttagctagccgttgagtccaagtctccttggcaagacagtagcttagagaaacgagatcgaatgcaaggactccccaaagaatttgtgcctcaactccttggccatctcctggctaccaaactcaagcgtttcctccttagcaaaggcggcgactcggaccgatg

SEQ ID NO: 12898 - DNA, 203 bp, Homo sapiens
ggcgcgccagtcctcactgcatgctcatctttgcggggttagctagccgttgagtccaagtctccttggcaagacagtagcttagagaaacgagatcgaatgcacccggaaggtggccaatttgtgcctcaactccttggccatctcctggctaccaaactcaagcgtttcctcagagctgttctttccgactcggaccgatg

SEQ ID NO: 12899 - DNA, 203 bp, Homo sapiens
ggcgcgccagtcctaagggcgtgctcatctttgcggggttagctagccgttgagtccaagtctccttggcaagacagtagcttagagaaacgagatcgaatgcacccggaaggtggccaatttgtgcctcaactccttggccatcttaattgggtagctgtcaagcgtttcctccttagcaaaggcggcgactcggaccgatg

SEQ ID NO: 12900 - DNA, 203 bp, Homo sapiens
ggcgcgccagtcctagatatcagctcatctttgcggggttagctagccgttgagtccaagtctccttggcaagacagtagcttagagaaacgagatcgaatgcacccggaaggtggccaatttgtgcctcaagcagcataggtgtccctggctaccaaactcaagcgtttcctccttagcaaaggcggcgactcggaccgatg

SEQ ID NO: 12901 - DNA, 203 bp, Homo sapiens
ggcgcgccagtcctttgctaacgctccgcggcggctgcgaaggcggcggctcctgccctctcgctttccctctcgcgtctctggctgcagaaagaagcttccgggcagtcaccttacaaggtgccatttccctctctgttgaagcaaaggccggggcagacctcctagtgaaaggaaagcaagccaggcgactcggaccgatg

SEQ ID NO: 12902 - DNA, 203 bp, Homo sapiens
ggcgcgccagtcctttcaaagtgctccgcggcggctgcgaaggcggcggctcctgccctctcgctttccctctcgcgtctctggctgcagaaagaagcttccggttctgaggtcctggaggtgccatttcccagggatggttgtgcaaggccggggcagacctcctagtgaaaggaaagcaagccaggcgactcggaccgatg

SEQ ID NO: 12903 - DNA, 203 bp, Homo sapiens
ggcgcgccagtcctgtttctgggctcgtctccgccggggacgtgctgcagcaacggctgcagggccgctaggccgactggcgccagacgcggcgcgtggccacgttggtggtgaccttccacgccaacttcatgatgtcacctagaggcctgctggagcgcgcgctcccgggccgagcgccgcgcgcccgactcggaccgatg

SEQ ID NO: 12904 - DNA, 203 bp, Homo sapiens
ggcgcgccagtccttttctgcagctcgtctccgccggggacgtgctgcagcaacggctgcagggccgctaggccgactggcgccagacgcggcgcgtggccacgttggtggtgaccttggtaagacggaaagactacgtgtggctgggcctgctggagcgcgcgctcccgggccgagcgccgcgcgcccgactcggaccgatg

SEQ ID NO: 12905 - DNA, 203 bp, Homo sapiens
ggcgcgccagtcctcctacgcagctcgttatctcccagcagtctcctctttacagaaaagagtaagagtactgaggaccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 12906 - DNA, 203 bp, Homo sapiens
ggcgcgccagtcctccctcaaggctctcgggcaccctcacctgccggcgcccggccgcttacccggcagggcgtgcgcagggtagggtgcgggaccggggggacctggaggcagaggggagaaccggccgtccgcgccgcagcacactgcactatccttgctcagaccccgcgcggggcgccggctcccgactcggaccgatg

SEQ ID NO: 12907 - DNA, 203 bp, Homo sapiens
ggcgcgccagtcctaaactagggctctcgggcaccctcacctgccggcgcccggccgcttacccggcagggcgtgcgcagggtagggtgcgggaccggggggacctggaggcagaggggagaaccggccgtcgttagtcgcctgttgccgctgggagcgcctcagaccccgcgcggggcgccggctcccgactcggaccgatg

SEQ ID NO: 12908 - DNA, 203 bp, Homo sapiens
ggcgcgccagtcctgtacgtaagctgcgagccctgggccacgctggccgtgctggcagtgggccgcctcgatccctaaaacacgacatggttgaggctccaagaccagcaggtgaggcctcgcggcgctgaaaccgtgaggcccggaccacaggctccagatggaccctgggaaggacaaagagggggcgactcggaccgatg

SEQ ID NO: 12909 - DNA, 203 bp, Homo sapiens
ggcgcgccagtcctcaaccaccgctgcgagccctgggccacgctggccgtgctggcagtgggccgcctcgatccctctgcagtctttcccttgaggctccaagaatgcactcctttttctcgcggcgctgaaaccgtgaggcccggaccacaggctccagatggaccctgggaaggacaaagagggggcgactcggaccgatg

SEQ ID NO: 12910 - DNA, 203 bp, Homo sapiens
ggcgcgccagtccttcgtatgtgctgcgagccctgggccacgctggccgtgctggcagtggggactaaacggtttcctgcagtctttcccttgaggctccaagaccagcaggtgaggcctcgcggcgctgaaaccgtgaggcccggaccacaggctccagatggaccctgggaaggacaaagagggggcgactcggaccgatg

SEQ ID NO: 12911 - DNA, 203 bp, Homo sapiens
ggcgcgccagtcctatcgaggagctggagcgagtgagcagcgatacctagggcggaagtgctctcggcggaagtgatcgctgtgtgaatccacctctttgatctcgcgggccgcctctttctaagtcggcttcgagcacccttcagttccatggccaagagcccactcgagggcgtttcctcctccagcgactcggaccgatg

SEQ ID NO: 12912 - DNA, 203 bp, Homo sapiens
ggcgcgccagtcctactaacatgctggagcgagtgagcagcgatacctagggcggaagtgctctcggcggaagtgatcgctgtgtgaatcgtgggtgggatggccgcgggccgcctctaaaattaaattgcacgagcacccttcagttccatggccaagagcccactcgagggcgtttcctcctccagcgactcggaccgatg

SEQ ID NO: 12913 - DNA, 203 bp, Homo sapiens
ggcgcgccagtcctgacccaacgctggagcgagtgagcagcgatacctagggcggaagtgctctcggcggaagtgatcgctgtgtgaatcgtgggtgggatggccgcgggccgcctctttctaagtcggcttatttgcattagtgcttccatggccaagagcccactcgagggcgtttcctcctccagcgactcggaccgatg

SEQ ID NO: 12914 - DNA, 203 bp, Homo sapiens
ggcgcgccagtcctacgatatggctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggccaaaagattgaggacgactcggaccgatg

SEQ ID NO: 12915 - DNA, 203 bp, Homo sapiens
ggcgcgccagtcctggcctatggctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctctagcgggcgtggcacgactcggaccgatg

SEQ ID NO: 12916 - DNA, 203 bp, Homo sapiens
ggcgcgccagtccttttgagtggctggggtgaccgggtcctttcttggttgccagtcagtgttacccagaaatttgggcgtgcccccgcgagatcactagccgagtagtgttgggtcgcgaaaggccttgtggtactgcctgatagggtgcttgcgagtgccccgggaggtctcgtagaccgtgcaaccgactcggaccgatg

SEQ ID NO: 12917 - DNA, 203 bp, Homo sapiens
ggcgcgccagtcctagaggtccgctggggtttggtgattcggaggcctggggtgcagacgcggcgtggctgtgagggtgaacgtcatcgccgggtgtgagggccggactcacactgggccgccgcggggctgtttccatcggtcactggattttctcctcttccggttcgggcctcagggtggccgaccgactcggaccgatg

SEQ ID NO: 12918 - DNA, 203 bp, Homo sapiens
ggcgcgccagtcctggcgcattgcttaatgattgagagctcccttctgataaagggagcctgggaggctgggtggaggagggagcagaaaaaacccaactcagcagatctgggaactgtgagagcggcaagcaggaactgtggtcagaggctgtgcgtcttggctggtagggcctgctcttttctacccgactcggaccgatg

SEQ ID NO: 12919 - DNA, 203 bp, Homo sapiens
ggcgcgccagtccttcggcccagcttaatgattgtccagaaggcggctataaagggagcctgggaggctgggtggaggagggagcagaaaaaacccaactcagcagatctgggaactgtgagagcggcaagcaggaactgtggtcagaggctgtgcgtctaaaacttcgcatggtgctcttttctacccgactcggaccgatg

SEQ ID NO: 12920 - DNA, 203 bp, Homo sapiens
ggcgcgccagtcctttgcacgggcttaatgattgtccagaaggcggctataaagggagcctgggaggctgggtggaggagggagcagaaaaaacccaactcagcagatctgggaactgtgagagcggcaagctattcggtactcgggaggctgtgcgtcttggctggtagggcctgctcttttctacccgactcggaccgatg

SEQ ID NO: 12921 - DNA, 203 bp, Homo sapiens
ggcgcgccagtcctcatgatccgcttaatgattgtccagaaggcggctataaagggagcctgggaggctgggtggaggagggagcagaaatctggggggcggcgagatctgggaactgtgagagcggcaagcaggaactgtggtcagaggctgtgcgtcttggctggtagggcctgctcttttctacccgactcggaccgatg

SEQ ID NO: 12922 - DNA, 203 bp, Homo sapiens
ggcgcgccagtcctgcgggatcgcttaatgattgtccagaaggcggctataaagggagcctgggaggctgggtggatatattcattcctcaaacccaactcagcagatctgggaactgtgagagcggcaagcaggaactgtggtcagaggctgtgcgtcttggctggtagggcctgctcttttctacccgactcggaccgatg

SEQ ID NO: 12923 - DNA, 203 bp, Homo sapiens
ggcgcgccagtcctccgtccgcgcttaatgattgtccagaaggcggctcgcttttccatgctggaggctgggtggaggagggagcagaaaaaacccaactcagcagatctgggaactgtgagagcggcaagcaggaactgtggtcagaggctgtgcgtcttggctggtagggcctgctcttttctacccgactcggaccgatg

SEQ ID NO: 12924 - DNA, 203 bp, Homo sapiens
ggcgcgccagtcctcttagtttgcttcatcctacagcgggcgccaggccggccgggcaggatgcgctaccgggcgtcggccctgggcagtgacggggttcgggtgaccatggagagtgcgctcaccgcccgtgaccgggtgggggtgcaggatttcgtgctgctggagaacttcaccagcgaggccgccgactcggaccgatg

SEQ ID NO: 12925 - DNA, 203 bp, Homo sapiens
ggcgcgccagtcctaacgttcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagcgactcggaccgatg

SEQ ID NO: 12926 - DNA, 203 bp, Homo sapiens
ggcgcgccagtcctgctagtatgcttccccaaggtgcaggcgcggtgaaaccatcgagacggagggccagagagtcacggcggtgagagggctgagtgacgggttaccccaaaccatgtggctggaggcgcgtcacccacaacatttaacaccccagggcctgtaaggtttggtgtttccctttcaagcgactcggaccgatg

SEQ ID NO: 12927 - DNA, 203 bp, Homo sapiens
ggcgcgccagtcctagtaaggtgcttccccaaggtgcaggcgcggtgaaaccatcgagacggagggccagagagtcttctgaacccatcagctgagtgacgggttaccccaaaccatgtggctggaggcgcgagctggggttttcgtaacaccccagggcctgtaaggtttggtgtttccctttcaagcgactcggaccgatg

SEQ ID NO: 12928 - DNA, 203 bp, Homo sapiens
ggcgcgccagtcctgagacgaagcttcttctgtaacgggagctggttgtgagtcaccaaggaaggcagcggcagctccactcagccagtacccagatacgctgggaaccttccccagccatggcttccctggggcagatcctcttctggagcataattagcatcatcattattctggctggagcaattcgactcggaccgatg

SEQ ID NO: 12929 - DNA, 203 bp, Homo sapiens
ggcgcgccagtcctaagcctcggctttcctccaacttgctgcgggtggatctccgctggacacaccgcctccgaggatcccgttgctccacaaggagggactttaagactacttctgatttgcaaagattgtctgtgctctgagcaggctgaagtgactggacgagacgcactgttggagaaataaaacgactcggaccgatg

SEQ ID NO: 12930 - DNA, 203 bp, Homo sapiens
ggcgcgccagtcctgttggcatgctttcctccaacttgctgcgggtggatctccgctggacacaccgcctccgaggcagtttgaaaattgcaaggagggactttaagactacttctgatttgcaaagattgtctgtgctctgagcaggctgaagtgactgtgaactttcggagtttggagaaataaaacgactcggaccgatg

SEQ ID NO: 12931 - DNA, 203 bp, Homo sapiens
ggcgcgccagtcctgtaagacagctttcctccaacttgctgcgggtggatctccgctggacacaccgcctccgaggcagtttgaaaattgcaaggagggactttcgaggcgtgcggactttgcaaagattgtctgtgctctgagcaggctgaagtgactggacgagacgcactgttggagaaataaaacgactcggaccgatg

SEQ ID NO: 12932 - DNA, 203 bp, Homo sapiens
ggcgcgccagtcctacacgaccgctttcctccaacttgctgcgggtggatctccgctggacacaccgcctccgaggcagtttgaaaattgtgcacgcactgaaaaagactacttctgatttgcaaagattgtctgtgctctgagcaggctgaagtgactggacgagacgcactgttggagaaataaaacgactcggaccgatg

SEQ ID NO: 12933 - DNA, 203 bp, Homo sapiens
ggcgcgccagtccttccgcgaagctttcctccaacttgctgcgggtggcaggtatggccgtgcaccgcctccgaggcagtttgaaaattgcaaggagggactttaagactacttctgatttgcaaagattgtctgtgctctgagcaggctgaagtgactggacgagacgcactgttggagaaataaaacgactcggaccgatg

SEQ ID NO: 12934 - DNA, 203 bp, Homo sapiens
ggcgcgccagtcctcctttcacggaaaactgcaccagggtaaaagaatttattttccttggcctgacccagaatcgggaagtgagcttagtcttatttcttttcctactcttggtgtaatatgattgggccatgggaaacctcctcatcatggtcactgttacctgtgaatctcgccttcacacgccccgactcggaccgatg

SEQ ID NO: 12935 - DNA, 203 bp, Homo sapiens
ggcgcgccagtccttgagtgatggaaaactgcaccagggtaaaagaatttattttccttggcctgacccagaatcgggaagtgagcttagtcttatttcttttcctactcttggtgtatgtgacaactttgctgggaaacctcctcatcatggtcactgttacctgtgaatctcgccttcacacgccccgactcggaccgatg

SEQ ID NO: 12936 - DNA, 203 bp, Homo sapiens
ggcgcgccagtcctaccatcaaggaaaactgcaccagggtaaaagaatttattttccttggcctgacccagaatcgggaagtgagcttagtcttatttcttttcctactcttggtgtatgtgacaactttgctgggaaacctcctcatcatggtcactgttacctgtgaatctctttgaacgctcttacgactcggaccgatg

SEQ ID NO: 12937 - DNA, 203 bp, Homo sapiens
ggcgcgccagtcctggagactaggaaaactgcacgccttattgctctgttattttccttggcctgacccagaatcgggaagtgagcttagtcttatttcttttcctactcttggtgtatgtgacaactttgctgggaaacctcctcatcatggtcactgttacctgtgaatctcgccttcacacgccccgactcggaccgatg

SEQ ID NO: 12938 - DNA, 203 bp, Homo sapiens
ggcgcgccagtcctaacttgtcggaaattatccgtactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaaccccgactcggaccgatg

SEQ ID NO: 12939 - DNA, 203 bp, Homo sapiens
ggcgcgccagtcctgaaaccctggacaatgaaataccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 12940 - DNA, 203 bp, Homo sapiens
ggcgcgccagtcctaatttcatggacagattcggattagcagagagcctgttggagtcaaaacgctccgtaaccccaattcttacagttttagatccaatggtaccgacaggttcagaaaatttaaaaagtctttttaatactgtctgcgtcatttggtgcatacacgcagaagagaaagtgaaagatcgactcggaccgatg

SEQ ID NO: 12941 - DNA, 203 bp, Homo sapiens
ggcgcgccagtccttcactaaaggacagattcggattagcagagagcctgttggagtcaaaagagggttgtcaaaaaattcttacagttttagatccaatggtaccgacaggttcagaaaatttaaaaagtctttttaatactgtctgcgtcatttggtgcatacacgcagaagctccgcaaggtttccgactcggaccgatg

SEQ ID NO: 12942 - DNA, 203 bp, Homo sapiens
ggcgcgccagtcctctactagaggacatccctcaccggtgacggtggtccaggctgcgttggcggcctacctatggctaacgccatgggaatgcgcaatctgtgaaggtgtgaagagcctattgagctacataagaatcctccggcccctgaatgcggctaatcccaacctcggagcaggtggtcacacgactcggaccgatg

SEQ ID NO: 12943 - DNA, 203 bp, Homo sapiens
ggcgcgccagtcctcgtagcctggacatccctcaccggtgacggtggtccaggctgcgttggcggcctacctatggctaacgccatgggacgctagttgtgaacaaggtgtgaagagcagccgtcaagcgggaagaatcctccggcccctgaatgcggctaatcccaacctcggagcaggtggtcacacgactcggaccgatg

SEQ ID NO: 12944 - DNA, 203 bp, Homo sapiens
ggcgcgccagtcctaccggcagggacatccctcaccggtgacggtggtccaggctgcgttggcggcctacctatggctaacgccatgggacgctagttgtgaacaaggtgtgaagagcctattgagctacataagaatcctccggcccctgaatgcggctaatcccaacctcgggaggttcaactcttcgactcggaccgatg

SEQ ID NO: 12945 - DNA, 203 bp, Homo sapiens
ggcgcgccagtcctagatcaccggacatccctcaccggtgacggtggtccaggctgcgttggcggcctacctatggctaacgccatgggacgctagttgtgaacaaggtgtgaagagcctattgagctacataagaatcctccggcccctgaatgcggctcccagaccgagacaagcaggtggtcacacgactcggaccgatg

SEQ ID NO: 12946 - DNA, 203 bp, Homo sapiens
ggcgcgccagtcctacaagaatggacatcgaccattcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcatacgactcggaccgatg

SEQ ID NO: 12947 - DNA, 203 bp, Homo sapiens
ggcgcgccagtcctgactagggggacccgtagtgaacataggaaattgtcgttgaactacatgttgtaaggctttagagaaataagggagtgtcctatttaggatgaggtgctccggtggcagccccaccaaaacctctagcgactaggaacagctatatcgggttgctatagcagtcaggatgtcatcgactcggaccgatg

SEQ ID NO: 12948 - DNA, 203 bp, Homo sapiens
ggcgcgccagtcctcagggtgcggacctcgagcgaaagacgcccgcccgccgcccagccctcgcctccctgcccaccgggcccaccgcgccgccaccccgacccaagctatacaccagtgtccgctgcacaccagcttgttggcgtcttcgtcgccgcgctcgccccgggctactcctgcgcgccacacgactcggaccgatg

SEQ ID NO: 12949 - DNA, 203 bp, Homo sapiens
ggcgcgccagtcctttgtatcgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgcatagttaacctcggtcctgcgcgccacacgactcggaccgatg

SEQ ID NO: 12950 - DNA, 203 bp, Homo sapiens
ggcgcgccagtcctagtatctgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctaccatgcatgttgtttcgactcggaccgatg

SEQ ID NO: 12951 - DNA, 203 bp, Homo sapiens
ggcgcgccagtcctcttgcgttggacctcgagcgtcgtggtgggctgagccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacacgactcggaccgatg

SEQ ID NO: 12952 - DNA, 203 bp, Homo sapiens
ggcgcgccagtcctccgaacttggactctgtcttcagctggacactccctccctgcaccatgctaacttcgaactccctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 12953 - DNA, 203 bp, Homo sapiens
ggcgcgccagtcctttagttcaggactctgtcttcagctggacactccctccctgcaccatgtcttacagttgtggcctgcccagcctgacggatttgcaactttgctcctcccggccctgtgtgccccccagctgccacggctgcaccctgcccggggcctgcaacatccccgccaatgtgagcaaccgactcggaccgatg

SEQ ID NO: 12954 - DNA, 203 bp, Homo sapiens
ggcgcgccagtcctaatgagaaggactctgtcttcagctggacactccctccctgcaccatgtcttacagttgtggcctgcccagcctgagctgccgcaccagctgcattaatgggccctgtgtgccccccagctgccacggctgcaccctgcccggggcctgcaacatccccgccaatgtgagcaaccgactcggaccgatg

SEQ ID NO: 12955 - DNA, 203 bp, Homo sapiens
ggcgcgccagtcctcacgctggggactctgtcttcagctggacactccctccctgcaccatgtcttacagttgtggcctgcccagcctgagctgccgcaccagctgctcctcccggccctgtgtgccccccagctgccacggctgcaccctgcccggggcaccttcgcagtgtaccaatgtgagcaaccgactcggaccgatg

SEQ ID NO: 12956 - DNA, 203 bp, Homo sapiens
ggcgcgccagtcctgatgaatcggactctgtcttcagctggacactccctccctgcaccatgtcttacagttgtggcctgcccagcctgagctgccgcaccagctgctcctcccggccctgtgtgccccccagctgccacggctgcaccctgcccggggcctgcaacatccccggtctccctttttcacgactcggaccgatg

SEQ ID NO: 12957 - DNA, 203 bp, Homo sapiens
ggcgcgccagtcctttgggactggactctgtcttcagctggacactccctccctgcaccatgtcttacagttgtggttgtttagagacccgctgccgcaccagctgctcctcccggccctgtgtgccccccagctgccacggctgcaccctgcccggggcctgcaacatccccgccaatgtgagcaaccgactcggaccgatg

SEQ ID NO: 12958 - DNA, 203 bp, Homo sapiens
ggcgcgccagtcctcatcccacggactctgtcttcagctggacactcctagaacagtttcaatcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 12959 - DNA, 203 bp, Homo sapiens
ggcgcgccagtcctgtattcacggactctgtcttcagctggatctcaggtccctgcaccatgtcttacagttgtggcctgcccagcctgagctgccgcaccagctgcattaatgggccctgtgtgccccccagctgccacggctgcaccctgcccggggcctgcaacatccccgccaatgtgagcaaccgactcggaccgatg

SEQ ID NO: 12960 - DNA, 203 bp, Homo sapiens
ggcgcgccagtcctgggtagaaggactctgtcttcagctggatctcaggtccctgcaccatgtcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 12961 - DNA, 203 bp, Homo sapiens
ggcgcgccagtcctgaggttcgggactctgtctttgctaccctcacaactccctgcaccatgtcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 12962 - DNA, 203 bp, Homo sapiens
ggcgcgccagtcctagttaagaggagagtagagcggagagaggaagtaagaagacgcctccgggtaagggacgcccctaacatccacggtaccaatgcgcgtactgtaaggaggagggacattggaagaagaactgtccaaaactcgtaagcggggcaaccccagtgttggtagaagaattacaatagcgactcggaccgatg

SEQ ID NO: 12963 - DNA, 203 bp, Homo sapiens
ggcgcgccagtcctagaccctgggagagtagagcggagagaggaagtaagaagacgcctccgggtaagggacgcccgcctttggggaaaaaccaatgcgcgtacaccctaacatctctacattggaagaagaactgtccaaaactcgtaagcggggcaaccccagtgttggtagaagaattacaatagcgactcggaccgatg

SEQ ID NO: 12964 - DNA, 203 bp, Homo sapiens
ggcgcgccagtccttcggcgtcggagccccgcgtgacgctcctctctcagtccaaaagcggcttttggttcggcgcagagagacccgggggtctagcttttcctcgaaaagcgccgccctgcccttggccccgagaacagacaaagagcaccgcagggccccgggtcgaacacccgctgaggccggcccgactcggaccgatg

SEQ ID NO: 12965 - DNA, 203 bp, Homo sapiens
ggcgcgccagtcctggatgcttggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggatgatgaaattcgacgactcggaccgatg

SEQ ID NO: 12966 - DNA, 203 bp, Homo sapiens
ggcgcgccagtcctatatgaacggagccccgcgtgacgctcctctctcagtccaaaagcggcttttggttcggcgcagagagacccgggggtctagcttttcctcgaaaagcgccgccctgcccttggccccgagaacagacaaaggttggttttattgagatcacgctgggggcgctgaggccggcccgactcggaccgatg

SEQ ID NO: 12967 - DNA, 203 bp, Homo sapiens
ggcgcgccagtcctcgtgacgaggagccccgcgtgacgctcctctctcagtccaaaagcggcttttggttcggcgcagagagacccgggggtctagcttttcctcgaaaagcgccgccctgcccttggcccctcctgtgactgtccagcaccgcagggccgatcacgctgggggcgctgaggccggcccgactcggaccgatg

SEQ ID NO: 12968 - DNA, 203 bp, Homo sapiens
ggcgcgccagtcctatgttgttggagccccgcgtgacgctcctctctcctataggtgcacatttttggttcggcgcagagagacccgggggtctagcttttcctcgaaaagcgccgccctgcccttggccccgagaacagacaaagagcaccgcagggccgatcacgctgggggcgctgaggccggcccgactcggaccgatg

SEQ ID NO: 12969 - DNA, 203 bp, Homo sapiens
ggcgcgccagtccttccacgtgggagccgcgcagccctcggagcacgaatatatacagccctgctctgggacacacctccattggatttaaaagacagtcctcgtcagcactgactttcagctatggaatcgacggttgatgatgagcgttgtaggaatgaaatgaagatcgggtgaggagcaggacgcgactcggaccgatg

SEQ ID NO: 12970 - DNA, 203 bp, Homo sapiens
ggcgcgccagtcctcccttcgtggagccgcgcagccctcggagcacgaatatatacagccctgctctgggacacactgttggactcgaagaaagacagtcctcgtcagcactgactttcagctatggaatcgacggttgatgatgaagcgccggccgtgtaaatgaagatcgggtgaggagcaggacgcgactcggaccgatg

SEQ ID NO: 12971 - DNA, 203 bp, Homo sapiens
ggcgcgccagtcctcaagtcccggataggaggaatttaacaggatactgaacgtcgtatgttcagatcaaaagtaagaaaaacttagggtgaatgacaattcacagatcagctcaaccagacaccaccagcatacacgaaaccaaccttcacagtggatacctcagcatccaaaactctccttcccgacgactcggaccgatg

SEQ ID NO: 12972 - DNA, 203 bp, Homo sapiens
ggcgcgccagtcctgcgatgcaggataggaggaatttaacaggatacttggacaatagaagccagatcaaaagtaaagctttgagcaaaggaatgacaattcacagatcagctcaaccagacaccaccagcatacacgaaaccaaccttcacagtggatacctcagcatccaaaactctccttcccgacgactcggaccgatg

SEQ ID NO: 12973 - DNA, 203 bp, Homo sapiens
ggcgcgccagtcctccaaccagggataggaggaatttaacaggatacttggacaatagaagccagatcaaaagtaagaaaaacttagggtgaatgacaattcacagatcagctcaaccagacaccaccagcatacacgaaaccaaccttcacagtggatacctcagcatccaaaactctccttcccgacgactcggaccgatg

SEQ ID NO: 12974 - DNA, 203 bp, Homo sapiens
ggcgcgccagtcctgtctacttggatcacttgagatttcactcgattcgctgcagtgagccctgtttttgccaccacactccagcttgggattgattcctaaagactcatgttacgtgaggaagcagctcagaagaggaaaggaaaggagccaggcatggctcttcctcagatatctcttccaaatgccgactcggaccgatg

SEQ ID NO: 12975 - DNA, 203 bp, Homo sapiens
ggcgcgccagtcctaagaggatggatcacttgagccagggagttgaaggctgcagtgagcccgcaaaggattggaccactccagcttgggattgattcctaaagactcatgttacgtgaggaagcagctcagaagaggaaaggaaaggagccaggcatggctcttcctcagatatctcttccaaatgccgactcggaccgatg

SEQ ID NO: 12976 - DNA, 203 bp, Homo sapiens
ggcgcgccagtcctacactctaggatcacttgagccagggagttgaaggctgcagtgagccctgtttttgccaccacactccagcttgggattgattcctaaagactcatgttacgtgaggaagcagctcagaagaggaaaggaaaggagccaggcatggagtcggagagctattctcttccaaatgccgactcggaccgatg

SEQ ID NO: 12977 - DNA, 203 bp, Homo sapiens
ggcgcgccagtcctgttatccaggatcacttgagccagggagttgaaggctgcagtgagccctgtttttgccaccacactccagcttgggattgattcctaaagttaagatcaggccaaggaagcagctcagaagaggaaaggaaaggagccaggcatggctcttcctcagatatctcttccaaatgccgactcggaccgatg

SEQ ID NO: 12978 - DNA, 203 bp, Homo sapiens
ggcgcgccagtccttagcctttggatcctaggcaaattgtctacctttactggtcagcaagtcttttccacaatgagcaactcaaaggaaatccccagcttcagatggactcaatccctgagaagagggctcagtgagttcacaacaccggtgaagaccgatgttctgagggattgggtttgccagaccgactcggaccgatg

SEQ ID NO: 12979 - DNA, 203 bp, Homo sapiens
ggcgcgccagtcctgagtaaacggatcctaggcaaattgtctacctttcgatcatttacgaccttttccacaatgagcaactcaaaggaaatccccagcttcagatggactcaatccctgagaagagggctcagtgagttcacaacaccggtgaagaccgatgttctgagggatgccaaaatgatactcgactcggaccgatg

SEQ ID NO: 12980 - DNA, 203 bp, Homo sapiens
ggcgcgccagtcctctgatattggatcctaggcaatttggttgtctttaacgacctaaaatcgcgctgtacttctccaaatgggaaacaagcaagccaaagccccagaatcaaaagacagtccgagagccagcctgatcccagatgccacacatctagggccacagttctgtaagagctgctggttcgcgactcggaccgatg

SEQ ID NO: 12981 - DNA, 203 bp, Homo sapiens
ggcgcgccagtccttgacttctggatcctaggcaatttggttgtctttttttgaggccttgtgcgctgtacttctccaaatgggaaacaacttcattcgttagtcagaatcaaaagacagtccgagagccagcctgatcccagatgccacacatctagggccacagttctgtaagagctgctggttcgcgactcggaccgatg

SEQ ID NO: 12982 - DNA, 203 bp, Homo sapiens
ggcgcgccagtcctgtagcaaaggatcctaggcaatttggttgtctttttttgaggccttgtgcgctgtacttctccaaatgggaaacaagcaagccaaagccccagaatcaaaagactcatgagtcctacacctgatcccagatgccacacatctagggccacagttctgtaagagctgctggttcgcgactcggaccgatg

SEQ ID NO: 12983 - DNA, 203 bp, Homo sapiens
ggcgcgccagtcctgtaccgttggatcctaggcaatttggttgtctttttttgaggccttgtgcgctgtacttctcggcgccttgccggggcaagccaaagccccagaatcaaaagacagtccgagagccagcctgatcccagatgccacacatctagggccacagttctgtaagagctgctggttcgcgactcggaccgatg

SEQ ID NO: 12984 - DNA, 203 bp, Homo sapiens
ggcgcgccagtcctacaactctggatcctaggcaccaccagctctgacttcactgagcaactctattctagatcaaaatcaccagaacttctggcatggcacactccaaggaggttccaagctttagatggactcagtccttaaggagaggtttgagccaattcactcagactgtcaagtcagatgttcgactcggaccgatg

SEQ ID NO: 12985 - DNA, 203 bp, Homo sapiens
ggcgcgccagtccttcgtagccggatcctaggcatagtgtctaacactccgcgaattatgggctattctagatcaaaatcaccagaacttctggcatggcacactccaaggaggttccaagctttagatggactcagtccttaaggagaggtttgagccaattcactcagactgtcaagtcagatgttcgactcggaccgatg

SEQ ID NO: 12986 - DNA, 203 bp, Homo sapiens
ggcgcgccagtcctccgcgagcggatcctaggcatagtgtctaacactttcactgagcaactctattctagatcaaaatcaccagaacttctggcatggcacacgagttccttcaataaagctttagatggactcagtccttaaggagaggtttgagccaattcactcagactgtcaagtcagatgttcgactcggaccgatg

SEQ ID NO: 12987 - DNA, 203 bp, Homo sapiens
ggcgcgccagtcctgtagaggcggatcctaggcatagtgtctaacactttcactgagcaactctattctagatcaaaatcaccagaacttctggcatggcacactccaaggaggttccaagctttagatggactcagtccttaaggagaggtttgagccaattcactcagactgtcaagtcagatgttcgactcggaccgatg

SEQ ID NO: 12988 - DNA, 203 bp, Homo sapiens
ggcgcgccagtcctgctattggggatcctaggcatagtgtctaacactttcactgagcaactctattctagatcaaaatcaccagaacttctggcatggcacactccaaggaggttccaagctttagatggactcagtccttaaggtctccaccaccgtgattcactcagactgtcaagtcagatgttcgactcggaccgatg

SEQ ID NO: 12989 - DNA, 203 bp, Homo sapiens
ggcgcgccagtcctcttggtacggatcctaggcattaaggctatcttatttaattgtctttaattgcctcttgtgtcttctgtgcccctacgggaccctatcccgcgtaagcaatagactctagcagaccacatgttctgagggttctgaacatcatacctgcagctaaacatggaggaagacatagccgactcggaccgatg

SEQ ID NO: 12990 - DNA, 203 bp, Homo sapiens
ggcgcgccagtcctccgcaggtggatcctaggcattaaggctatcttatttaattgtctttataacgtcgcatcagcttctgtgcccctacgggaccctatcccatagcgaactgttgctctagcagaccacatgttctgagggttctgaacatcatacctgcagctaaacatggaggaagacatagccgactcggaccgatg

SEQ ID NO: 12991 - DNA, 203 bp, Homo sapiens
ggcgcgccagtcctatatctaaggatcctaggccgtcgttaagtttggatgtgctgtggtgaaggcgtgtaaaacgacggccagtgcgcacagtggatcctaggcgacacttggccatactctttagcacataagagttgaaagggcttattagaaagcacattcctgagaggtgcgagtttggacatcgactcggaccgatg

SEQ ID NO: 12992 - DNA, 203 bp, Homo sapiens
ggcgcgccagtccttacaggcaggatcctaggccgtcgttaagtttggatgtgctgtggtgaaggcgtgtaaaacgacggccagtgcgcacagtggatcctaggcgacacttggccatggatgaatatgtccaagagttgaaagggcttattagaaagcaatcgaaaagctatagcgagtttggacatcgactcggaccgatg

SEQ ID NO: 12993 - DNA, 203 bp, Homo sapiens
ggcgcgccagtcctttactgtcggatcctaggcgaaatttgacaatggatgaaaaagtctttgttttgaaagattttatcagaagacaagtgcctgacatacctgaactgtcttatcagaaggaggcattactttctcaagtcgaagtaccaatggtcttaacagagggcttcaagctcctatcatgccgactcggaccgatg

SEQ ID NO: 12994 - DNA, 203 bp, Homo sapiens
ggcgcgccagtcctattcagggggatcctaggcgaaatttgacaatggatgaaaaagtctttgttttgaaagattttatcagaagacaagtgcctgacatacctgaactgtcttatcagaaggaggcattactttctcaagtcgaatgcttgtactagaaaacagagggcttcaagctcctatcatgccgactcggaccgatg

SEQ ID NO: 12995 - DNA, 203 bp, Homo sapiens
ggcgcgccagtcctctgctgaaggatcctaggctattggattgcgctttgcttttgtcatttcctacctgttcgcaagttctttgttgtgtgcatacaacacaacaatctggcgatgagtgcctcaaaggaaataaaatcctttttgtggacacaatctttgaggagggaattatctggttactgctccgactcggaccgatg

SEQ ID NO: 12996 - DNA, 203 bp, Homo sapiens
ggcgcgccagtccttcgcttcgggatcctaggctattggattgcgctttgcttttgtcattttggcagatagtctcagttctttgttgtgtgcatacaacacaacaatctggcgatgagtgcctcaaaggaagagtggcatggagggtggacacaatctttgaggagggaattatctggttactgctccgactcggaccgatg

SEQ ID NO: 12997 - DNA, 203 bp, Homo sapiens
ggcgcgccagtcctggaaagtgggatcctaggctattggattgcgctttgcttttgtcattttggcagatagtctcttggtgcacggtgatgcatacaacacaacaatctggcgatgagtgcctcaaaggaaataaaatcctttttgtggacacaatctttgaggagggaattatctggttactgctccgactcggaccgatg

SEQ ID NO: 12998 - DNA, 203 bp, Homo sapiens
ggcgcgccagtcctgatcgccgggatggcgataggacagctataggctctgcagggccccaggcagctggggtattccttaggggctgagtctcctggtatccctaagactgggcttggcttaggcactgagattccttctggaaccccaacgccttcgagacggattccgacctgccggctggatggcgactcggaccgatg

SEQ ID NO: 12999 - DNA, 203 bp, Homo sapiens
ggcgcgccagtcctctttattgggatttggctccatggcttagggcaacatatctatgaaacttatggggatacttgggcaggagtggaagccataataagaattctgcaacaactgctgtttatccattttcagaattgggtgtcacgggtaatagtggggcgttactcgacagaggagagcaagaacgactcggaccgatg

SEQ ID NO: 13000 - DNA, 203 bp, Homo sapiens
ggcgcgccagtccttaatccagggatttggctccatggcttagggcaacatatctatgaaacttatggggatactttatgccaccgaaccgccataataagaattctgcaacaactgctgtttatccattttcagaattgggtgtcgacatagcagaataggcgttactcgacagaggagagcaagaacgactcggaccgatg

SEQ ID NO: 13001 - DNA, 203 bp, Homo sapiens
ggcgcgccagtccttttcgtccggcaagggggcgaccgatcttataacaagctcggcgttccagagagtggggagggggcaagtgtcagtcaggacgggagtccggcgggttacagcggaggcctaggtggcagacagggggcccgggccgctgcgtgttgtccacccaagatggagttcctcctgggcgactcggaccgatg

SEQ ID NO: 13002 - DNA, 203 bp, Homo sapiens
ggcgcgccagtcctacgccgacggcaagggggcggggccaaaggccctaagctcggcgttccagagagtggggagggggcaagtgtcagtcaggacgggagtccccacccgccggtgcgaggcctaggtggcagacagggggcccgggccgctgcgtgttgtccacccaagatggagttcctcctgggcgactcggaccgatg

SEQ ID NO: 13003 - DNA, 203 bp, Homo sapiens
ggcgcgccagtcctaatgtagaggcaagggggcggggccaaaggccctaagctcggcgttccagagagtggggagggggcaagtgtcagtcaggacgggagtccggcgggttacagcggaggcctaggtggcagacagggggcccgggccgctgcgtgttgtccacccaagatggagttcctcctgggcgactcggaccgatg

SEQ ID NO: 13004 - DNA, 203 bp, Homo sapiens
ggcgcgccagtcctcctcgcaaggcaagggggcggggccaaaggccctaagctcggcgttccagagagtggggagggggcaagtgtcagtcaggacgggagtccggcgggttacagcggaggcctaggtggcgatgtaactctgaaggccgctgcgtgttgtccacccaagatggagttcctcctgggcgactcggaccgatg

SEQ ID NO: 13005 - DNA, 203 bp, Homo sapiens
ggcgcgccagtccttgtgtgggggcaagggggcggggccaaaggccctcgtacttagccataagagagtggggagggggcaagtgtcagtcaggacgggagtccggcgggttacagcggaggcctaggtggcagacagggggcccgggccgctgcgtgttgtccacccaagatggagttcctcctgggcgactcggaccgatg

SEQ ID NO: 13006 - DNA, 203 bp, Homo sapiens
ggcgcgccagtcctagaggagaggcaataacatatatatgtcaaccctgctcattggtttaaggacctcacggagctgttgtgtgatcttgcgcgataaatgctgacgtgaaaacgttgcgtattgctacaacacttggttagctatttagctttactaatcaagacgccgtcgtgcagcccacaaaacgactcggaccgatg

SEQ ID NO: 13007 - DNA, 203 bp, Homo sapiens
ggcgcgccagtcctcgagtaacggcaataacatatatatgtcaaccctgctcattggtttaattgagcgcatttagtgttgtgtgatcttgcgcgataaatgctgacgtgaaaacgttgcgtattgctacaacacttggttagctatttagctttactaatcaagacgccgtcgatgcagaacaggtgcgactcggaccgatg

SEQ ID NO: 13008 - DNA, 203 bp, Homo sapiens
ggcgcgccagtcctgtcaaatgggcaataacatatatatgtcaaccctgctcattggtttaattgagcgcatttagtgttgtgtgatcttgcgcgataaatgctgacgtgaaaacgttgcgtattgctacaacacttggttagctatttagctttactaatcaagacgccgtcgtgcagcccacaaaacgactcggaccgatg

SEQ ID NO: 13009 - DNA, 203 bp, Homo sapiens
ggcgcgccagtcctgacctgaaggcacttgcaccgtgtggacagactcagaacgagataaataatccagtccctgttactccattttggccagaaattcaagacatttcaggtggcagaataaattcaatccttgtttctccatcttatcgagtagtagaagttagttacattctctttgaactcatccgactcggaccgatg

SEQ ID NO: 13010 - DNA, 203 bp, Homo sapiens
ggcgcgccagtcctgcgcaacgggcacttgcaccgtgtggacagactctccggttctggggaaatccagtccctgtgctatgtgcactcgcagaaattcaagacatttcaggtggcagaataaattcaatccttgtttctccatcttatcgagtagtagaagttagttacattctctttgaactcatccgactcggaccgatg

SEQ ID NO: 13011 - DNA, 203 bp, Homo sapiens
ggcgcgccagtcctaaggcatgggcacttgcaccgtgtggacagactctccggttctggggaaatccagtccctgttactccattttggcatagttgctggcttatttcaggtggcagaataaattcaatccttgtttctccatcttatcgagtagtagaagttagttacattctctttgaactcatccgactcggaccgatg

SEQ ID NO: 13012 - DNA, 203 bp, Homo sapiens
ggcgcgccagtcctgtggcttaggcacttgcaccgtgtggacagactctccggttctggggaaatccagtccctgttactccattttggccagaaattcaagacatttcaggtggcagaataaattcaatccttgtttctccatcttatcgagtagtagaagttagttacattctctttgaactcatccgactcggaccgatg

SEQ ID NO: 13013 - DNA, 203 bp, Homo sapiens
ggcgcgccagtcctcgcaaagcggcaggcgatccggggctcgcctccgtagatagggggcgccgcaggcgcgagctggccgcctcacacggagtcggcttgttaagtgcgcacgcgcgggagtttctggcagaaagcaggcgagcctgggccggcgcggggccttgtgggagggcttaaggaagtaaacgactcggaccgatg

SEQ ID NO: 13014 - DNA, 203 bp, Homo sapiens
ggcgcgccagtccttccttcagggcagtccatggaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctgcgactcggaccgatg

SEQ ID NO: 13015 - DNA, 203 bp, Homo sapiens
ggcgcgccagtcctcctcaaacggccaaatacagaattttggatctccccccccccacccccctttggatcttgtcgggctttccacgtttcacttaaaaaaaattcttgtaacgtccaaggcaagctccccacgacccgaacacgcccagaggaaccttggggcctctggggacttggctagcaggtcgactcggaccgatg

SEQ ID NO: 13016 - DNA, 203 bp, Homo sapiens
ggcgcgccagtcctgtagaactggccaaccagaccctgggtggtgactttttcctgttgggaatcttcagccagatctcacaccctggccgcctctgcttgcttatcttcagtatatttttgatggctgtgtcttggaatattacaggccgctaataaccccacattgactcctctctgcatactccccgactcggaccgatg

SEQ ID NO: 13017 - DNA, 203 bp, Homo sapiens
ggcgcgccagtccttgaggcctggccaaccagaccctgggtggtgactttttcctgttgggaatcttcagccagatctcacaccctggccgcctctgcttgctttgggaagagcataatttgatggctgtgtcttggaatattacattgatacttctgatccacattgactcctctctgcatactccccgactcggaccgatg

SEQ ID NO: 13018 - DNA, 203 bp, Homo sapiens
ggcgcgccagtcctgccgcgggggccacgaatcatttgccatctcctccgtaccctcgaagcaatgtatggccctggtagtcagctgggaaagtctggcaataacagctgggctaaggaacgtggatgctcaattgcctgccaagggtctcttacttcagcccggctacatgcccccagcattggagacgactcggaccgatg

SEQ ID NO: 13019 - DNA, 203 bp, Homo sapiens
ggcgcgccagtcctagatcgggggccacgaatcatttgccatctcctctaccaaagactcaaaatgtatggccctgcactcagcgccctcaagtctggcaataacagctgggctaaggaacgtggatgctcaattgcctgccaagggtctcttacttcagcccggctacatgcccccagcattggagacgactcggaccgatg

SEQ ID NO: 13020 - DNA, 203 bp, Homo sapiens
ggcgcgccagtcctagttagcgggccacgaatcatttgccatctcctctaccaaagactcaaaatgtatggccctggtagtcagctgggaaagtctggcaataacagctgggctaaggaacgtggatgctcaattgcctgccaaggacggggactacacacccggctacatgcccccagcattggagacgactcggaccgatg

SEQ ID NO: 13021 - DNA, 203 bp, Homo sapiens
ggcgcgccagtccttcacccgcggccacgaatcatttgccatctcctctaccaaagactcaaaatgtatggccctggtagtcagctgggaaagtctggcaataacagctgggctaaggaacgtggatgctcagcgcgacagagtcagtctcttacttcagcccggctacatgcccccagcattggagacgactcggaccgatg

SEQ ID NO: 13022 - DNA, 203 bp, Homo sapiens
ggcgcgccagtcctcataaataggccacgaatcatttgccatctcctctaccaaagactcaaaatgtatggccctggtagtcagctgggaaagtctggcaataacagctgggctaagggctaaattcagagtattgcctgccaagggtctcttacttcagcccggctacatgcccccagcattggagacgactcggaccgatg

SEQ ID NO: 13023 - DNA, 203 bp, Homo sapiens
ggcgcgccagtcctacgcgcctggccacgaatcatttgccatctcctctaccaaagactcaagggtctgtcggacagtagtcagctgggaaagtctggcaataacagctgggctaaggaacgtggatgctcaattgcctgccaagggtctcttacttcagcccggctacatgcccccagcattggagacgactcggaccgatg

SEQ ID NO: 13024 - DNA, 203 bp, Homo sapiens
ggcgcgccagtcctagagtttaggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgactcggaccgatg

SEQ ID NO: 13025 - DNA, 203 bp, Homo sapiens
ggcgcgccagtcctaatacccgggccatcgctagcggcttgatccgccagaagcggcaggcgcgggagcagcactgggaccggccgtctgccagcaggaggcggagcagccccagcaagaaccgcgggctcttatcttctgcggccgtggatatcttctccaaagtgcgcatcttcggcctcaagaagcgactcggaccgatg

SEQ ID NO: 13026 - DNA, 203 bp, Homo sapiens
ggcgcgccagtccttgaaaccaggccatcgctagcggcttgatccgccagaagcggcaggcgcgggagcagcactgggaccggccgtctgccagcaggaggcggcagtttttggtttcgaaccgcgggctctgcaacggcaacctggtggatatcttctccaaagtgcgcatcttcggcctcaagaagcgactcggaccgatg

SEQ ID NO: 13027 - DNA, 203 bp, Homo sapiens
ggcgcgccagtcctgcagcctgggccatcgctagcggcttgatccgccagaagcggcaggcgcgggagcagcactgggaccggccgtctgtttagtcatcattcagcagccccagcaagaaccgcgggctctgcaacggcaacctggtggatatcttctccaaagtgcgcatcttcggcctcaagaagcgactcggaccgatg

SEQ ID NO: 13028 - DNA, 203 bp, Homo sapiens
ggcgcgccagtccttgttatggggccatcgctagcggcttgatccgccagaagcggcaggcgtcatctacttctaaggaccggccgtctgccagcaggaggcggagcagccccagcaagaaccgcgggctctgcaacggcaacctggtggatatcttctccaaagtgcgcatcttcggcctcaagaagcgactcggaccgatg

SEQ ID NO: 13029 - DNA, 203 bp, Homo sapiens
ggcgcgccagtcctgtgatctcggccatcgctagcggcttgatccgccttggtaattgcatacgggagcagcactgggaccggccgtctgccagcaggaggcggagcagccccagcaagaaccgcgggctctgcaacggcaacctggtggatatcttctccaaagtgcgcatcttcggcctcaagaagcgactcggaccgatg

SEQ ID NO: 13030 - DNA, 203 bp, Homo sapiens
ggcgcgccagtccttcctggctggccatgtcttaggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagagcgactcggaccgatg

SEQ ID NO: 13031 - DNA, 203 bp, Homo sapiens
ggcgcgccagtccttttagacgggcccatcagttccaccccttgtagtgcatcactactgctattgagcaggctgctctagcagcggccaactctgcccttgcgaatgctgtggtagttaggccttttctctctcaccagcagattgagatccttattaacctaatgcaacctcgccagcttgttttccgactcggaccgatg

SEQ ID NO: 13032 - DNA, 203 bp, Homo sapiens
ggcgcgccagtccttgacgggcggcccatcagtttattaaggctcctggcatcactactgctattgagcaggctgccggcaacctttgggactctgcccttgcgaatgctgtggtagttaggccttttctctctcaccagcagattgagatccttattaacctaatgcaacctcgccagcttgttttccgactcggaccgatg

SEQ ID NO: 13033 - DNA, 203 bp, Homo sapiens
ggcgcgccagtcctgcgtgtaaggcccatcagtttattaaggctcctggcatcactactgctattgagcaggctgctctagcagcggccaactctgcccttgcgaatgctgtggtagtatccagcaaatatcctcaccagcagattgagatccttattaacctaatgcaacctcgccagcttgttttccgactcggaccgatg

SEQ ID NO: 13034 - DNA, 203 bp, Homo sapiens
ggcgcgccagtccttcagaagaggcccatcagtttattaaggctcctggcatcactactgctattgagcaggctgctctagcagcggccaactctgcccttgcgaatgctgtggtagttaggccttttctctctcaccagcagattttcgatggagaatgcctaatgcaacctcgccagcttgttttccgactcggaccgatg

SEQ ID NO: 13035 - DNA, 203 bp, Homo sapiens
ggcgcgccagtcctatcttagcggcccatcagtttattaaggctcctggcatcactactgctattgagcaggctgctctagcagcggccaactctgcccttgcgaatgctgtggtagttaggccttttctcttaactgcatgctcggagatccttattaacctaatgcaacctcgccagcttgttttccgactcggaccgatg

SEQ ID NO: 13036 - DNA, 203 bp, Homo sapiens
ggcgcgccagtcctgcaaggttggcccatcagtttattaaggctcctggcatcactactgcttccctcgttcgatgtctagcagcggccaactctgcccttgcgaatgctgtggtagttaggccttttctctctcaccagcagattgagatccttattaacctaatgcaacctcgccagcttgttttccgactcggaccgatg

SEQ ID NO: 13037 - DNA, 203 bp, Homo sapiens
ggcgcgccagtccttctaacgaggccccacagccaagatcacacttgtacaactgagttgtaagacgttcatcgccgtgttatccttgagtaaagaatgaactctggaagcccagccagggacaatgcaccttcacagagattctgcactaatctgagtgaaggtctaaggtttggaatctccccctccgactcggaccgatg

SEQ ID NO: 13038 - DNA, 203 bp, Homo sapiens
ggcgcgccagtcctacagatagggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctccgactcggaccgatg

SEQ ID NO: 13039 - DNA, 203 bp, Homo sapiens
ggcgcgccagtcctgctctataggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttttgtcggaatttcacgactcggaccgatg

SEQ ID NO: 13040 - DNA, 203 bp, Homo sapiens
ggcgcgccagtcctggcggtgtggccccacagcccctgctgactcaaaacaactgagttgtaagacgttcatcgccgtgttatccttgagtaaagaatgaactctggaagcccagccagggacaatgcaccttcacagagattctgcactaatctgagtgcttaaaagcctaggggaatctccccctccgactcggaccgatg

SEQ ID NO: 13041 - DNA, 203 bp, Homo sapiens
ggcgcgccagtccttgtgaacaggccccagggtgtgcagccactgactacctcgtcttcctcggggtagggatgagggagggaggggcattgtgatgtacagggctgctctgtgagatcaagggtctcttaagggtgggagctggggcagggactacgagagcagccagatgggctgaaagtggaactcgactcggaccgatg

SEQ ID NO: 13042 - DNA, 203 bp, Homo sapiens
ggcgcgccagtccttcttacttggccccagggtgtgcagccactgacttggggactgctggtggggtagggatgagggagggaggggcattgtgatgtacagggagtaggccgtcttccaagggtctcttaagggtgggagctggggcagggactacgagagcagccagatgggctgaaagtggaactcgactcggaccgatg

SEQ ID NO: 13043 - DNA, 203 bp, Homo sapiens
ggcgcgccagtccttcggatacggccccagggtgtgcagccactgacttggggactgctggtggggtagggatgagggagggaggggcattgtgatgtacagggctgctctgtgagatcaagggtctcttaagggtgggagctggggcagggactacgagagcagccagatggggaatcgcccagctgcgactcggaccgatg

SEQ ID NO: 13044 - DNA, 203 bp, Homo sapiens
ggcgcgccagtcctgcgttaccggccccagggtgtgcagccactgacttggggactgctggtggggtagggatgagggagggaggggcattgtgatgtacagggctgctctgtgagatcaagggtctcttaataccaactcgcttcgcagggactacgagagcagccagatgggctgaaagtggaactcgactcggaccgatg

SEQ ID NO: 13045 - DNA, 203 bp, Homo sapiens
ggcgcgccagtcctgcctggtcggccccctttccacgcagaagagagagctacagatcgtctgctccctcagcctcgcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 13046 - DNA, 203 bp, Homo sapiens
ggcgcgccagtcctaagtctgaggccccctttccttaacagtctcctcgctacagatcgtcactaaattcagcctcgcccgagacccacttccccagtctcgcccgggtggaggtcgacgaggaggagacaagagtcacccttcctccaggcggcgccggccccctcattatacctggtgtcctataacgactcggaccgatg

SEQ ID NO: 13047 - DNA, 203 bp, Homo sapiens
ggcgcgccagtcctctcagagaggccccctttccttaacagtctcctcgctacagatcgtctgctccctcagcctcaagatcctttaggatccccagtctcgcccgggtggaggtcgacgaggaggagacaagagtcacccttcctccaggcggcgccggccccctcacccgcgggtgtgtcctataacgactcggaccgatg

SEQ ID NO: 13048 - DNA, 203 bp, Homo sapiens
ggcgcgccagtcctagtctacaggccccctttccttaacagtctcctcgctacagatcgtctgctccctcagcctcgcccgagacccactgattacccggacatcgggtggaggtcgacgaggaggagacaagagtcacccttcctccaggcggcgccggccccctcacccgcgggtgtgtcctataacgactcggaccgatg

SEQ ID NO: 13049 - DNA, 203 bp, Homo sapiens
ggcgcgccagtcctactgccctggccccctttccttaacagtctcctcgctacagatcgtctgctccctcagcctcgcccgagacccacttccccagtctcgccatctatagaaaaaccgaggaggagacaagagtcacccttcctccaggcggcgccggccccctcacccgcgggtgtgtcctataacgactcggaccgatg

SEQ ID NO: 13050 - DNA, 203 bp, Homo sapiens
ggcgcgccagtcctagcagcttggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgacgcgtcaaatattcgactcggaccgatg

SEQ ID NO: 13051 - DNA, 203 bp, Homo sapiens
ggcgcgccagtcctataaagttggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 13052 - DNA, 203 bp, Homo sapiens
ggcgcgccagtcctcacgtagcggccccctttccttaacagtctcctcgctacagatcgtctgctccctcagcctcgcccgagacccacttccccagtctcgcccgggtggaggtcgacgaggaggagacaagagtcacccttcctttctatatgtaaatccccctcacccgcgggtgtgtcctataacgactcggaccgatg

SEQ ID NO: 13053 - DNA, 203 bp, Homo sapiens
ggcgcgccagtcctgaccactcggccccctttccttaacagtctcctcgctacagatcgtctgctccctcagcctcgcccgagacccacttccccagtctcgcccgggtggaggtcgagttctccccaggtcgagtcacccttcctccaggcggcgccggccccctcacccgcgggtgtgtcctataacgactcggaccgatg

SEQ ID NO: 13054 - DNA, 203 bp, Homo sapiens
ggcgcgccagtcctgtcattctggccccctttccttaacagtctcctcgctacagatcgtcttagtatgagaataagcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 13055 - DNA, 203 bp, Homo sapiens
ggcgcgccagtcctctgcaataggccccctttccttaacagtctcctctggcatttcgcggagctccctcagcctcgcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 13056 - DNA, 203 bp, Homo sapiens
ggcgcgccagtcctttcatcgcggccgccatgagttccaccttccagcttactggcttcccaggcatggagaaggcacatcactggatattcatcccattattggcagcctacatctccatacttcttggcaatggcactcttctctttctcatcaggaatgatcataacctccatgagcccatgtaccgactcggaccgatg

SEQ ID NO: 13057 - DNA, 203 bp, Homo sapiens
ggcgcgccagtcctaggtaactggccgctccgggcgccttctccctgccccgccgcgtctcgcctgcgcgggctccaagcgcagccttaaacttggaacttgtgtgaatcagcgccccgatcccgagagggctcttccttcggccccatcactcccacaatggaagggcggccgcctccggaaggccgcgactcggaccgatg

SEQ ID NO: 13058 - DNA, 203 bp, Homo sapiens
ggcgcgccagtcctgcattgtaggccgctccgggcgccttctccctgccccgccgcgtctcgcctgcgcgggctccaagcgcagccttaacaggctccgaaacttgaatcagcgccccacattgcgtccacatcttccttcggccccatcactcccacaatggaagggcggccgcctccggaaggccgcgactcggaccgatg

SEQ ID NO: 13059 - DNA, 203 bp, Homo sapiens
ggcgcgccagtcctacaagcgcggccgctccgggcgccttctccctgccccgccgcgtctcgcctgcgcgggctccaagcgcagccttaacaggctccgaaacttgaatcagcgccccgatcccgagagggctcttccttcggccccattcacgttacaatggaagggcggccgcctccggaaggccgcgactcggaccgatg

SEQ ID NO: 13060 - DNA, 203 bp, Homo sapiens
ggcgcgccagtcctcttactagggccggaacccttgagaccagaggctcttagcctattgagctaggagggccaggaactgctgacgtgaccactggacagttattcgtgtctcttacaattaccaaacagaatggacaagcttaataaaataaccgtccccgccagtcagaagttgaggcagcttcacgactcggaccgatg

SEQ ID NO: 13061 - DNA, 203 bp, Homo sapiens
ggcgcgccagtcctagttcctcggccggaacccttgagaccagaggcttaccatgctgctccctaggagggccaggaactgctgacgtgaaactaaagtgtggcttcgtgtctcttacaattaccaaacagaatggacaagcttaataaaataaccgtccccgccagtcagaagttgaggcagcttcacgactcggaccgatg

SEQ ID NO: 13062 - DNA, 203 bp, Homo sapiens
ggcgcgccagtcctcctggacaggccggaacccttgagaccagaggcttaccatgctgctccctaggagggccaggaactgctgacgtgaccactggacagttaagatcacaatgagaaattaccaaacagaatggacaagcttaataaaataaccgtccccgccagtcagaagttgaggcagcttcacgactcggaccgatg

SEQ ID NO: 13063 - DNA, 203 bp, Homo sapiens
ggcgcgccagtcctagattcgtggccggaacccttgagaccagaggcttaccatgctgctccctaggagggccaggaactgctgacgtgaccactggacagttattcgtgtctcttacaattaccaaacagaatggacaagcttaagtggcctgataataccgccagtcagaagttgaggcagcttcacgactcggaccgatg

SEQ ID NO: 13064 - DNA, 203 bp, Homo sapiens
ggcgcgccagtcctcataagcgggccggaacccttgagaccagaggcttaccatgctgctccctaggagggccaggaactgctgacgtgaccactggacagttattcgtgtctcttacaattaccaaacagaatggacaagcttaataaaataaccgtcctgttttcaagagtcttgaggcagcttcacgactcggaccgatg

SEQ ID NO: 13065 - DNA, 203 bp, Homo sapiens
ggcgcgccagtcctcaggtacaggccggaacccttgagaccagaggcttaccatgctgctccctaggagggccaggaactgctgacgtgaccactggacagttattcgtgtctcttacaattaccaaacagacattgatttaaatttaaaataaccgtccccgccagtcagaagttgaggcagcttcacgactcggaccgatg

SEQ ID NO: 13066 - DNA, 203 bp, Homo sapiens
ggcgcgccagtcctctatacaaggccggaacccttgagaccagaggcttaccatgctgctccctaggagggccaggcgtcaaaacaagctccactggacagttattcgtgtctcttacaattaccaaacagaatggacaagcttaataaaataaccgtccccgccagtcagaagttgaggcagcttcacgactcggaccgatg

SEQ ID NO: 13067 - DNA, 203 bp, Homo sapiens
ggcgcgccagtcctaacgcggcggccggcgggcgcttacgtttacagagagaggcgcggggagccaggcctcggggcctcggagcaaccacccgagcagacggagtacacggagcagcggccccggccccgccaacgctgccgccggctactccctcttgatgccctcccctttgcccctcactcaggcgactcggaccgatg

SEQ ID NO: 13068 - DNA, 203 bp, Homo sapiens
ggcgcgccagtccttcgatcgtggccggcgggcgggcggaagagggagagaccaaattataggccaggcctcggggcctcggagcaaccacccgagcagacggagtacacggagcagcggccccggccccgccaacgctgccgccggctactccctcttgatgccctcccctttgcccctcactcaggcgactcggaccgatg

SEQ ID NO: 13069 - DNA, 203 bp, Homo sapiens
ggcgcgccagtcctgatccagaggccggcgggcgggcggaagagggaggagaggcgcggggacgggtcgtagattacctcggagcaaccacccgagcagacggagtacacggagcagcggccccggccccgccaacgctgccgccggctactccctcttgatgccctcccctttgcccctcactcaggcgactcggaccgatg

SEQ ID NO: 13070 - DNA, 203 bp, Homo sapiens
ggcgcgccagtcctcccatttgggccggcgggcgggcggaagagggaggagaggcgcggggagccaggcctcggggcctcggagcaaccacccgagcagacggagtacacggagcagcccagagcctatgcacaacgctgccgccggctactccctcttgatgccctcccctttgcccctcactcaggcgactcggaccgatg

SEQ ID NO: 13071 - DNA, 203 bp, Homo sapiens
ggcgcgccagtcctaatctttaggccggcgggcgggcggaagagggaggagaggcgcggggagccaggcctcggggcctcggagcaaccacccgagcagacggagtacacggagcagcggccccggccccgccaacgctgccgccggcctgaatttcttgatgccctcccctttgcccctcactcaggcgactcggaccgatg

SEQ ID NO: 13072 - DNA, 203 bp, Homo sapiens
ggcgcgccagtcctgggccggcggccggcgggcgggcggaagagggaggagaggcgcggggagccaggcctcggggcctcggagcaaccacccgagcagacggagtacacggagcagcggccccggccccgccaacgctgccgccggctactccctcttgatgccctcccctttgcccctcactcaggcgactcggaccgatg

SEQ ID NO: 13073 - DNA, 203 bp, Homo sapiens
ggcgcgccagtccttttacgacggccggcgggcgggcggaagagggaggagaggcgcggggagccaggcctcggggcctcggagcaaccatgatctgctctttggtacacggagcagcggccccggccccgccaacgctgccgccggctactccctcttgatgccctcccctttgcccctcactcaggcgactcggaccgatg

SEQ ID NO: 13074 - DNA, 203 bp, Homo sapiens
ggcgcgccagtcctgtcgtcaaggcctgctgatgttatggtgacaattgagagattgttaccatatagctattggattggccatccggtgaccaatagagctattatatatctctttgttgggtttataccacttagcttgaaagaggttaaaacattacaattcattgttaagttgaatacagcaaacgactcggaccgatg

SEQ ID NO: 13075 - DNA, 203 bp, Homo sapiens
ggcgcgccagtccttacataacggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccaccaccattcttctaagttgccgcggcagcccgactcggaccgatg

SEQ ID NO: 13076 - DNA, 203 bp, Homo sapiens
ggcgcgccagtccttcagtgccggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccagaatatcaagtaacgactcggaccgatg

SEQ ID NO: 13077 - DNA, 203 bp, Homo sapiens
ggcgcgccagtcctccgccatgggcgagagcgtatggagccgagccgttagcgcgcgccgtcggtgagtcagtccgtccgtccgtccgtccgtcggggcgccgcagctcccgccaggcccagcggccccggctgtcatctctaggacacccggagccacccggtggagcgggccttgccgcggcagcccgactcggaccgatg

SEQ ID NO: 13078 - DNA, 203 bp, Homo sapiens
ggcgcgccagtcctatggctccggcgcggccggagagtataattcactgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagcgactcggaccgatg

SEQ ID NO: 13079 - DNA, 203 bp, Homo sapiens
ggcgcgccagtcctcatatcttggcgcggccggattccgggcagtgactgacttaatccttacgcggcgcatttccgcctctggcgaatggctcgtctgtagtgcacgccgcgggcccagctgcgaccccggccccgcccccgggaccccggccatggacgaactgttccccctcatcttcccggcagcgactcggaccgatg

SEQ ID NO: 13080 - DNA, 203 bp, Homo sapiens
ggcgcgccagtccttttgaaatggcgctggcacctcctcttacagcttgctgatcgccagcttgggaaaaggccggagaaggtgaaattctgtggagcggttccggcgagagactttgtcagctcccgcacagtaacgtggaagtccaagaatccgagtggaggctcaccgaggcgaaggggccaacccgactcggaccgatg

SEQ ID NO: 13081 - DNA, 203 bp, Homo sapiens
ggcgcgccagtcctccggctgaggcgctggcacctcctcttacagcttgctgatcgccagcttgggaaaaggccggagaaggtgaaattctgtgtgctccctccggcgagagactttgtcagctcccgcacagtaacgtggaagtccaagaatccgagtggaggctcaccgaggcgaaggggccaacccgactcggaccgatg

SEQ ID NO: 13082 - DNA, 203 bp, Homo sapiens
ggcgcgccagtcctaatattctggcgctggcacctcctcttacagctttactcctgccagcttgggaaaaggccggagaaggtgaaattctgtgtgctccctcccttttctagaaaaatcagctcccgcacagtaacgtggaagtccaagaatccgagtggaggctcaccgaggcgaaggggccaacccgactcggaccgatg

SEQ ID NO: 13083 - DNA, 203 bp, Homo sapiens
ggcgcgccagtcctgagcattgggcgctggcacctcctcttacagctttactcctgccagcttgggaaaaggccggagaaggtgaaattctgtgtgctccctccggcgagagactttgcggagaggatatatgtaacgtggaagtccaagaatccgagtggaggctcaccgaggcgaaggggccaacccgactcggaccgatg

SEQ ID NO: 13084 - DNA, 203 bp, Homo sapiens
ggcgcgccagtccttagttgagggcgctggcacctcctcttacagctttactcctgccagcttgggaaaaggccggagaaggtgaaattctgtgtgctccctccggcgagagactttgtcagctcccgcacatggcatgcactacacaagaatccgagtggaggctcaccgaggcgaaggggccaacccgactcggaccgatg

SEQ ID NO: 13085 - DNA, 203 bp, Homo sapiens
ggcgcgccagtcctaacaacgtggcggcgcgcgggcgcctggggcgggacttccggcgcgctggagcgttttccggccgtgcgtttgtggccgtccggcctccctgacatgcagccctctggaccccgaggttggaccctactgtggagactagctgtgccggacactcttcaacctcctctggcttgcgactcggaccgatg

SEQ ID NO: 13086 - DNA, 203 bp, Homo sapiens
ggcgcgccagtcctggtgtacgggcggcgcgcgggcgcctggggcgggacttccggcgcgctggagcgttttccggggtaagacagtataccgtccggcctccctgacatgcagccctctggaccccgaggttggaccctactgtgacacacctaccatgcggacactcttcaacctcctctggcttgcgactcggaccgatg

SEQ ID NO: 13087 - DNA, 203 bp, Homo sapiens
ggcgcgccagtccttaaacgcgggcggcgcgcggtgcataccacttttacttccggcgcgctggagcgttttccggccgtgcgtttgtggccgtccggcctccctgacatgcagccctctggaccccgaggttggaccctactgtgacacacctaccatgcggacactcttcaacctcctctggcttgcgactcggaccgatg

SEQ ID NO: 13088 - DNA, 203 bp, Homo sapiens
ggcgcgccagtcctaggtccatggcggctgcagcaacctgcacagccggagagcgcagagaagcagaggaccaagaggcagaatgccggcgctccaccgcccgagactgtgtttcctgtgagtccagatgtgtgatccagatatgctgcaatggtgacataaactgttgactgagactaggagcgtgccgactcggaccgatg

SEQ ID NO: 13089 - DNA, 203 bp, Homo sapiens
ggcgcgccagtccttaacagcaggcggctgcagccgtggctctgcagcgagagcgcagagaagcagaggaccaagaggcagaatgccggcgctccaccgcccgagactgtgtttcctgtgagtccagatgtgcctatagatagctttgcaatggtgacataaactgttgactgagactaggagcgtgccgactcggaccgatg

SEQ ID NO: 13090 - DNA, 203 bp, Homo sapiens
ggcgcgccagtcctgttacaatggcgggaggcgcagccgggctgtcggtggacctgcccactaacttaacttataaggaggacgaggaggaggccgtccacgagcaatgccagcatgagagagacaggcagcttcaggcccaggacgaggagggaggcggccatgtccccgagcggccgaagcaggagcgactcggaccgatg

SEQ ID NO: 13091 - DNA, 203 bp, Homo sapiens
ggcgcgccagtcctggccacggggcgggaggcgcagccgggctgtcggtggacctgcccactgctcagtggagcgtggaggacgaggaggaggccgtccacgagcaatgccagcatgagagagacaggcagccagtttaatgtcttgaggagggaggcggccatgtccccgagcggccgaagcaggagcgactcggaccgatg

SEQ ID NO: 13092 - DNA, 203 bp, Homo sapiens
ggcgcgccagtcctgggcatcaggcgggaggcgcagccgggctgtcggtggacctgcccactgctcagtggagcgtggaggacgaggaggaggccgtccacgagcaatgccagcatgagagagacaggcagcttcaggcccaggacgaggagggaggcggccatgtccccgagcacagttgaagctgccgactcggaccgatg

SEQ ID NO: 13093 - DNA, 203 bp, Homo sapiens
ggcgcgccagtcctgcgacagcggcgggaggcgcagccgggctgtcggtggacctgcccactgctcagtggagcgtggaggacgaggaggaggccgtccacgagcaatgccagcatgagagagacaggcagcttcaggcccaggactgtcgcatgtaataccatgtccccgagcggccgaagcaggagcgactcggaccgatg

SEQ ID NO: 13094 - DNA, 203 bp, Homo sapiens
ggcgcgccagtccttaagtctaggcgggaggcgcagccgggctgtcggtggacctgcccactgctcagtggagcgtggaggacgaggaggaggccgtccacgagcaatgccagcatgatttgacagccacttttcaggcccaggacgaggagggaggcggccatgtccccgagcggccgaagcaggagcgactcggaccgatg

SEQ ID NO: 13095 - DNA, 203 bp, Homo sapiens
ggcgcgccagtccttgcaccggggcgtggccggagctgcggcggcaagcgggctgggactgcaattattaacatctcccggcgagcagctcagaccatgtcgcctgaagaatggacgtatctagtggttcttcttatctccatccccatcggcttcctctttaagaaagccggtcctgggctgaagagcgactcggaccgatg

SEQ ID NO: 13096 - DNA, 203 bp, Homo sapiens
ggcgcgccagtcctcgacatttggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagcgactcggaccgatg

SEQ ID NO: 13097 - DNA, 203 bp, Homo sapiens
ggcgcgccagtcctggttagtcggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtgtctctggagcccccgactcggaccgatg

SEQ ID NO: 13098 - DNA, 203 bp, Homo sapiens
ggcgcgccagtcctcaaagcacggcgtggccggagctgcggcggcaagcgggctgggactgctcggccgcctcctgcccggcgagcagcttgtgtatacctctgtgaagaatggacgtatctagtggttcttcttatctccatccccatcggcttcctctttaagaaagccggtcctgggctgaagagcgactcggaccgatg

SEQ ID NO: 13099 - DNA, 203 bp, Homo sapiens
ggcgcgccagtcctcaaagtcgggcgtggccggatggcacctttgctacgggctgggactgctcggccgcctcctgcccggcgagcagctcagaccatgtcgcctgaagaatggacgtatctagtggttcttcttatctccatccccatcggcttcctctttaagaaagccggtcctgggctgaagagcgactcggaccgatg

SEQ ID NO: 13100 - DNA, 203 bp, Homo sapiens
ggcgcgccagtcctcaccctctggctcaccgcacgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcgactcggaccgatg

SEQ ID NO: 13101 - DNA, 203 bp, Homo sapiens
ggcgcgccagtcctggattatcggctccggccgcatcagtatatgccacgctcagcgccctctcaccgcccggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 13102 - DNA, 203 bp, Homo sapiens
ggcgcgccagtcctagattaaaggctccggccgcgcgccccgcccttgcgctcagcgccctctcaccgcccggctctgtgtgctccgggacttcctgatgtgtgagagggtgagaacccagctctgggaccaagtcacttgcttccttacttagcaagactatcgacttgagcaaacttggacctgggcgactcggaccgatg

SEQ ID NO: 13103 - DNA, 203 bp, Homo sapiens
ggcgcgccagtcctccagaaccggctccggccgcgcgccccgcccttgcgctcagcgccctctcaccgcccggctctgtgtgctccgggatggagcaggtgtgcagagggtgagaaccacatagccccgagcagtcacttgcttccttacttagcaagactatcgacttgagcaaacttggacctgggcgactcggaccgatg

SEQ ID NO: 13104 - DNA, 203 bp, Homo sapiens
ggcgcgccagtcctagaaccgaggctccggccgcgcgccccgcccttgcgctcagcgccctctcaccgcccggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 13105 - DNA, 203 bp, Homo sapiens
ggcgcgccagtcctagcctgggggctccggccgcgcgccccgcccttgcgctcagcgccctctcaccgcccggctctgtgtgctccgggatggagcaggtgtgcagagggtgagaacccagctctgggaccatcgtgacgatgaagttacttagcaagactatcgacttgagcaaacttggacctgggcgactcggaccgatg

SEQ ID NO: 13106 - DNA, 203 bp, Homo sapiens
ggcgcgccagtccttcccataaggctcggattccaagtcatcctatgctcccctcagctagcaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 13107 - DNA, 203 bp, Homo sapiens
ggcgcgccagtcctcccgagctggctcggattccgcccgcgtgcgccaagggtcggcactcgaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 13108 - DNA, 203 bp, Homo sapiens
ggcgcgccagtcctctccaaccggctcggattccgcccgcgtgcgccatcccctcagctagcaggtgtgagcggctttctgcccgcagtctctacacagctcagcatcctgacgcctcctccccttgcagggaatgtctcgagaaacagactctgctgtgacgacttggccgccaggcaccgatcctccgactcggaccgatg

SEQ ID NO: 13109 - DNA, 203 bp, Homo sapiens
ggcgcgccagtccttagagcgcggctcggattccgcccgcgtgcgccatcccctcagctagcaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 13110 - DNA, 203 bp, Homo sapiens
ggcgcgccagtcctggtccgtgggctcggattccgcccgcgtgcgccatcccctcagctagcaggtgtgagcggctttctgcccgcagtctctacacagctcagcatcctgacgcctcctccccttgcaggggcgtgaagctacttcagactctgctgtgcaattaacaggaaaaggcaccgatcctccgactcggaccgatg

SEQ ID NO: 13111 - DNA, 203 bp, Homo sapiens
ggcgcgccagtcctatgtgagaggctcggattccgcccgcgtgcgccatcccctcagctagcccaaacagcgacagttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 13112 - DNA, 203 bp, Homo sapiens
ggcgcgccagtcctggacaaccggctgcagcctgcaccgttgctgcccgctgcccaggacgctcaacccaccgttagagccagagtggtgcctcctacagaccaatctgcggccccaaggtggggggccctacagagatgctccgagagccaaggacatgaagaacaagctggggatcttcagacggccgactcggaccgatg

SEQ ID NO: 13113 - DNA, 203 bp, Homo sapiens
ggcgcgccagtcctccgctgccggctgcagtggcattcgtgctcctccagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatcgactcggaccgatg

SEQ ID NO: 13114 - DNA, 203 bp, Homo sapiens
ggcgcgccagtcctagtattaaggctgcagtggcgacgagcggaacggagtgcgggttcccggggagggggcgtgcaggatcgggttgtggggggtgcgctgtagggctaaggagaagatgagctttggggggccctgaggaggagtctgcagcaaccacaccgaggacagggtcgcagcgggggcatcgactcggaccgatg

SEQ ID NO: 13115 - DNA, 203 bp, Homo sapiens
ggcgcgccagtcctctatagccggctgcagtggcgacgagcggaacggagtgcgggttcccggggagggggcgtgcaggatcgggttgtggggggtgcgctgtatcctctgctcattcatgagctttggggggccctgaggaggaggggagtcaggattaaccgaggacagggtcgcagcgggggcatcgactcggaccgatg

SEQ ID NO: 13116 - DNA, 203 bp, Homo sapiens
ggcgcgccagtcctgcacctcaggctgcagtggcgacgagcggaacggagtgcgggttcccgttcgttcaatagtaaggatcgggttgtggggggtgcgctgtagggctaaggagaagatgagctttggggggccctgaggaggaggggagtcaggattaaccgaggacagggtcgcagcgggggcatcgactcggaccgatg

SEQ ID NO: 13117 - DNA, 203 bp, Homo sapiens
ggcgcgccagtcctaggaacggggctgcagtggcgacgagcggaacggcagtaaccgaggacgggagggggcgtgcaggatcgggttgtggggggtgcgctgtagggctaaggagaagatgagctttggggggccctgaggaggaggggagtcaggattaaccgaggacagggtcgcagcgggggcatcgactcggaccgatg

SEQ ID NO: 13118 - DNA, 203 bp, Homo sapiens
ggcgcgccagtcctatcgggtcggctggtcgatccgccatttcccctggtagacctggcagatgaggctagaaataccccactggcgacagtgttctagcctgcgtggctgcctgcacaccctatgggtgtgaagccaaacaatggacaaggtgtgaagagccccgtgtgctcgctttgagtcctccgcgactcggaccgatg

SEQ ID NO: 13119 - DNA, 203 bp, Homo sapiens
ggcgcgccagtcctcctgctcgggctggtcgatccgccatttcccctggtagacctggcagatgaggctagaaataccccactggcgacagtgttctagcctgcgtggctgcctgcacaccctatgggtgtgtttatccgacggtaacaaggtgtgaagagccccgtgtgctcgctttgagtcctccgcgactcggaccgatg

SEQ ID NO: 13120 - DNA, 203 bp, Homo sapiens
ggcgcgccagtcctcactgtgaggctggtcgatccgccatttcccctggtagacctggcagatgaggctagaaataccccactggcgacagtgttctagcctgctgttggcgtgaggaaccctatgggtgtgaagccaaacaatggacaaggtgtgaagagccccgtgtgctcgctttgagtcctccgcgactcggaccgatg

SEQ ID NO: 13121 - DNA, 203 bp, Homo sapiens
ggcgcgccagtcctcattaggaggctggtcgatccgccatttcccctggtagacctggcagatgaggctagaaataccccactggcgacatatgctgcagtgttgtggctgcctgcacaccctatgggtgtgaagccaaacaatggacaaggtgtgaagagccccgtgtgctcgctttgagtcctccgcgactcggaccgatg

SEQ ID NO: 13122 - DNA, 203 bp, Homo sapiens
ggcgcgccagtcctgttgtaacggcttgggtccagactgcgccacagcctctcgggagacgtgggccctcggaacctttttagtgccggactccgggccgcaggcagtcccgcggcagcaggatcacaggtggcagggactcagctcggaattctgtatacgggccaatttgtcatcccagtctttcacgactcggaccgatg

SEQ ID NO: 13123 - DNA, 203 bp, Homo sapiens
ggcgcgccagtcctgcgcatgcggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcacgactcggaccgatg

SEQ ID NO: 13124 - DNA, 203 bp, Homo sapiens
ggcgcgccagtcctcctgggtcggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggtatgtccatccagtcgactcggaccgatg

SEQ ID NO: 13125 - DNA, 203 bp, Homo sapiens
ggcgcgccagtcctatggtgagggcttgggtccagactgcgccacagcctctcgggagacgtgggccctcggaacctttttagtgccggactccgggccgcaggcagtcccgcggcagcaggatcacaggtggcagggactcagcttaatccatctgcctgaaaaagcacctggatcccagtctttcacgactcggaccgatg

SEQ ID NO: 13126 - DNA, 203 bp, Homo sapiens
ggcgcgccagtcctattacatgggcttgggtccatttctacttgagcgctctcgggagacgtgggccctcggaacctttttagtgccggactccgggccgcaggcagtcccgcggcagcaggatcacaggtggcagggactcagctcggaattctgtatagaaaaagcacctggatcccagtctttcacgactcggaccgatg

SEQ ID NO: 13127 - DNA, 203 bp, Homo sapiens
ggcgcgccagtcctccagctacggctttctgcccgcagtctctacacagctcagcatcctgaaagaaaacagatacgcaggggcgtgaagctacttcagactctgctgtgacgacttggccgccaggcaccgatcctccccggtgagaaggtccacgaatcttactgcagacagatttgctcagcgcgcgactcggaccgatg

SEQ ID NO: 13128 - DNA, 203 bp, Homo sapiens
ggcgcgccagtcctctcccaaaggctttctgcccgcagtctctacacagctcagcatcctgacgcctcctccccttgcaggggcgtgaagctacttcagactctagaaatcgcttgctgccgccaggcaccgatcctccccggtgagaaggtccacgaatcttactgcagacagatttgctcagcgcgcgactcggaccgatg

SEQ ID NO: 13129 - DNA, 203 bp, Homo sapiens
ggcgcgccagtcctttgtagtaggctttctgcccgcagtctctacacagctcagcatcctgacgcctcctccccttgcaggggcgtgaagctacttcagactctgctgtgacgacttggccgccaggcaccgatcctccccggtgagaaggtccacgaattactggcggtctgaatttgctcagcgcgcgactcggaccgatg

SEQ ID NO: 13130 - DNA, 203 bp, Homo sapiens
ggcgcgccagtcctctcggccaggctttctgcccgcagtctctacacagctcagcatcctgacgcctcctccccttgcaggggcgtgaagctacttcagactctgctgtgacgacttggccgccaggcaccgatcctccccggtgatttaacgtcgattacttactgcagacagatttgctcagcgcgcgactcggaccgatg

SEQ ID NO: 13131 - DNA, 203 bp, Homo sapiens
ggcgcgccagtcctatgagcccggctttctgcccgcagtctctacacagctcagcatcctgacgcctcctccccttgcaggggcgtgaagtgctcctcctagtagctgtgacgacttggccgccaggcaccgatcctccccggtgagaaggtccacgaatcttactgcagacagatttgctcagcgcgcgactcggaccgatg

SEQ ID NO: 13132 - DNA, 203 bp, Homo sapiens
ggcgcgccagtcctcgtgtcatggctttctgcccgcagtctctacacagctcagcatcctgacgcctcctcccctttatcatagtatgttctacttcagactctgctgtgacgacttggccgccaggcaccgatcctccccggtgagaaggtccacgaatcttactgcagacagatttgctcagcgcgcgactcggaccgatg

SEQ ID NO: 13133 - DNA, 203 bp, Homo sapiens
ggcgcgccagtcctatgggctgggctttctgcccgcagtctctacacattaagttgcgtcagcgcctcctccccttgcaggggcgtgaagctacttcagactctgctgtgacgacttggccgccaggcaccgatcctccccggtgagaaggtccacgaatcttactgcagacagatttgctcagcgcgcgactcggaccgatg

SEQ ID NO: 13134 - DNA, 203 bp, Homo sapiens
ggcgcgccagtccttccaccatggctttctgccctacacacgactgatgctcagcatcctgacgcctcctccccttgcaggggcgtgaagctacttcagactctgctgtgacgacttggccgccaggcaccgatcctccccggtgagaaggtccacgaatcttactgcagacagatttgctcagcgcgcgactcggaccgatg

SEQ ID NO: 13135 - DNA, 203 bp, Homo sapiens
ggcgcgccagtcctccgtggtggggaaacgcacctgattttttacttattagtttgttttttctttaacctttcagcatcacagaggaagtagactgatattaacaatacttactaataataacgtgcctcatgaaataaagatccttgctccgggctcctaaaaatttcctgcgtctcatgccaagacgactcggaccgatg

SEQ ID NO: 13136 - DNA, 203 bp, Homo sapiens
ggcgcgccagtcctgaatatccgggaaacgcacctgattttttacttattagtttgttttttctttaacctttcagcatcacagaggaagtagactgatattaacaatacttactaatgcctgttactaatgtgaaataaagatccgaaaggaattggaataaaaatttcctgcgtctcatgccaagacgactcggaccgatg

SEQ ID NO: 13137 - DNA, 203 bp, Homo sapiens
ggcgcgccagtcctcttcagatgggaaacgcacctgattttttacttattagtttgttttttctttaacctttcagcatcacagaggaagtagactgatattaatgcgctactggtcgaataacgtgcctcatgaaataaagatccgaaaggaattggaataaaaatttcctgcgtctcatgccaagacgactcggaccgatg

SEQ ID NO: 13138 - DNA, 203 bp, Homo sapiens
ggcgcgccagtcctgcgtaattgggaatgtgagggtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgcgactcggaccgatg

SEQ ID NO: 13139 - DNA, 203 bp, Homo sapiens
ggcgcgccagtccttcaacctagggaccgctgcatgtatcctcagctcctaacactgtgtctggtacacattgtttgatggttttgatgtttcagattcgttatatttcacaaacacaaggcttgccagctgaatatcttctcagtgccggaacaaaaacaaccaggtttttcaacagagatcctaatcgactcggaccgatg

SEQ ID NO: 13140 - DNA, 203 bp, Homo sapiens
ggcgcgccagtcctcttccctggggagagccatacgtagggttaatcgcggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgacgactcggaccgatg

SEQ ID NO: 13141 - DNA, 203 bp, Homo sapiens
ggcgcgccagtcctctttaagcgggagagccatagtggtctgcggaaccggtgagtacaccgcgtcgagtttaggtaccgggtcctttcttggataaacccgctcaatgcctggagatttgggcgtgcccccgcaagactgctagccgagtagtgttgggtcgcgaaaggccttgtggtactgcctgacgactcggaccgatg

SEQ ID NO: 13142 - DNA, 203 bp, Homo sapiens
ggcgcgccagtcctaaccgacggggagagccatagtggtctgcggaaccggtgagtacaccggaattgccaggacgaccgggtcctttcttggataaacccgctattacttcatcatgttgggcgtgcccccgcaagactgctagccgagtagtgttgggtcgcgaaaggccttgtggtactgcctgacgactcggaccgatg

SEQ ID NO: 13143 - DNA, 203 bp, Homo sapiens
ggcgcgccagtcctagacggttgggagatttgagagaaagactccagaagcccgcggggagagcaggggttctggggaagataaagcccttcatccaggatcccatgactcgtcgttcatgagatggaccaaacgcccccggcgcgtcctgaatatctggtctcagggattcgaactccccctgtgagcgactcggaccgatg

SEQ ID NO: 13144 - DNA, 203 bp, Homo sapiens
ggcgcgccagtcctcaagttgagggagatttgagagaaagactccagaagcccgcggggagagcaggggttctggggaagataaagcccttcatccaggatccctctgtgaccataagatgagatggaccaaacgcccccggcgcgtcctgaatatctggtctcagggattcgaactccccctgtgagcgactcggaccgatg

SEQ ID NO: 13145 - DNA, 203 bp, Homo sapiens
ggcgcgccagtcctttcgcgcggggatcctaggcatttttggttgcgcaattcaagtgtcctatttaaaatgggacaaatagtgacattcttccaggaagtgcctcatgtaatagaagaggtgatgaacattgttctcattgcactgtctgtactagcagctgatccttagacatacaattttgcaaccgactcggaccgatg

SEQ ID NO: 13146 - DNA, 203 bp, Homo sapiens
ggcgcgccagtccttattaagtgggatcctaggcatttttggttgcgcaattcaagtgtcctcaccttccaattctaaatagtgacattcttccaggaagtgcctcatgtaatagaagaggtgatgaacattgttctcattgcactgtctgtactagcagtgctgaaaggtctgtacaattttgcaaccgactcggaccgatg

SEQ ID NO: 13147 - DNA, 203 bp, Homo sapiens
ggcgcgccagtcctccaacggcgggatcctaggcgttttttagtcacgcttaaatctttgattgcgtcaatcatgggtcaattgttcagcttttttgaagaagttccgaatatcatccatgaggctatcaacatagctctgatagcagtgagcttaattgagatagaagctattatgattaacttgtgcgactcggaccgatg

SEQ ID NO: 13148 - DNA, 203 bp, Homo sapiens
ggcgcgccagtcctaacattgggggatcctaggcgttttttagtcacgcttaaatctttgattgcgtcaatcatgggtcaattgttcagcttttttgaagaagttccgaatatcatccatgaggctatcaacatagctctgatagcagtgagcttaattgctgccttgaaagggatgattaacttgtgcgactcggaccgatg

SEQ ID NO: 13149 - DNA, 203 bp, Homo sapiens
ggcgcgccagtcctggtttcgggggatcctaggcgttttttagtcacgcttaaatctttgattgcgtcaatcatgggtcaattgttcagcttttttgaagaagttccgaatatcatccatgaggctatcaacatagctctgatagctccaccgcgcgcacctgccttgaaagggatgattaacttgtgcgactcggaccgatg

SEQ ID NO: 13150 - DNA, 203 bp, Homo sapiens
ggcgcgccagtccttcattcctgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccagtccaatagtatgagccccgcggcagccgactcggaccgatg

SEQ ID NO: 13151 - DNA, 203 bp, Homo sapiens
ggcgcgccagtcctgggaaatcgggcagagagagggacgccccctcctcctccccgcctcttgtgaggcgcgcggagccgcctcccctgggtcaggtctgatgggccggtgggcgcgctagtggtggccgccaccgccgaaaccgtgacggggggtaatgccagttccgcgtccagccccgcggcagccgactcggaccgatg

SEQ ID NO: 13152 - DNA, 203 bp, Homo sapiens
ggcgcgccagtccttctcagtcgggcataaaacacgcctccacccctgccctcctcaggccccctccgcctccacccctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13153 - DNA, 203 bp, Homo sapiens
ggcgcgccagtccttgatggcggggcccaagcgtaaccaggctcttctgattggccggtgtacttcagtttccgtccaaggtccgcctcctacctccttctgcttcggtccttaggataagaccatggccttgagagcatgtggctgctgatatgagttgagatgcctcattcccaaagtggacaacacgactcggaccgatg

SEQ ID NO: 13154 - DNA, 203 bp, Homo sapiens
ggcgcgccagtcctgagcggcagggcccaagcgtaaccaggctcttctgattggccggtgtacttcagtttccgtccaaggtccgcctcctacctccttctgcttcggtccttaggataagaccatggccttgagagcatgtggcttgatcatcttccgaagatgcctcattccacgtcatatattgccgactcggaccgatg

SEQ ID NO: 13155 - DNA, 203 bp, Homo sapiens
ggcgcgccagtcctggcatgtcgggcccaagcgtaaccaggctcttctgattggccggtgtacttcagtttccgtccaaggtccgcctcctacctccttctgcttcggtccttaggataagaccatggccttgagagcatgtggcttgatcatcttccgaagatgcctcattcccaaagtggacaacacgactcggaccgatg

SEQ ID NO: 13156 - DNA, 203 bp, Homo sapiens
ggcgcgccagtcctcttcatcagggcccaagcgtaaccaggctcttctgattggccggtgtacttcagtttccgtccaaggtccgcctcctacctccttctgcttcggtccttaggataagaccatggccttttcgcttcaattgatgatcatcttccgaagatgcctcattcccaaagtggacaacacgactcggaccgatg

SEQ ID NO: 13157 - DNA, 203 bp, Homo sapiens
ggcgcgccagtcctggagccgcgggcccaagcgtaaccaggctcttctgattggccggtgtatcggttaggtttcgcaaggtccgcctcctacctccttctgcttcggtccttaggataagaccatggccttgagagcatgtggcttgatcatcttccgaagatgcctcattcccaaagtggacaacacgactcggaccgatg

SEQ ID NO: 13158 - DNA, 203 bp, Homo sapiens
ggcgcgccagtcctcgcgactggggcccaagcgtaaccaggctcttctttgccataacacctcttcagtttccgtccaaggtccgcctcctacctccttctgcttcggtccttaggataagaccatggccttgagagcatgtggcttgatcatcttccgaagatgcctcattcccaaagtggacaacacgactcggaccgatg

SEQ ID NO: 13159 - DNA, 203 bp, Homo sapiens
ggcgcgccagtcctggcccttagggcgggcggccgcagagcagcaccggccgtggctccggtagcagcaagttcgaaccccgctcccgctaatagggccactcggctccttcggcccttgggcctccaaacaccagtccccggcagctcgttgcgcattgcgctctccccgccaccaggatgccggtacgactcggaccgatg

SEQ ID NO: 13160 - DNA, 203 bp, Homo sapiens
ggcgcgccagtcctgttctagggggcgggcggccgcagagcagcaccgtatccttaaggcaaagcagcaagttcgaaccccgctcccgctccgcttcggttctcgctccttcggcccttgggcctccaaacaccagtccccggcagctcgttgcgcattgcgctctccccgccaccaggatgccggtacgactcggaccgatg

SEQ ID NO: 13161 - DNA, 203 bp, Homo sapiens
ggcgcgccagtcctgcccagtggggcgtggcgttacagagcctctagcgctgggtgttggggacctgacgctatggagctctcggagtttaacctaattgtagcgtgagtggggggttcctgctgcgggatgagaacgtagacgccagtggctcactcgctcctggcaccttccctttcaggctccagcgactcggaccgatg

SEQ ID NO: 13162 - DNA, 203 bp, Homo sapiens
ggcgcgccagtcctcattctcagggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagcgactcggaccgatg

SEQ ID NO: 13163 - DNA, 203 bp, Homo sapiens
ggcgcgccagtccttgtaattagggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttcctaggaccatagttacgactcggaccgatg

SEQ ID NO: 13164 - DNA, 203 bp, Homo sapiens
ggcgcgccagtcctcacagttcgggcgtggcgttacagagcctctagcgctgggtgttggggacctgacgctatggagctctcggagttttgtgggggacggctgtgagtggggggttcctgctgcgggatgagaacgtagacgccgtgctgaagtgtcgtcctggcaccttccctttcaggctccagcgactcggaccgatg

SEQ ID NO: 13165 - DNA, 203 bp, Homo sapiens
ggcgcgccagtcctgtgttcgtgggcgtggcgttctcttaatctgctggctgggtgttggggacctgacgctatggagctctcggagttttgtgggggacggctgtgagtggggggttcctgctgcgggatgagaacgtagacgccagtggctcactcgctcctggcaccttccctttcaggctccagcgactcggaccgatg

SEQ ID NO: 13166 - DNA, 203 bp, Homo sapiens
ggcgcgccagtcctcgcagaatgggctaaggatgggaactgatggttagcacgtaaccttcagagagtgcggatctgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 13167 - DNA, 203 bp, Homo sapiens
ggcgcgccagtcctgggcgcgtgggctaaggatgtcctacaggtaccccacaaatgaaaattgagagtgcggatctgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 13168 - DNA, 203 bp, Homo sapiens
ggcgcgccagtcctcgtggttagggctaaggatgtcctacaggtacccgcacgtaaccttcaattgtgagctcggcgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 13169 - DNA, 203 bp, Homo sapiens
ggcgcgccagtccttaacgcccgggctaaggatgtcctacaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 13170 - DNA, 203 bp, Homo sapiens
ggcgcgccagtcctgaggcaccgggctccgggatctggtcgttagggtcaggtgagaaagcgagacaggcaggtagggaaatcgtgaggtgagcgtggtcctagctccttgtggcagagcctagagagaaggcgaggacgctgaagaaccaggcggacagctggcagagagagaagttggctagcatgcgactcggaccgatg

SEQ ID NO: 13171 - DNA, 203 bp, Homo sapiens
ggcgcgccagtcctccatcacagggctccgggatgaaaggagggaacgcaggtgagaaagcgagacaggcaggtagccggtgttcactcggagcgtggtcctagctccttgtggcagagcctagagagaaggcgaggacgctgaagaaccaggcggacagctggcagagagagaagttggctagcatgcgactcggaccgatg

SEQ ID NO: 13172 - DNA, 203 bp, Homo sapiens
ggcgcgccagtcctttgtcaccgggctccgggatgaaaggagggaacgcaggtgagaaagcgagacaggcaggtagggaaatcgtgaggtgagcgtggtcctagctccttgtggcagagcctagagagaaggcgaggacgctgaagaaccaggcggacagtcttatcttgtttcagttggctagcatgcgactcggaccgatg

SEQ ID NO: 13173 - DNA, 203 bp, Homo sapiens
ggcgcgccagtcctacgactaggggctccgggatgaaaggagggaacgcaggtgagaaagcgagacaggcaggtagggaaatcgtgaggttccttgctcgtactctccttgtggcagagcctagagagaaggcgaggacgctgaagaaccaggcggacagctggcagagagagaagttggctagcatgcgactcggaccgatg

SEQ ID NO: 13174 - DNA, 203 bp, Homo sapiens
ggcgcgccagtccttttcacaagggctccgggatgaaaggagggaacgttacgctacgttaaagacaggcaggtagggaaatcgtgaggtgagcgtggtcctagctccttgtggcagagcctagagagaaggcgaggacgctgaagaaccaggcggacagctggcagagagagaagttggctagcatgcgactcggaccgatg

SEQ ID NO: 13175 - DNA, 203 bp, Homo sapiens
ggcgcgccagtcctgagagtttggggaggttggggacgggcctggcagttgtgaactcgaacctgccgctgtcgccgcggcggggcggggagcgagagtgggccgcggaggccggccttcgggctccatggacgggcgccgcgtccagaatggtggacgagcagagcagaggaagaaccgatgctggacgactcggaccgatg

SEQ ID NO: 13176 - DNA, 203 bp, Homo sapiens
ggcgcgccagtcctttcagcctggggcagacagcgccggtggtgttcagtacgccacaagcgacacaaatgaacaccgtcataatcatgagccagcacttctaccctagccgggcccagcccccgagcagtgcagcctcccgagtgcagagtgcagcccctgcccgccctggcccagctgcccatgtccgactcggaccgatg

SEQ ID NO: 13177 - DNA, 203 bp, Homo sapiens
ggcgcgccagtcctcgcctactggggcagacagcgccggtggtgttcagtacgccacaagcgacacaaatgaacacgccttctcagcccccgtctataggtggtcctagccgggcccagcccccgagcagtgcagcctcccgagtgcagagtgcagcccctgcccgccctggcccagctgcccatgtccgactcggaccgatg

SEQ ID NO: 13178 - DNA, 203 bp, Homo sapiens
ggcgcgccagtcctctccatagggggcagacagcgccggtggtgttcagtacgccacaagcgacacaaatgaacacgccttctcagccccgccagcacttctaccctagccgggcccagcccccgagcagtgcagcctcccgagtgcagagtgcagccccattatatgtcaatgcagctgcccatgtccgactcggaccgatg

SEQ ID NO: 13179 - DNA, 203 bp, Homo sapiens
ggcgcgccagtcctttgctaacggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtccgactcggaccgatg

SEQ ID NO: 13180 - DNA, 203 bp, Homo sapiens
ggcgcgccagtcctggtaacacggggcagacagcgccggtggtgttcagtacgccacaagcgacacaaatgaacacgccttctcagccccgccagcacttctaccctagccgggcccagcccccgagcagtgcagcctcccgagtggcttcctgcaagagtgcccgccctggcccagctgcccatgtccgactcggaccgatg

SEQ ID NO: 13181 - DNA, 203 bp, Homo sapiens
ggcgcgccagtcctcgaacttaggggcagacagcgccggtggtgttcagtacgccacaagcgacacaaatgaacacgccttctcagccccgccagcacttctacgagcctgtttgatcgcccccgagcagtgcagcctcccgagtgcagagtgcagcccctgcccgccctggcccagctgcccatgtccgactcggaccgatg

SEQ ID NO: 13182 - DNA, 203 bp, Homo sapiens
ggcgcgccagtcctcataatatggggccacagcccgggctggggggagccggggtgcaagagggcaggctggatcaccggattagacgcgggaccgggctccgagtgtcaacgagagctagagacatgaggctgagctggttccgggtcctgacagtactgtccatctgcctgagcgccgtggccacgcgactcggaccgatg

SEQ ID NO: 13183 - DNA, 203 bp, Homo sapiens
ggcgcgccagtcctctatcttcggggccacagcccgggctggggggagccggggtgcaagagggcaggctggatcaggccgggcagaaggggaccgggctccgagtgtcaacgagagctagagacatgaggcaatttattgcaaatgtcctgacagtactgtccatctgcctgagcgccgtggccacgcgactcggaccgatg

SEQ ID NO: 13184 - DNA, 203 bp, Homo sapiens
ggcgcgccagtcctgtttctggggggccgcgcgtccaggcggcgagcggaagtgggtgtgagagcggaagtggccgataccttgtctttcctgggcggggaccgggcttgtcggtgaagcggcagtggcggcggcggcggcggctcggcaggcgggttcaggcttcgggggccagccgccgccatgatcgactcggaccgatg

SEQ ID NO: 13185 - DNA, 203 bp, Homo sapiens
ggcgcgccagtcctctgaggctggggccgcgcgtccaggcggcgagcggaagtgggtgtgagagcggaagtggccggctagagccgggggctgggcggggaccgggcttgtcggtgaagcggcagtggcggcggcggcggcggctctaatacaatccggcggcttcgggggccagccgccgccatgatcgactcggaccgatg

SEQ ID NO: 13186 - DNA, 203 bp, Homo sapiens
ggcgcgccagtccttacttcttggggccgcgcgtgttcttcttacttagaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcgactcggaccgatg

SEQ ID NO: 13187 - DNA, 203 bp, Homo sapiens
ggcgcgccagtcctcggcagcgggggccgggcggccggcgcccccggctgctcccgccgccgcccggacccgcgccccgccggggcagcggtggtgagagccccgactccccggacgccgcccgccgtgccatggggttcccggccaatcgaaaatcagccgcgctgtgctgcggcctcctggccccgcgactcggaccgatg

SEQ ID NO: 13188 - DNA, 203 bp, Homo sapiens
ggcgcgccagtccttcgtatgtggggcgcatcccctggcgactcctcccgttccctcttccgcttgcgctgccgcaaacttgcattagcgctggagcgcaccttcatcgccatcaagccggacggcgtgcagcgcggcctggtgggcgagatcatcaagcgcttcgagcagaagggattccgcctcgtcgactcggaccgatg

SEQ ID NO: 13189 - DNA, 203 bp, Homo sapiens
ggcgcgccagtcctagaaagacggggcgcatcccctggcgactcctcccgttccctcttccgcttgcgctgccgcaggaccatggccaacctggagcgcaccttcatcgccatcaagccggacggcgtgcagcgcggcctggtgggcgagatcatcaagctacgttgatcagctggattccgcctcgtcgactcggaccgatg

SEQ ID NO: 13190 - DNA, 203 bp, Homo sapiens
ggcgcgccagtcctatcgaggaggggcgcatcccctggcgactcctcccgttccctcttccgcttgcgctgccgcaggaccatggccaacctggagcgcaccttcatcgccatcaagccggacggcgtgcagcgcggcctggtgggttttcgatcattttgcttcgagcagaagggattccgcctcgtcgactcggaccgatg

SEQ ID NO: 13191 - DNA, 203 bp, Homo sapiens
ggcgcgccagtcctactaacatggggcgcatcccctggcgactcctcccgttccctcttccgcttgcgctgccgcaggaccatggccaacctggagcgcaccttcatcgccatcaagccggacggcgtgcaggtttaagctaaatccgagatcatcaagcgcttcgagcagaagggattccgcctcgtcgactcggaccgatg

SEQ ID NO: 13192 - DNA, 203 bp, Homo sapiens
ggcgcgccagtcctaataggccggggcgcatcccctggcgactcctccttacggtggcctatcttgcgctgccgcaggaccatggccaacctggagcgcaccttcatcgccatcaagccggacggcgtgcagcgcggcctggtgggcgagatcatcaagcgcttcgagcagaagggattccgcctcgtcgactcggaccgatg

SEQ ID NO: 13193 - DNA, 203 bp, Homo sapiens
ggcgcgccagtcctgatttctagggggtccgggagtctgctatgtgggcggaggtctagtgattccccgggataagcctcactcgtcccctctcggggggcggaacacccacctgctagccccgctgctctctttgctttcctcctcgcttcggtctcccccaactcctagcatcccctcctatcgctcgactcggaccgatg

SEQ ID NO: 13194 - DNA, 203 bp, Homo sapiens
ggcgcgccagtccttcatcatcgggggtccgggagtctgctatgtggggacgataagtcgaggctgaaaactgtcccctcactcgtcccctctcggggggcggaacacccacctgctagccccgctgctctctttgctttcctcctcgcttcggtctcccccaactcctagcatcccctcctatcgctcgactcggaccgatg

SEQ ID NO: 13195 - DNA, 203 bp, Homo sapiens
ggcgcgccagtcctccttagaggggggtccgggagtctgctatgtggggacgataagtcgagttccccgggataagcctcactcgtcccccgggaactcagcagacacccacctgctagccccgctgctctctttgctttcctcctcgcttcggtctcccccaactcctagcatcccctcctatcgctcgactcggaccgatg

SEQ ID NO: 13196 - DNA, 203 bp, Homo sapiens
ggcgcgccagtcctcgctcgccgggggtccgggagtctgctatgtggggacgataagtcgagttccccgggataagcctcactcgtcccctctcggggggcggaacacccacctgctagccccgctgctctctttgctttcctcctcgcttcggtctcccaatttggagttttgcccctcctatcgctcgactcggaccgatg

SEQ ID NO: 13197 - DNA, 203 bp, Homo sapiens
ggcgcgccagtcctggcctatggggggtccgggagtctgctatgtggggacgataagtcgagttccccgggataagcctcactcgtcccctctcggggggcggaacacccacctgctatgagattcaaagaatttgctttcctcctcgcttcggtctcccccaactcctagcatcccctcctatcgctcgactcggaccgatg

SEQ ID NO: 13198 - DNA, 203 bp, Homo sapiens
ggcgcgccagtcctaatttaccgggggtccgggatatcctggaccaaagacgataagtcgagttccccgggataagcctcactcgtcccctctcggggggcggaacacccacctgctagccccgctgctctctttgctttcctcctcgcttcggtctcccccaactcctagcatcccctcctatcgctcgactcggaccgatg

SEQ ID NO: 13199 - DNA, 203 bp, Homo sapiens
ggcgcgccagtcctgactctgcggggtatactggcaaacttgcacattcggaaaaaatggggcaaataagaatttgataagtgctatttaagtctaaccttttcaatcagaaatggggtgcaattcactgagcatgataaaggttagattacaaaatttatttgacaatgacgaagtagcattgttaacgactcggaccgatg

SEQ ID NO: 13200 - DNA, 203 bp, Homo sapiens
ggcgcgccagtcctcgttacccggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcgactcggaccgatg

SEQ ID NO: 13201 - DNA, 203 bp, Homo sapiens
ggcgcgccagtcctgcgggatcgggtagcccaagaaccttcgggtgagattttactcttacatcttttcctataccgatcatggcagtccttctgctcctactcgtggtggaggccggggctattttagccccggccacccatgcttgtagcgcgaaagggcaatatttcctcacaaactgttgcgcccgactcggaccgatg

SEQ ID NO: 13202 - DNA, 203 bp, Homo sapiens
ggcgcgccagtcctccgtccgcgggtagcccaagaaccttcgggtgagggcgggtggcatttcggacaaggggtttgatcatggcagtccttctgctcctactcgtggtggaggccggggctattttagccccggccacccatgcttgtagcgcgaaagggcaatatttcctcacaaactgttgcgcccgactcggaccgatg

SEQ ID NO: 13203 - DNA, 203 bp, Homo sapiens
ggcgcgccagtcctcttagtttgggtagcccaagaaccttcgggtgagggcgggtggcattttcttttcctataccgatcatggcagtccttctgctcctactccgatgaagcagataggctattttagccccggccacccatgcttgtagcgcgaaagggcaatatttcctcacaaactgttgcgcccgactcggaccgatg

SEQ ID NO: 13204 - DNA, 203 bp, Homo sapiens
ggcgcgccagtcctgtataagagggtagcccaagaaccttcgggtgagggcgggtggcattttcttttcctataccgatcatggcagtccttctgctcctactcgtggtggaggccggggctattttagcccttcgtgttgtgaggtgtagcgcgaaagggcaatatttcctcacaaactgttgcgcccgactcggaccgatg

SEQ ID NO: 13205 - DNA, 203 bp, Homo sapiens
ggcgcgccagtccttggtggttgggtagcccaagaaccttcgggtgagggcgggtggcattttcttttcctataccgatcatggcagtccttctgctcctactcgtggtggaggccggtctgtgaggccgtacggccacccatgcttgtagcgcgaaagggcaatatttcctcacaaactgttgcgcccgactcggaccgatg

SEQ ID NO: 13206 - DNA, 203 bp, Homo sapiens
ggcgcgccagtcctcagacgtggggtccgccgcgagaatattcaacttaggtttgtccccgccgccccgacgcttccgccgggtccgtcggcacgtcggccctgcctcccggaccaccctgcggggcgcaccagcgatctggggtgcggggctcggcctccctgcgctcctggctgacggtcttaacccgactcggaccgatg

SEQ ID NO: 13207 - DNA, 203 bp, Homo sapiens
ggcgcgccagtcctggcgaagagggtccgccgcggtcgaggatcctggaggtttgtccccgccgccccgacgcttccgccgggtccgtcggcacgtcggccctgcctcccggaccaccctgcggggcgcaccagcgatctggggtgcggggctcggcctccctgcgctcctggctgacggtcttaacccgactcggaccgatg

SEQ ID NO: 13208 - DNA, 203 bp, Homo sapiens
ggcgcgccagtcctgattgtaggggtccgccgcggtcgaggatcctggaggtttgtccccgccgccccgacgcttccgccgggtccgtcggcacgtcggccctgcctcccggaccaccctgcggggcgcaccagcgatctggggtgcggggctcggcctctaatatacaggctttgacggtcttaacccgactcggaccgatg

SEQ ID NO: 13209 - DNA, 203 bp, Homo sapiens
ggcgcgccagtcctagggagtcgggtccgccgcggtcgaggatcctgggacaaaaggagtcacgccccgacgcttccgccgggtccgtcggcacgtcggccctgcctcccggaccaccctgcggggcgcaccagcgatctggggtgcggggctcggcctccctgcgctcctggctgacggtcttaacccgactcggaccgatg

SEQ ID NO: 13210 - DNA, 203 bp, Homo sapiens
ggcgcgccagtcctgttggcatgggtgtaaactagcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccgactcggaccgatg

SEQ ID NO: 13211 - DNA, 203 bp, Homo sapiens
ggcgcgccagtcctgtaagacagggttctacttgagatttccctcgtggtgccagggtccggcgagcatcacgccgaggcccattttccagacgaccacgacgacagaatatattgttactctggcgccccttaccagcttccagtctctcgaggtggccagtgtggtgcttggtccttgtttccaggcgactcggaccgatg

SEQ ID NO: 13212 - DNA, 203 bp, Homo sapiens
ggcgcgccagtcctacagccaagggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggcgactcggaccgatg

SEQ ID NO: 13213 - DNA, 203 bp, Homo sapiens
ggcgcgccagtcctgaagttacgggttctacttgagatttccctcgtggtgccagggtccggcgagcatcacgccgaggcccattttccagacgaccacgacgaggccggggtcacgaactctggcgccccttaccagcttccagtctctcgaggtggccctctgtccatggaatccttgtttccaggcgactcggaccgatg

SEQ ID NO: 13214 - DNA, 203 bp, Homo sapiens
ggcgcgccagtcctcccttgcagggttctacttgagatttccctcgtggtgccagggtccggcgagcatcacgccgaggcccattttccagacgaccacgacgaggccggggtcacgaactctggcgccccttaccagcttccagttatatagacccttgagtgtggtgcttggtccttgtttccaggcgactcggaccgatg

SEQ ID NO: 13215 - DNA, 203 bp, Homo sapiens
ggcgcgccagtcctcttaccgtgggttctacttgagatttccctcgtggtgccagggtccggcgagcatcacgccgtttatacacgatatgacgaccacgacgaggccggggtcacgaactctggcgccccttaccagcttccagtctctcgaggtggccagtgtggtgcttggtccttgtttccaggcgactcggaccgatg

SEQ ID NO: 13216 - DNA, 203 bp, Homo sapiens
ggcgcgccagtccttgagataagggttctacttgttgcgatatgatgagtgccagggtccggcgagcatcacgccgaggcccattttccagacgaccacgacgaggccggggtcacgaactctggcgccccttaccagcttccagtctctcgaggtggccagtgtggtgcttggtccttgtttccaggcgactcggaccgatg

SEQ ID NO: 13217 - DNA, 203 bp, Homo sapiens
ggcgcgccagtcctataagttggggttgctgacgaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgcgactcggaccgatg

SEQ ID NO: 13218 - DNA, 203 bp, Homo sapiens
ggcgcgccagtccttgagtgatggtaaggagaggaggttacggggaacgacgcgctgctttcatgccctttcttgttctaccttcatcggccgaggtggacacccttaacacctcagaccctccggcccctgaagcatggccagcagcggcatggctgacagcgccaaccacctgcccttctttttcgcgactcggaccgatg

SEQ ID NO: 13219 - DNA, 203 bp, Homo sapiens
ggcgcgccagtcctaccatcaaggtaaggagaggaggttacggggaacgacgcgctgctttcatgccctttcttgttctaccttcatcggccgaggtggacacctgcgcaggtgtgtgattctttctatgctaagcatggccagcagcggcatggctgacagcgccaaccacctgcccttctttttcgcgactcggaccgatg

SEQ ID NO: 13220 - DNA, 203 bp, Homo sapiens
ggcgcgccagtcctgaatcctcggtaaggagaggaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcgcgactcggaccgatg

SEQ ID NO: 13221 - DNA, 203 bp, Homo sapiens
ggcgcgccagtcctggagactaggtaaggagaggaggttacggggaacgacgcgctgctttcatgccctttcttgttctaccttcatcggccgaggtggacacctgcgcaggtgtgtgccctccggcccctgaagcatggccagcagcggcatggctgacttgtatcggactaagcccttctttttcgcgactcggaccgatg

SEQ ID NO: 13222 - DNA, 203 bp, Homo sapiens
ggcgcgccagtcctagctgcggggtaaggagaggaggttacggggaacgacgcgctgctttcatgccctttcttgttctaccttcatcggccgaggtggacacctgcgcaggtgtgtgccctccggcccctgaagcatggccagcattaattgccaccctagcgccaaccacctgcccttctttttcgcgactcggaccgatg

SEQ ID NO: 13223 - DNA, 203 bp, Homo sapiens
ggcgcgccagtcctcttatgtgggtaaggagaggaggttacggggaacgacgcgctgctttcatgccctttcttgttctaccttcatcggccgaggtggacacctgcgcaggtgtgtgccctccggcccctggtttggtcgacattgcggcatggctgacagcgccaaccacctgcccttctttttcgcgactcggaccgatg

SEQ ID NO: 13224 - DNA, 203 bp, Homo sapiens
ggcgcgccagtccttaaacaatggtaaggagaggaggttacggggaacgacgcgctgctttctgctggacgtaatctctaccttcatcggccgaggtggacacctgcgcaggtgtgtgccctccggcccctgaagcatggccagcagcggcatggctgacagcgccaaccacctgcccttctttttcgcgactcggaccgatg

SEQ ID NO: 13225 - DNA, 203 bp, Homo sapiens
ggcgcgccagtccttcccgttcggtacggggcgtctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagccgactcggaccgatg

SEQ ID NO: 13226 - DNA, 203 bp, Homo sapiens
ggcgcgccagtcctggagtagtggtagattttgtgctacattcactctttatggtaaatccaaacattatgataaaccaggctcccgccaaaatggtttcacagcattcgctaatactgtagaggatgctgttaacaaactggttttcttagctgttgactttattacctggcgcagacaggagttaacgactcggaccgatg

SEQ ID NO: 13227 - DNA, 203 bp, Homo sapiens
ggcgcgccagtcctcttccactggtagattttgtgctacattcactctttatggtaaatccatcggccggagacggtattttggagtaataaatggtttcacagcattcgctaatactgtagaggatgctgttaacaaactggttttcttagctgttgactttattacctggcgcagacaggagttaacgactcggaccgatg

SEQ ID NO: 13228 - DNA, 203 bp, Homo sapiens
ggcgcgccagtcctaggtattgggtagcaacagtggtgagttcgttggatggcttaagccctccagcggttaggtacgtcagtggttcgacgccttggaataaaggtctcgagatgccacgtggacgagggcatgcccaaagcacatcttaacctgagcgggggtcgcccaggtaaaagcagttttaacgactcggaccgatg

SEQ ID NO: 13229 - DNA, 203 bp, Homo sapiens
ggcgcgccagtcctgaaaccctggtagcaacagtggtgagttcgttggatggcttaagccctgagtacagggtagtcgtcagtggttcgacgccttggaataaaggtctcgagatgccacgtggacgagggcatgcccaaagcacatcttaacctgagcgggggtcgcccaggtggctaatacagccccgactcggaccgatg

SEQ ID NO: 13230 - DNA, 203 bp, Homo sapiens
ggcgcgccagtcctacggattaggtagcaacagtggtgagttcgttggcatctcgtttaagagagtacagggtagtcgtcagtggttcgacgccttggaataaaggtctcgagatgccacgtggacgagggcatgcccaaagcacatcttaacctgagcgggggtcgcccaggtaaaagcagttttaacgactcggaccgatg

SEQ ID NO: 13231 - DNA, 203 bp, Homo sapiens
ggcgcgccagtcctgtgagtacggtatcgattcgcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccgcgactcggaccgatg

SEQ ID NO: 13232 - DNA, 203 bp, Homo sapiens
ggcgcgccagtcctttgaagatggtcaagtgttcggtctaatatagtctgtgtgacctgcaggcattttgtgaaaagggtaaagtatgaaagctactctcagaaaagtacttatgtattgatgagagccttaaaatgactttatattcacaaaactgctggaagacaatgatctggggtatcacattccgactcggaccgatg

SEQ ID NO: 13233 - DNA, 203 bp, Homo sapiens
ggcgcgccagtcctggcagtaaggtccttttgtgcctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccgactcggaccgatg

SEQ ID NO: 13234 - DNA, 203 bp, Homo sapiens
ggcgcgccagtcctaccggcagggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagcgactcggaccgatg

SEQ ID NO: 13235 - DNA, 203 bp, Homo sapiens
ggcgcgccagtcctagtgggacggtctggcatctacaaagcctcttggccgtgttctgaacttgaagcctggaggagttctctgctcagcacagccaaggaacagaattagaagaaaaggaaccctggcctgaggcaggtgacaaacattaccaccccaggacacacgacccatgcagatgcaaccagcgactcggaccgatg

SEQ ID NO: 13236 - DNA, 203 bp, Homo sapiens
ggcgcgccagtccttcccacctggtctggcatctacaaagcctcttggccgtgttctgaacttgaagcctggaggagttctctgctcagcacagccaaggaacagaattagaagaaaaggaaccctggcctggcttccaactatcgcattaccaccccagctgtgcacgatgcagcagatgcaaccagcgactcggaccgatg

SEQ ID NO: 13237 - DNA, 203 bp, Homo sapiens
ggcgcgccagtccttatacgtaggtctggcatctacaaagcctcttggccgtgttctgaacttgaagcctggaggagttctctgctcagcacagccaaggaacagaattagaagaaaatccggtagtagtgcaggcaggtgacaaacattaccaccccagctgtgcacgatgcagcagatgcaaccagcgactcggaccgatg

SEQ ID NO: 13238 - DNA, 203 bp, Homo sapiens
ggcgcgccagtcctacaagaatggtctggcatctacaaagcctcttggccgtgttctgaacttgaagcctggaggagttctctgctcagcgacaaaggttcctggaattagaagaaaaggaaccctggcctgaggcaggtgacaaacattaccaccccagctgtgcacgatgcagcagatgcaaccagcgactcggaccgatg

SEQ ID NO: 13239 - DNA, 203 bp, Homo sapiens
ggcgcgccagtcctcggcgtgaggtgataattcaggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 13240 - DNA, 203 bp, Homo sapiens
ggcgcgccagtcctactatgacggtgcaagtactttgtacctataaacgtgcctttttagataagttagatgttaatagtggttttgctgtttttgttaagtctaaagttggtaactatcgtttaccgtctagtaaacctagtggtatggatactgccttgttaagagcttaaactcctcactccgcacgactcggaccgatg

SEQ ID NO: 13241 - DNA, 203 bp, Homo sapiens
ggcgcgccagtccttggtacgcggtgctggtcctagggaagctcaagtcactttgtaaccgagtgattgcacatgatttcctggccttcattctgcaccggctctctctgccccgtgaccgacaggccttggtcaaaaagcatgcccagacctttttggccctctgtgctacagattatacctttgcccgactcggaccgatg

SEQ ID NO: 13242 - DNA, 203 bp, Homo sapiens
ggcgcgccagtcctaatgagaaggtgctggtcctagggaagctcaagtgggacctggctgctgtgattgcacatgaccctagaaggcagcttctgcaccggctctctctgccccgtgaccgacaggccttggtcaaaaagcatgcccagacctttttggccctctgtgctacagattatacctttgcccgactcggaccgatg

SEQ ID NO: 13243 - DNA, 203 bp, Homo sapiens
ggcgcgccagtcctgttcaattggtgctggtcctagggaagctcaagtgggacctggctgctgtgattgcacatgatttcctggccttcagcggatcaatcacgtctctgccccgtgaccgacaggccttggtcaaaaagcatgcccagacctttttggccctctgtgctacagattatacctttgcccgactcggaccgatg

SEQ ID NO: 13244 - DNA, 203 bp, Homo sapiens
ggcgcgccagtcctcacgctggggtgctggtcctagggaagctcaagtgggacctggctgctgtgattgcacatgatttcctggccttcattctgcaccggctcgggggagtggaccgccgacaggccttggtcaaaaagcatgcccagacctttttggccctctgtgctacagattatacctttgcccgactcggaccgatg

SEQ ID NO: 13245 - DNA, 203 bp, Homo sapiens
ggcgcgccagtcctgatgaatcggtgctggtcctagggaagctcaagtgggacctggctgctgtgattgcacatgatttcctggccttcattctgcaccggctctctctgccccgtgaccgacaggccttggattggcgcgcgtagcagacctttttggccctctgtgctacagattatacctttgcccgactcggaccgatg

SEQ ID NO: 13246 - DNA, 203 bp, Homo sapiens
ggcgcgccagtcctttaaggagggtgctggtcctagggaagctcaagtgggacctggctgctgtgattgcacatgatttcctggccttcattctgcaccggctctctctgccccgtgaccgacaggccttggtcaaaaagcatgccacacgggccggcttcctctgtgctacagattatacctttgcccgactcggaccgatg

SEQ ID NO: 13247 - DNA, 203 bp, Homo sapiens
ggcgcgccagtcctcgggtttgggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgcccgactcggaccgatg

SEQ ID NO: 13248 - DNA, 203 bp, Homo sapiens
ggcgcgccagtcctttgggactggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagcgctccgaagatatcgactcggaccgatg

SEQ ID NO: 13249 - DNA, 203 bp, Homo sapiens
ggcgcgccagtcctgggtagaaggtgctggtcctccctcgagaaggtggggacctggctgctgtgattgcacatgatttcctggccttcattctgcaccggctctctctgccccgtgaccgacaggccttggtcaaaaagcatgcccagacctttttggccctctgtgctacagattatacctttgcccgactcggaccgatg

SEQ ID NO: 13250 - DNA, 203 bp, Homo sapiens
ggcgcgccagtcctgaggttcgggtgcttagccgcgttttactgtcagctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgaccgactcggaccgatg

SEQ ID NO: 13251 - DNA, 203 bp, Homo sapiens
ggcgcgccagtcctagttaagaggtgcttagccggcgccagaccgaccctcgacttcggagaggcagcgcggttcctctgggtgcttccgaagattaagaagaggcttctccagcctcttcggcctcctcgcccgccgcgggaacccgagaccccagtgtatgccccacccctgaccccgctcgcgaccgactcggaccgatg

SEQ ID NO: 13252 - DNA, 203 bp, Homo sapiens
ggcgcgccagtcctagaccctgggtgcttagccggcgccagaccgaccctcgacttcggagaggcagcgcggttcctctgggtgcttccgcctccccttctcctcggggcagtatactttcggcctcctcgcccgccgcgggaacccgagaccccagtgtatgccccacccctgaccccgctcgcgaccgactcggaccgatg

SEQ ID NO: 13253 - DNA, 203 bp, Homo sapiens
ggcgcgccagtccttttgtataggtgcttagccggcgccagaccgaccctcgacttcggagaggcagcgcggttcctctgggtgcttccgcctccccttctcctgcttctccagcctccggtatggtgcactccgccgcgggaacccgagaccccagtgtatgccccacccctgaccccgctcgcgaccgactcggaccgatg

SEQ ID NO: 13254 - DNA, 203 bp, Homo sapiens
ggcgcgccagtcctgcaattccggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtgcatattggtaggcaccccgctcgcgaccgactcggaccgatg

SEQ ID NO: 13255 - DNA, 203 bp, Homo sapiens
ggcgcgccagtccttgaccattggtgcttagccggcgccagaccgaccctcgacttcggagaggcagcgcggttcctctgggtgcttccgcctccccttctcctgcttctccagcctcttcggcctcctcgcccgccgcgggaaccgtgtgtatgtcgtaatgccccacccctgaccccgctcgcgaccgactcggaccgatg

SEQ ID NO: 13256 - DNA, 203 bp, Homo sapiens
ggcgcgccagtcctatatccttggtgcttagccggcgccagaccgaccctcgacttcggagatctttactctactgtctgggtgcttccgcctccccttctcctgcttctccagcctcttcggcctcctcgcccgccgcgggaacccgagaccccagtgtatgccccacccctgaccccgctcgcgaccgactcggaccgatg

SEQ ID NO: 13257 - DNA, 203 bp, Homo sapiens
ggcgcgccagtcctctcgaattggtggagttctccttcccactcgcctcagatagattctgtctgacgggcagtggcgagctgtggtggcaggcggagagggcttcctcctccaagtcttggatcacctttgacctgaagaacaaggaagtgtctgtaaaacgggttacccaggaccctaagctccagcgactcggaccgatg

SEQ ID NO: 13258 - DNA, 203 bp, Homo sapiens
ggcgcgccagtcctttgcgtgtggtggagttctccttcccactcgcctttacagttgaaaagctgacgggcagtggatgatcccccatctaggcggagagggcttcctcctccaagtcttggatcacctttgacctgaagaacaaggaagtgtctgtaaaacgggttacccaggaccctaagctccagcgactcggaccgatg

SEQ ID NO: 13259 - DNA, 203 bp, Homo sapiens
ggcgcgccagtcctggatgcttggtggagttctccttcccactcgcctttacagttgaaaagctgacgggcagtggcgagctgtggtggcaggcggagagggcttcctcctccaagtcttggatcacctttgacctgaagaacaagacttgaataccttcacgggttacccaggaccctaagctccagcgactcggaccgatg

SEQ ID NO: 13260 - DNA, 203 bp, Homo sapiens
ggcgcgccagtcctatatgaacggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccagggtagcgctagggcacgactcggaccgatg

SEQ ID NO: 13261 - DNA, 203 bp, Homo sapiens
ggcgcgccagtcctactgtcgcggtggagttctccttcccactcgcctttacagttgaaaagctgacgggcagtggcgagctgtggtggcgtaacatcccactatcctcctccaagtcttggatcacctttgacctgaagaacaaggaagtgtctgtaaaacgggttacccaggaccctaagctccagcgactcggaccgatg

SEQ ID NO: 13262 - DNA, 203 bp, Homo sapiens
ggcgcgccagtcctcgagcccgggtggcggctcggctactgctcgtggaggggaatacaggccaatatcttgttttaatgcagggttgctggggctgggcccagaagcagcagcaccagggaagaggattcgaaaaccctctctcttgtatgagggctttgagagccccacaatggcttcggtgcctgcgactcggaccgatg

SEQ ID NO: 13263 - DNA, 203 bp, Homo sapiens
ggcgcgccagtcctgccgtcctggtggcggctcggctactgctcgtggaggggaatacaggctccctggggaagggaatgcagggttgctacttggcaagaagaaagcagcagcaccagggaagaggattcgaaaaccctctctcttgtatgagggctttgagagccccacaatggcttcggtgcctgcgactcggaccgatg

SEQ ID NO: 13264 - DNA, 203 bp, Homo sapiens
ggcgcgccagtcctcaagcgatggtggcggctcggctactgctcgtggaggggaatacaggctccctggggaagggaatgcagggttgctggggctgggcccagaagcagcagcaccaactgctgctggagtaaaaccctctctcttgtatgagggctttgagagccccacaatggcttcggtgcctgcgactcggaccgatg

SEQ ID NO: 13265 - DNA, 203 bp, Homo sapiens
ggcgcgccagtcctcagtacagggtggcggctcggctactgctcgtggaggggaatacaggctccctggggaagggaatgcagggttgctggggctgggcccagaagcagcagcaccagggaagaggattcgaaaaccctctctctacctacgactggcagagagccccacaatggcttcggtgcctgcgactcggaccgatg

SEQ ID NO: 13266 - DNA, 203 bp, Homo sapiens
ggcgcgccagtccttgctcaaaggtgtacagttcggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagagacgactcggaccgatg

SEQ ID NO: 13267 - DNA, 203 bp, Homo sapiens
ggcgcgccagtccttgaatacgggtgtatgtcgtacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaaccgactcggaccgatg

SEQ ID NO: 13268 - DNA, 203 bp, Homo sapiens
ggcgcgccagtcctataaatccggtgtgcaaatcacgcctggcagcccctgcccacagtacccgaagatggcaggccttgttcccttcacctaaattcataaacgcttagacgcatctttctgatgctgatttgtttctcttttcagtaagtgtggacctttgtgtaccagagagaacatcatggtggcgactcggaccgatg

SEQ ID NO: 13269 - DNA, 203 bp, Homo sapiens
ggcgcgccagtcctcgttctacggtgtgcaaatcacgcctggcagcccctgcccacagtacccgaagatggcaggccttgttcccttcactggccgcacccgcgctgggtgtagtggcttctgatgctgatttgtttctcttttcagtaagtgtggacctttgtgtaccagagagaacatcatggtggcgactcggaccgatg

SEQ ID NO: 13270 - DNA, 203 bp, Homo sapiens
ggcgcgccagtcctacgaagaaggtgtgcaaatcacgcctggcagcccctgcccacagtacccgaagatggcaggcggacgcgaaggggtctaaattcataaacctgggtgtagtggcttctgatgctgatttgtttctcttttcagtaagtgtggacctttgtgtaccagagagaacatcatggtggcgactcggaccgatg

SEQ ID NO: 13271 - DNA, 203 bp, Homo sapiens
ggcgcgccagtcctgcgttctgggtgtgcaaatcacgcctggcagcccctgcccacagtaccgtgcacatcagccacttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 13272 - DNA, 203 bp, Homo sapiens
ggcgcgccagtcctttcgctttggttacccatagtccatccgttgaagcaataaactcagtattaaggcttgttgtgttggacaaggtgccctatttagggtgaggagccttactggcagccccagtgaatcctccattggataggaacagctatattgggtagttgtagcagttgtattcaaatgaacgactcggaccgatg

SEQ ID NO: 13273 - DNA, 203 bp, Homo sapiens
ggcgcgccagtcctccaggctaggttacccatcattagaggaaatttccaataaactctggtcctgatacatctaggatggtcgaggtgccctatttagggtgaggagcctcggtggcagccccaccaaatcctctattggataggaacagctgtactgggcagttacagcagtcgtatggtaacacacgactcggaccgatg

SEQ ID NO: 13274 - DNA, 203 bp, Homo sapiens
ggcgcgccagtcctgctgggcgggttacccatcattagaggaaatttccaataaactctggtgtaaggcttagagtgatggtcgaggtgccctatttagggtgaggagcctcggtggcagccccaccaaatcctctattggataggaacagctgtactggattaagtgcaaccccgtatggtaacacacgactcggaccgatg

SEQ ID NO: 13275 - DNA, 203 bp, Homo sapiens
ggcgcgccagtcctacctatgaggttacccatcattagaggaaatttccaataaactctggtgtaaggcttagagtgatggtcgaggtgccctatttagggtgaggagcctcggtggcagccccaccaaatcctctattggataggcttttgcacctatcgcagttacagcagtcgtatggtaacacacgactcggaccgatg

SEQ ID NO: 13276 - DNA, 203 bp, Homo sapiens
ggcgcgccagtcctgagtaaacggttacccatcattagaggaaatttcggtccccaaagcaagtaaggcttagagtgatggtcgaggtgccctatttagggtgaggagcctcggtggcagccccaccaaatcctctattggataggaacagctgtactgggcagttacagcagtcgtatggtaacacacgactcggaccgatg

SEQ ID NO: 13277 - DNA, 203 bp, Homo sapiens
ggcgcgccagtcctgagaccggggttcgaagtaaagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacacgactcggaccgatg

SEQ ID NO: 13278 - DNA, 203 bp, Homo sapiens
ggcgcgccagtcctattcgtagggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggcgactcggaccgatg

SEQ ID NO: 13279 - DNA, 203 bp, Homo sapiens
ggcgcgccagtcctacaactctggttctccgcccctgccactgggccatggagactgtggcacagtagactgtagtgtgaggctcgcgggggcagtggccatggccttatccacccgagagctggtgtctgtggaggacctgctgaagtttgaaaagaaatttcagtctgagaaggcagcaggctcggcgactcggaccgatg

SEQ ID NO: 13280 - DNA, 203 bp, Homo sapiens
ggcgcgccagtcctgtaatggaggttctccgcccgatagctgataagttggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggcgactcggaccgatg

SEQ ID NO: 13281 - DNA, 203 bp, Homo sapiens
ggcgcgccagtcctaaacagtgggttgatgaaatgatatggactcaaaaagaattaaaagaagctttgtccgatgggatagtgaagtctcacaccaacatttacaattgttatttagatgcaccgttctcagtatatgtcaaggcttacttaagttagtaaaaacacatcagagtgggataagtgacacgactcggaccgatg

SEQ ID NO: 13282 - DNA, 203 bp, Homo sapiens
ggcgcgccagtccttagctctgggttgtgcatttatagtcccaaatcttttgtggtgagtatgttgctattatgttgttgttctactggttgctgtggcttctttagttgttttgcatcttctattagaggttgttgtgaatcaactaaacttccttattacgacgttgaaaagatccacatacagtacgactcggaccgatg

SEQ ID NO: 13283 - DNA, 203 bp, Homo sapiens
ggcgcgccagtcctcttggtacggttgtgcatttcagtcgtgctcatctttgtggtgagtatgttgctattatgttgttgttctactggttgctgtggcttctttagttgttttgcatcttctattagaggttgttgtgaatcaactaaacttccttattacgacgttgaaaagggtgcaccgattgtcgactcggaccgatg

SEQ ID NO: 13284 - DNA, 203 bp, Homo sapiens
ggcgcgccagtcctggaacgccggttgtgcatttcagtcgtgctcatctttgtggtgagtatgttgctattatgtttgataaggcggcactgctgtggcttctttagttgttttgcatcttctattagaggttgttgtgaatcaactaaacttccttattacgacgttgaaaagatccacatacagtacgactcggaccgatg

SEQ ID NO: 13285 - DNA, 203 bp, Homo sapiens
ggcgcgccagtccttacaggcagtaaaaaaacagctcaacgcctttttcgacaccagcggcggcttttgctgcaattttgtgaaggggaagatactgttgacgggaaacgcaaaaaaccagaaaggttaactgaaaaaccagaaagttaactggtaagtttagtctttttgtcttttatttcaggtcccgactcggaccgatg

SEQ ID NO: 13286 - DNA, 203 bp, Homo sapiens
ggcgcgccagtcctgcacaggagtaaaaaaacagctcaacgcctttttgtgtttgttttagagcttttgctgcaattttgtgaaggggaagatactgttgacggttccgcatgggtgacagaaaggttaactgaaaaaccagaaagttaactggtaagtttagtctttttgtcttttatttcaggtcccgactcggaccgatg

SEQ ID NO: 13287 - DNA, 203 bp, Homo sapiens
ggcgcgccagtcctgggtccgagtaacagcactgaaagcggtgtatcaagcatgacggccgtgggaactcctccttggtaacaaggacccacggggccaaaagccacgcccacacgggcccgtcatgtgtgcaaccccagcacggcgactttactgcgaaacccactttaaagtgacattgaaactggcgactcggaccgatg

SEQ ID NO: 13288 - DNA, 203 bp, Homo sapiens
ggcgcgccagtcctggtacctagtaacagcactgttgcttcgtagcggagcatgacggccgtatctcaaggcgtcaggtaacaaggacccacggggccaaaagccacgcccacacgggcccgtcatgtgtgcaaccccagcacggcgactttactgcgaaacccactttaaagtgacattgaaactggcgactcggaccgatg

SEQ ID NO: 13289 - DNA, 203 bp, Homo sapiens
ggcgcgccagtcctgtccgtcggtaacagcactgttgcttcgtagcggagcatgacggccgtgggaactcctccttctagctggcattttacggggccaaaagccacgcccacacgggcccgtcatgtgtgcaaccccagcacggcgactttactgcgaaacccactttaaagtgacattgaaactggcgactcggaccgatg

SEQ ID NO: 13290 - DNA, 203 bp, Homo sapiens
ggcgcgccagtcctggcgggcagtaacagcactgttgcttcgtagcggagcatgacggccgtgggaactcctccttggtaacaaggacccacggggccaaaagccacgcccacacgggcccgtcatgtgtgcaaccccagcacggcccgcccgggaaacgacccactttaaagtgacattgaaactggcgactcggaccgatg

SEQ ID NO: 13291 - DNA, 203 bp, Homo sapiens
ggcgcgccagtcctactgtgcagtaacagcactgttgcttcgtagcggagcatgacggccgtgggaactcctccttggtaacaaggacccacggggccaaaagccacgcccacacgggtatcgacatgcgagaaccccagcacggcgactttactgcgaaacccactttaaagtgacattgaaactggcgactcggaccgatg

SEQ ID NO: 13292 - DNA, 203 bp, Homo sapiens
ggcgcgccagtcctctgctgaagtaacagcactgttgcttcgtagcggcagcaacgccaaaagggaactcctccttggtaacaaggacccacggggccaaaagccacgcccacacgggcccgtcatgtgtgcaaccccagcacggcgactttactgcgaaacccactttaaagtgacattgaaactggcgactcggaccgatg

SEQ ID NO: 13293 - DNA, 203 bp, Homo sapiens
ggcgcgccagtccttcgcttcggtaacgtccaaggcaagctccccacgacccgaacacgcccagaggaaccttggggcctctggggacttggctagcaggtattcatgctagcctggaccatttttcagatttagccttcagaagaggatctgggaaagcctttggattatacttgtcgcagccggcccgactcggaccgatg

SEQ ID NO: 13294 - DNA, 203 bp, Homo sapiens
ggcgcgccagtcctggaaagtggtaacgtccaaggcaagctccccacgacccgaacacgcccagaggaaccttggggcctctggggacttggctagcaggtattgccttacagaattcccatttttcagatttagccttcagaagaggatctgggaaagcctttggattatactgaaactcattcaagcgactcggaccgatg

SEQ ID NO: 13295 - DNA, 203 bp, Homo sapiens
ggcgcgccagtcctgcctcactgtaacgtccaaggcaagctccccacgacccgaacacgcccagaggaaccttgggtaggtcccccttgcggctagcaggtattcatgctagcctggaccatttttcagatttagccttcagaagaggatctgggaaagcctttggattatactgaaactcattcaagcgactcggaccgatg

SEQ ID NO: 13296 - DNA, 203 bp, Homo sapiens
ggcgcgccagtcctccacaccagtaactgagagggtactgtgatctgcccaaagtcctaatgtgcagtcaggtgaatttattgaaaaatttgaggctcctggtggtgcaaatcaaagaactgctcctcagtggatgttgcctttacttctaggcctgtacggaagtgttacttctgctctaaaagcttcgactcggaccgatg

SEQ ID NO: 13297 - DNA, 203 bp, Homo sapiens
ggcgcgccagtcctttaaactcgtaactgagaggtgggaagctcaaagccaaagtcctaatgtgcagtcaggtgaaggatacactttccgtgaggctcctggtggtgcaaatcaaagaactgctcctcagtggatgttgcctttacttctaggcctgtacggaagtgttacttctgctctaaaagcttcgactcggaccgatg

SEQ ID NO: 13298 - DNA, 203 bp, Homo sapiens
ggcgcgccagtcctgatggtgagtaactgagaggtgggaagctcaaagccaaagtcctaatgtgcagtcaggtgaatttattgaaaaatttgaggctcctggtggtgcaaatcaaagaactgctcctcagtggatgttgcctttacggtccttgtccgtgggaagtgttacttctgctctaaaagcttcgactcggaccgatg

SEQ ID NO: 13299 - DNA, 203 bp, Homo sapiens
ggcgcgccagtcctgactaatagtaactgagaggtgggaagctcaaagccaaagtcctaatgtgcagtcaggtgaatttattgaaaaatttgaggctcctggtggtgcaaatcaaagactctggtaggccacgatgttgcctttacttctaggcctgtacggaagtgttacttctgctctaaaagcttcgactcggaccgatg

SEQ ID NO: 13300 - DNA, 203 bp, Homo sapiens
ggcgcgccagtcctaccgcacagtaccttccgtgattcagtatggaaagaataaaagaactacggaacctgatgtcgcagtctcgcactcgcgagatactgacaaaaaccacagtggaccatatggccataattaagaagtacacatcggggagacaggaaaagaacccgtcacttaggatgaaatggcgactcggaccgatg

SEQ ID NO: 13301 - DNA, 203 bp, Homo sapiens
ggcgcgccagtcctgagatggcgtagacaaagacgttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 13302 - DNA, 203 bp, Homo sapiens
ggcgcgccagtcctcccggaacgtagatatagtcaatcaactggtctgacaagtcataccccaaacaatccaaatctggaatcacctgttcgctcagtagtaattatcgaatggggcgtacactaacctcgtctgtactgtctgaaagtggtcaggattgattgacagttattatttatctttaagcacgactcggaccgatg

SEQ ID NO: 13303 - DNA, 203 bp, Homo sapiens
ggcgcgccagtcctaaggcatggtagatatagtccccggtacccgtgcacaagtcataccccaaacaatccaaatctggaatcacctgttcgctcagtagtaatatcttggcaaacactacactaacctcgtctgtactgtctgaaagtggtcaggattgattgacagttattatttatctttaagcacgactcggaccgatg

SEQ ID NO: 13304 - DNA, 203 bp, Homo sapiens
ggcgcgccagtccttaggatcagtagatgcagctatgttgtaaggctttagagaaataagggagtgtcctatttaggatgaggtgctccggtggcagccccaccaaaacctctagcgactaggaacagctatatcgggttgctatagcagtcaggatgtcattctggcgttccgaaatacccaaacctcgactcggaccgatg

SEQ ID NO: 13305 - DNA, 203 bp, Homo sapiens
ggcgcgccagtcctattacggagtagcaagtgaagccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 13306 - DNA, 203 bp, Homo sapiens
ggcgcgccagtcctccgtctatgtaggacataccccaaatattgggttccactcgtagagaagaaaattagtggcgaaacgtacggtttaccgtgttccctcctgtgattttaattgcacctgaagcaaccctaggtcttccctttgatgtgagctaataaggagtaaccgattcttacaatgtgatccgactcggaccgatg

SEQ ID NO: 13307 - DNA, 203 bp, Homo sapiens
ggcgcgccagtcctaacactacgtaggacataccccaaatattgggttccactcgtagagaagaaaattagtggcgaaacgtacggtttatgtcaaaggagaaggtgattttaattgcacctgaagcaaccctaggtcttccctttgatgtgagctaatattcgtcgttgttcacttacaatgtgatccgactcggaccgatg

SEQ ID NO: 13308 - DNA, 203 bp, Homo sapiens
ggcgcgccagtcctcggtcatcgtaggacataccccaaatattgggttccactcgtagagaagaaaattagtggcgccggtgcgaacgagtgtcaaaggagaaggtgattttaattgcacctgaagcaaccctaggtcttccctttgatgtgagctaataaggagtaaccgattcttacaatgtgatccgactcggaccgatg

SEQ ID NO: 13309 - DNA, 203 bp, Homo sapiens
ggcgcgccagtcctcaattgtggtaggacatacctattgctaaatacgccactcgtagagaagaaaattagtggcgaaacgtacggtttatgtcaaaggagaaggtgattttaattgcacctgaagcaaccctaggtcttccctttgatgtgagctaataaggagtaaccgattcttacaatgtgatccgactcggaccgatg

SEQ ID NO: 13310 - DNA, 203 bp, Homo sapiens
ggcgcgccagtccttccttcaggtatatgcatgtatgtgtatgtgtatatatgtatgtgtgtgtatgtatatgtgtgtgtatgtgtatgtgtgtgtgtatgtgtgtgtgtatgtatgtatgtatgtatatgtcagtgggttggcgccacatattggtttttttaatcatttgagagttagttgaagatcgactcggaccgatg

SEQ ID NO: 13311 - DNA, 203 bp, Homo sapiens
ggcgcgccagtccttagggcaagtatatgcatgtatgtgtatgtgtatatatgtatgtgtgtgtatgtatatgtgtgtgtatgtgtatgtgtgtgtgtatgtgtgtgtgtatgtatgtgctaccactatatgattatacacatatacacatattggtttttttaatcatttgagagttagttgaagatcgactcggaccgatg

SEQ ID NO: 13312 - DNA, 203 bp, Homo sapiens
ggcgcgccagtcctatcacgctgtatatgcatgtatgtgtatgtgtatatatgtatgtgtgtgtatgtatatgtgttgtatccgtccacagtgtgtgtatgtgtgtgtgtatgtatgtatgtatgtatatgtattatacacatatacacatattggtttttttaatcatttgagagttagttgaagatcgactcggaccgatg

SEQ ID NO: 13313 - DNA, 203 bp, Homo sapiens
ggcgcgccagtcctttatttatgtatatgcatgtatgtgtatgtgtatgggccggcagtaaagtatgtatatgtgtgtgtatgtgtatgtgtgtgtgtatgtgtgtgtgtatgtatgtatgtatgtatatgtattatacacatatacacatattggtttttttaatcatttgagagttagttgaagatcgactcggaccgatg

SEQ ID NO: 13314 - DNA, 203 bp, Homo sapiens
ggcgcgccagtcctctaatgatgtatcctatgagcgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagcgactcggaccgatg

SEQ ID NO: 13315 - DNA, 203 bp, Homo sapiens
ggcgcgccagtccttctcctgagtatgggaatcggcatgaacttactctaggatctctcgtagagggataggtgtgccattcaaatccagggagtactctggctctgacattgggacatttgatgtaaccggacctggttcagtatccgggttgtcctgtattgttacggtgtatccgtcttggcacacgactcggaccgatg

SEQ ID NO: 13316 - DNA, 203 bp, Homo sapiens
ggcgcgccagtcctgaccatgtgtatgggaatcgtgtatggggatgattaggatctctcgtagagggataggtgtgccattcaaatccagggagtactctggctctgacattgggacatttgatgtaaccggacctggttcagtatccgggttgtcctgtattgttacggtgtatccgtcttggcacacgactcggaccgatg

SEQ ID NO: 13317 - DNA, 203 bp, Homo sapiens
ggcgcgccagtccttacgaaaggtatgggaatcgtgtatggggatgattaggatctctcgtatgtttcgcctccaaccattcaaatccagggagtactctggctctgacattgggacatttgatgtaaccggacctggttcagtatccgggttgtcctgtattgttacggtgtatccgtcttggcacacgactcggaccgatg

SEQ ID NO: 13318 - DNA, 203 bp, Homo sapiens
ggcgcgccagtccttgaaaccagtcatcgtaatatagccatagtggcgagctccctgggtggtctaagtcctgagtacaggacagtcgtcagtagttcgacgtgagcagaagcccacctcgagatgctacgtggacgagggcatgccaagacacaccttaaccctagcgggggtcgctagggtgaaatcgactcggaccgatg

SEQ ID NO: 13319 - DNA, 203 bp, Homo sapiens
ggcgcgccagtccttcctggctgtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgagtacgatacacaccgactcggaccgatg

SEQ ID NO: 13320 - DNA, 203 bp, Homo sapiens
ggcgcgccagtcctaaacatacgtccacgatgcagccccggggccccgccgcgggaccgcgagccttgtgtgagcggaggggtgcccggccccgcgggagccggcgatcctgaggctacgacctttcggaaggttacaagctttaaaccagcgcaagcttttccaacacccctgctccgcccttcttgcgactcggaccgatg

SEQ ID NO: 13321 - DNA, 203 bp, Homo sapiens
ggcgcgccagtcctgcgtgtaagtccacgatgcagccccggggccccgccgcgggaccgcgagccttgtgtgagcggaggggtgcccggcgataattcttaatccgatcctgaggctacgacctttcggaagcacctgcctccgtcaccagcgcaagcttttccaacacccctgctccgcccttcttgcgactcggaccgatg

SEQ ID NO: 13322 - DNA, 203 bp, Homo sapiens
ggcgcgccagtcctgacaaaccgtccacgatgcagccccggggccccggaatttttgtaaacgccttgtgtgagcggaggggtgcccggccccgcgggagccggcgatcctgaggctacgacctttcggaagcacctgcctccgtcaccagcgcaagcttttccaacacccctgctccgcccttcttgcgactcggaccgatg

SEQ ID NO: 13323 - DNA, 203 bp, Homo sapiens
ggcgcgccagtcctctcgttgtgtccactaccttaactagctcgctgacccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacgactcggaccgatg

SEQ ID NO: 13324 - DNA, 203 bp, Homo sapiens
ggcgcgccagtccttcagaagagtccactacctttttcgagagtgactcccgttgtcccaaggcttcccagagcgaacctgtgcggctgcaggcaccggcgcgtaataacataataccccggaaggaccgagctcttctcgcggatccagtgttccgtttccagcccccaatctcagagcggagccgacgactcggaccgatg

SEQ ID NO: 13325 - DNA, 203 bp, Homo sapiens
ggcgcgccagtcctgcagattcgtccactacctttttcgagagtgactcccgttgtcccaaggcttcccagagcgaacctgtgcggctgcgccttggtaattagcgagtttccggcgtccggaaggaccgagctcttctcgcggatccagtgttccgtttccagcccccaatctcagagcggagccgacgactcggaccgatg

SEQ ID NO: 13326 - DNA, 203 bp, Homo sapiens
ggcgcgccagtcctgattagatgtccgcaaagccggtggcgcccggaggctgcacggagagcggtgcccgcgtcagtgaccgaaggaagagaccaagatgaatgatcgttagtcagtcaagtttggcgtggtggtggttggtgttggccgagccggctccgtgcggatgagggacttgcggaatccaccgactcggaccgatg

SEQ ID NO: 13327 - DNA, 203 bp, Homo sapiens
ggcgcgccagtcctgacatattgtcctgaagctcgactgcccggaaaggttcatgcaccttcttgccaagcctcagtctttgggatctggggaggccgcctggttttcctccctccttctgcacgtctgctggggtctcttcctctccaggccttgccgtccccctggcctctcttcccagctcacaccgactcggaccgatg

SEQ ID NO: 13328 - DNA, 203 bp, Homo sapiens
ggcgcgccagtcctgcgttaccgtcctgaagctctcgcagtgcagtgagttcatgcaccttcccaggtctagcacttctttgggatctggggaggccgcctggttttcctccctccttctgcacgtctgctggggtctcttcctctccaggccttgccgtccccctggcctctcttcccagctcacaccgactcggaccgatg

SEQ ID NO: 13329 - DNA, 203 bp, Homo sapiens
ggcgcgccagtcctgcctggtcgtcctgaagctctcgcagtgcagtgagttcatgcaccttcttgccaagcctcagtctttgggatctggggaggccgcctggtgggtgaagtcgaggctgcacgtctgctggggtctcttcctctccaggccttgccgtccccctggcctctcttcccagctcacaccgactcggaccgatg

SEQ ID NO: 13330 - DNA, 203 bp, Homo sapiens
ggcgcgccagtcctaagtctgagtcctgaagctctcgcagtgcagtgagttcatgcaccttcttgccaagcctcagtctttgggatctggggaggccgcctggttttcctccctccttctgcacgtctgctgcctcggtgattaagccaggccttgccgtccccctggcctctcttcccagctcacaccgactcggaccgatg

SEQ ID NO: 13331 - DNA, 203 bp, Homo sapiens
ggcgcgccagtcctagtctacagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctccctgatcggttattcgactcggaccgatg

SEQ ID NO: 13332 - DNA, 203 bp, Homo sapiens
ggcgcgccagtcctactgccctgtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacaccgactcggaccgatg

SEQ ID NO: 13333 - DNA, 203 bp, Homo sapiens
ggcgcgccagtcctatcaagaggtcctgaagctctcgcagtgcagtgagttcatgcaccttcttgccaagcctcagtctttgggatctggggaggccgcctggttttcctccctccttctgcacgtctgctggggtctcttcctctttcacataactatcccccctggcctctcttcccagctcacaccgactcggaccgatg

SEQ ID NO: 13334 - DNA, 203 bp, Homo sapiens
ggcgcgccagtcctagcagcttgtcctgaagctctcgcagtgcagtgagttcatgcaccttcttgccaagcctcagtctttgggatctggtcttataaatgttatttcctccctccttctgcacgtctgctggggtctcttcctctccaggccttgccgtccccctggcctctcttcccagctcacaccgactcggaccgatg

SEQ ID NO: 13335 - DNA, 203 bp, Homo sapiens
ggcgcgccagtcctggacccatgtcctggcagcagcctctgacctgtccaggtgccctgtccagctgactgcaaggacagagaggagtcctgcccagctcttggatcagtctgctggccgaggagcccggtgataagtccaacagtcctggagcccagcctgccccgaggaggccccggctcagagcccgactcggaccgatg

SEQ ID NO: 13336 - DNA, 203 bp, Homo sapiens
ggcgcgccagtcctgaccactcgtcctggcagcagcctctgacctgtccaggtgccctgtccagctgactgcaaggacagagaggagtcctgcccagctcttggatcagtctgctggccgaggagcccggtggagccaggggtgaccctggagcccagcctgccccgaggaggcaagacactgccaatcgactcggaccgatg

SEQ ID NO: 13337 - DNA, 203 bp, Homo sapiens
ggcgcgccagtcctgtcattctgtcctggcagcagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagcccgactcggaccgatg

SEQ ID NO: 13338 - DNA, 203 bp, Homo sapiens
ggcgcgccagtccttcttcacggtcctggcagcagcctctgacctgtctttcccgggcagttagctgactgcaaggacagagaggagtcctgcccagctcttggatcagtctgctggccgaggagcccggtggagccaggggtgaccctggagcccagcctgccccgaggaggccccggctcagagcccgactcggaccgatg

SEQ ID NO: 13339 - DNA, 203 bp, Homo sapiens
ggcgcgccagtcctttcatcgcgtcgagccgcgctcacctcgggctcccgctccgtctccacctccgcctttgccctggcggcgcgaccccgtcccgggcgcggcccccagcagtcgcgcgccgttagcctcgcgcccgccgcgcacaatcattagcatacgatgggggccgccgccggccggagccccgactcggaccgatg

SEQ ID NO: 13340 - DNA, 203 bp, Homo sapiens
ggcgcgccagtccttaacgatagtcgccgccgcagtcctcgccgcagtcgccgccgccgccgccgccgccgccgctgctcctccgcctggaagactagtctaagccgcagccatgagcgtgctcggccccggtggagcccgcagtcctctagattagtctccaccgccgtccaggacccacttgcagccgactcggaccgatg

SEQ ID NO: 13341 - DNA, 203 bp, Homo sapiens
ggcgcgccagtccttgaaccacgtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccagccggagtaccttttcgactcggaccgatg

SEQ ID NO: 13342 - DNA, 203 bp, Homo sapiens
ggcgcgccagtcctcctggacagtcgccgccgcagtcctcgccgcagttattaatattcgtcccgccgccgccgctgctcctccgcctggcctgggccgtctgcccgcagccatgagcgtgctcggccccggtggagcccgcagtcctctagattagtctccaccgccgtccaggacccacttgcagccgactcggaccgatg

SEQ ID NO: 13343 - DNA, 203 bp, Homo sapiens
ggcgcgccagtcctagattcgtgtcggagaccgggcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccacccgactcggaccgatg

SEQ ID NO: 13344 - DNA, 203 bp, Homo sapiens
ggcgcgccagtcctcataagcggtctacgtggacatgtcctctgtaggtctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcgactcggaccgatg

SEQ ID NO: 13345 - DNA, 203 bp, Homo sapiens
ggcgcgccagtccttcgatcgtgtctacgtggaccgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcgactcggaccgatg

SEQ ID NO: 13346 - DNA, 203 bp, Homo sapiens
ggcgcgccagtcctcggctagggtctacgtggaccgacaaagacagattctttgagggagctaagctcaacgtagttctaacagttttttctaagcccgtttagtctctgatgaataaccaacggaaaaaggcgaaaaacacgcctttcaatatgctgaaacgcgagagaaaccgcgtgtcgactgtgcgactcggaccgatg

SEQ ID NO: 13347 - DNA, 203 bp, Homo sapiens
ggcgcgccagtcctaatctttagtctacgtggaccgacaaagacagattctttgagggagctcccgatccgtgctctctaacagttttttaattagagagcagatctctgatgaataaccaacggaaaaaggcgaaaaacacgcctttcaatatgctgaaacgcgagagaaaccgcgtgtcgactgtgcgactcggaccgatg

SEQ ID NO: 13348 - DNA, 203 bp, Homo sapiens
ggcgcgccagtcctataatatcgtctacgtggaccgacaagaacagttatacgctacttaaatgcttaacgtagttctaacagttttttattagagagcagatctctgatgaacaaccaacggaaaaagacgggtcgaccgtctttcaatatgctgaaacgcgcgagaaaccgcgtgtcaactgtttccgactcggaccgatg

SEQ ID NO: 13349 - DNA, 203 bp, Homo sapiens
ggcgcgccagtcctgggccggcgtctacgtggaccgacaagaacagttcttttaaatttaaatgcttaacgtagtgctgacagttttttattagagagcagatctctgatgaacaaccaacggaagaagacgggaaaaccgtctatcaatatgctgaaacgcgtgagaaaccgtgtgtcaactggatccgactcggaccgatg

SEQ ID NO: 13350 - DNA, 203 bp, Homo sapiens
ggcgcgccagtcctctactgcggtctacgtggaccgacaagaacagtttcgaatcggaagcttgcttaacgtagtttccgttacccgcctttagagagcagatctctgatgaacaaccaacggaaaaagacgggtcgaccgtctttcaatatgctgaaacgcgcgagaaaccgcgtgtcaactgtttccgactcggaccgatg

SEQ ID NO: 13351 - DNA, 203 bp, Homo sapiens
ggcgcgccagtccttcagtgccgtctacgtggaccgacaagaacagtttcgactcggaagcttgcttaacgtagtgctgacagttttttacattgactagccagtctgatgaacaaccaacggaagaagacgggaaaaccgtctatcaatatgctgaaacgcgtgagaaaccgtgtgtcaactggatccgactcggaccgatg

SEQ ID NO: 13352 - DNA, 203 bp, Homo sapiens
ggcgcgccagtcctatacgtctgtctacgtggaccgacaagaacagtttcgactcggaagcttgcttaacgtagtgctgacagttttttattagagagcagatctctgatgaacaaccttgttctccgtggtggaaaaccgtctatcaatatgctgaaacgcgtgagaaaccgtgtgtcaactggatccgactcggaccgatg

SEQ ID NO: 13353 - DNA, 203 bp, Homo sapiens
ggcgcgccagtccttgggcaacgtctacgtggacgtggcgatgggtaatcgaatcggaagcttgcttaacgtagttctaacagttttttattagagagcagatctctgatgaacaaccaacggaaaaagacgggtcgaccgtctttcaatatgctgaaacgcgcgagaaaccgcgtgtcaactgtttccgactcggaccgatg

SEQ ID NO: 13354 - DNA, 203 bp, Homo sapiens
ggcgcgccagtcctctccgtgcgtctagggctatgtaactttcacgcctataagttgagattttcacaacttgaacccatttacaaacatgggcaattcaaaatctaaatccaacccatccagttcctcagagtctcaaaaaggggcaccaacagtcacagaatttaggaggactgccattcacagtccgactcggaccgatg

SEQ ID NO: 13355 - DNA, 203 bp, Homo sapiens
ggcgcgccagtccttggtgtccgtctccctcctcccctaaccaccccccgaagtgggtcaaacccgcagtaataaaggcccctgaacgtgtatgttggtctcccgggagctgcttgctgaagatccgcgcccctgtcgccgtctggtaggagctgtttgcagggtcctaactcaatcggcttgttgtgcgactcggaccgatg

SEQ ID NO: 13356 - DNA, 203 bp, Homo sapiens
ggcgcgccagtcctcaccacaagtctgacgccagggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaacgactcggaccgatg

SEQ ID NO: 13357 - DNA, 203 bp, Homo sapiens
ggcgcgccagtcctaatgctatgtctgtgtggaccgacaaggacagttaggggctacctcaatgcttaacacagttctaacagtttgtttgaatagagagcagatctctggaaaaatgaaccaacgaaaaaaggtggttagaccacctttcaatatgctgaaacgcgagagaaaccgcgtatcaaccccgactcggaccgatg

SEQ ID NO: 13358 - DNA, 203 bp, Homo sapiens
ggcgcgccagtcctaaatggcagtctgtgtggaccgacaaggacagttccaaatcggaagcttgcttaacacagttctaacagtttgtttcttacactgagccttctctggaaaaatgaaccaacgaaaaaaggtggttagaccacctttcaatatgctgaaacgcgagagaaaccgcgtatcaaccccgactcggaccgatg

SEQ ID NO: 13359 - DNA, 203 bp, Homo sapiens
ggcgcgccagtccttggcattcgtctgtgtggaccgacaaggacagttccaaatcggaagcttgcttaacacagttctaacagtttgtttgaatagagagcagagtgtacatcctgataaccaacgaaaaaaggtggttagaccacctttcaatatgctgaaacgcgagagaaaccgcgtatcaaccccgactcggaccgatg

SEQ ID NO: 13360 - DNA, 203 bp, Homo sapiens
ggcgcgccagtcctgagcattggtctgttctgaactacaccatttactgctgtgaagaatgccctggaggcaagctggttacagccctgaccaggccctgcccgtgactctcgaccggcgcagggtcaaaaaagtatatcttccgtgcaggaacgcgggagcgtttcttttccttttgtactgacatgcgactcggaccgatg

SEQ ID NO: 13361 - DNA, 203 bp, Homo sapiens
ggcgcgccagtcctggcacggagtctgttctgaactacaccatttactgctgtgaagaatgccctggaggcaagctggttacagccctgaccaggccctgcccgtgactctcgaccggcgcagggtcaaaaattgtctaagcagcagcaggaacgcgggagcgtttcttttcctacctgcaccgttctcgactcggaccgatg

SEQ ID NO: 13362 - DNA, 203 bp, Homo sapiens
ggcgcgccagtcctacgtcgctgtctgttctgaactacaccatttactgctgtgaagaatgccctggaggcaagctggttacagccctgaccaggccctgcccgtgactctcgaccggcgcagggtcaaaaattgtctaagcagcagcaggaacgcgggataagccagccaaactttgtactgacatgcgactcggaccgatg

SEQ ID NO: 13363 - DNA, 203 bp, Homo sapiens
ggcgcgccagtccttagttgaggtctgttctgaactacaccatttactgctgtgaagaatgccctggaggcaagctggttacagccctgataccaggagagagttgactctcgaccggcgcagggtcaaaaattgtctaagcagcagcaggaacgcgggagcgtttcttttccttttgtactgacatgcgactcggaccgatg

SEQ ID NO: 13364 - DNA, 203 bp, Homo sapiens
ggcgcgccagtccttgtaagaggtctgttctgaactacaccatttactgctgtgaagaatgcgggctgtatggctgggttacagccctgaccaggccctgcccgtgactctcgaccggcgcagggtcaaaaattgtctaagcagcagcaggaacgcgggagcgtttcttttccttttgtactgacatgcgactcggaccgatg

SEQ ID NO: 13365 - DNA, 203 bp, Homo sapiens
ggcgcgccagtcctgattgcgtgtctgttctgaactacaccatttacttactcccccctgttcctggaggcaagctggttacagccctgaccaggccctgcccgtgactctcgaccggcgcagggtcaaaaattgtctaagcagcagcaggaacgcgggagcgtttcttttccttttgtactgacatgcgactcggaccgatg

SEQ ID NO: 13366 - DNA, 203 bp, Homo sapiens
ggcgcgccagtccttaaacgcggtctgttgtgtgactctggtaactagagatccctcagaccgaccccacggagaaggaaaatctctagcagtggcgcccgaacagggacctgaaagcgaaagggaaaccagaggagctctctcgacgcaggactcggcttgctgaagcgcgcacggcaagaggcgagcgactcggaccgatg

SEQ ID NO: 13367 - DNA, 203 bp, Homo sapiens
ggcgcgccagtcctgtcctggcgtgaacttgcctctctcaacaaaaagccaccgacattaagagagagagtattgcactggcccattgctcaggccctatttagggttaccgcccaggatctgcaacagcattcctgtatcatccagggcaccggtggacttggtgaggattgagttgacctcatcatcgactcggaccgatg

SEQ ID NO: 13368 - DNA, 203 bp, Homo sapiens
ggcgcgccagtcctagctacaagtgaacttgcctctctcaacaaaaagccaccgacattaagagagagagtattgctgcttagttaactgcaggccctatttagtccccaatttgtctatctgcaacagcattcctgtatcatccagggcaccggtggacttggtgaggattgagttgacctcatcatcgactcggaccgatg

SEQ ID NO: 13369 - DNA, 203 bp, Homo sapiens
ggcgcgccagtcctgaaacatagtgaacttgcctgcggatcgtgcgtcccaccgacattaagagagagagtattgctgcttagttaactgcaggccctatttagggttaccgcccaggatctgcaacagcattcctgtatcatccagggcaccggtggacttggtgaggattgagttgacctcatcatcgactcggaccgatg

SEQ ID NO: 13370 - DNA, 203 bp, Homo sapiens
ggcgcgccagtccttaacagcagtgaagggtgagatcgggaaacaaagggtatggccccctagttcccaaagggagcagggagatgggaatagaattgaaggtacagacctcctctgatgggaggaggaatatttaggtaattgtggagactttctcctgtgtgatgaaggcggcagacactgtgatccgactcggaccgatg

SEQ ID NO: 13371 - DNA, 203 bp, Homo sapiens
ggcgcgccagtcctacaatacagtgaagggtgagatcgggaaacaaagggtatggccccctagttcccaaagggagcagggagatgggaatagaattgaaggtaggttttaggctactattagcttaagtgttttaggtaattgtggagactttctcctgtgtgatgaaggcggcagacactgtgatccgactcggaccgatg

SEQ ID NO: 13372 - DNA, 203 bp, Homo sapiens
ggcgcgccagtcctgtaagcgtgtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcgggctggtgaagttagcgactcggaccgatg

SEQ ID NO: 13373 - DNA, 203 bp, Homo sapiens
ggcgcgccagtcctgttacaatgtgaagggtgagatcgggaaacaaagtacccccagtgagcgttcccaaagggagcagggagatgggaatagaattgaaggtaggttttaggctacttgggaggaggaatatttaggtaattgtggagactttctcctgtgtgatgaaggcggcagacactgtgatccgactcggaccgatg

SEQ ID NO: 13374 - DNA, 203 bp, Homo sapiens
ggcgcgccagtcctggccacgggtgatctgattagaagtaagaaaattcctagttataatatcgacgcgttataatcatttttaagacccttagttatttagctttaccgcccaggatggggtgcagcgttcctgcaatatccagggcacctaggtgcagccttgtagttttagtggactttaggctacgactcggaccgatg

SEQ ID NO: 13375 - DNA, 203 bp, Homo sapiens
ggcgcgccagtcctgggcatcagtgatctgattagaagtaagaaaattcctagttataatatttttaatactgctacatttttaagacccttagttatttagctcccggtaagcctggggggtgcagcgttcctgcaatatccagggcacctaggtgcagccttgtagttttagtggactttaggctacgactcggaccgatg

SEQ ID NO: 13376 - DNA, 203 bp, Homo sapiens
ggcgcgccagtccttgcaccgggtgatctgattagaagtaagaaaattcctagttataatatttttaatactgctaggagcccttctttgttagttatttagctttaccgcccaggatggggtgcagcgttcctgcaatatccagggcacctaggtgcagccttgtagttttagtggactttaggctacgactcggaccgatg

SEQ ID NO: 13377 - DNA, 203 bp, Homo sapiens
ggcgcgccagtcctacttgggtgtgatctgattagaagtaagaaaatttgcctagcattaggttttaatactgctacatttttaagacccttagttatttagctttaccgcccaggatggggtgcagcgttcctgcaatatccagggcacctaggtgcagccttgtagttttagtggactttaggctacgactcggaccgatg

SEQ ID NO: 13378 - DNA, 203 bp, Homo sapiens
ggcgcgccagtcctcgacacaggtgatctgattatgttggttgcgcaacctagttataatatttttaatactgctacatttttaagacccttagttatttagctttaccgcccaggatggggtgcagcgttcctgcaatatccagggcacctaggtgcagccttgtagttttagtggactttaggctacgactcggaccgatg

SEQ ID NO: 13379 - DNA, 203 bp, Homo sapiens
ggcgcgccagtcctgcgcccaggtgatcttgcttccttatacaattttctaccaccgtacctaaggaagtagtgctatcttaataattaggttaactatttagttttactgttcaggatgcctattggcagccccataatatccaggacaccctctctgcttcttatatgattaggttgtcatttagacgactcggaccgatg

SEQ ID NO: 13380 - DNA, 203 bp, Homo sapiens
ggcgcgccagtcctcaaagcacgtgatcttgcttccttatacaattttgagaggttaataagaaggaagtagtgctatcttaataattaggttaactatttagttttactgttcaggagtttggcgatggtacccataatatccaggacaccctctctgcttcttatatgattaggttgtcatttagacgactcggaccgatg

SEQ ID NO: 13381 - DNA, 203 bp, Homo sapiens
ggcgcgccagtcctcaaagtcggtgatcttgcttccttatacaattttgagaggttaataagaaggaagtagtgctatcttaataattaggttaactatttagttttactgttcaggatgcctattggcagccccataatatccaggacaccctctctgcttcttatatgattataggaagggcatttcgactcggaccgatg

SEQ ID NO: 13382 - DNA, 203 bp, Homo sapiens
ggcgcgccagtcctcgcgtggagtgatcttgcttccttatacaattttgagaggttaataagaaggaagtagtgctatcttaataattaggttaactatttagttttactgttcaggatgcctattggcagccccataatatccagtcgtagggtgggtattcttatatgattaggttgtcatttagacgactcggaccgatg

SEQ ID NO: 13383 - DNA, 203 bp, Homo sapiens
ggcgcgccagtcctccagaaccgtgatcttgcttgcggaggcaaaatttgcacagtataaaatctgcaagtagtgctattgttggaatcaccgtacctatttaggtttacgctccaagatcggtggatagcagccctatcaatatcccttcctctgagaatatgtttagaagattaggtagtctctaacgactcggaccgatg

SEQ ID NO: 13384 - DNA, 203 bp, Homo sapiens
ggcgcgccagtcctagaaccgagtgatcttgcttgcggaggcaaaatttgcacagtataaaatctgcaagtagtgctattgttggaatcaccgtacctatttaggtttacgctccaagatcggtggatagcagccctatcaatatctaggagaactgtgctatgtttagaagattaggtagtctctaacgactcggaccgatg

SEQ ID NO: 13385 - DNA, 203 bp, Homo sapiens
ggcgcgccagtcctaggagtgtgtgatcttgcttgcggaggcaaaatttgcacagtataaaatctgcaagtagtgctattgttggaatcattccgtaacgggttgtttacgctccaagatcggtggatagcagccctatcaatatctaggagaactgtgctatgtttagaagattaggtagtctctaacgactcggaccgatg

SEQ ID NO: 13386 - DNA, 203 bp, Homo sapiens
ggcgcgccagtcctctccaaccgtgatgctgggcgagagagagccgccgcgccggagcctccttctttcctgcctctgattccgggctgtcatggcgacccccaacaatctgacccccaccaactgcagctggtggcccatctccgacgaacccgaatgggcggccaagccagcggaggcccccgacgcgactcggaccgatg

SEQ ID NO: 13387 - DNA, 203 bp, Homo sapiens
ggcgcgccagtcctgtgcgaatgtgatgctgggcgagagagagccgccgcgccggagcctccttctttcctgcctctgattccgggctgtcatggcgacccccaacaatctgacccccaccaactgcagctggtggcccatctccgcgctggagagcgatagttagtgttgcctggaggcccccgacgcgactcggaccgatg

SEQ ID NO: 13388 - DNA, 203 bp, Homo sapiens
ggcgcgccagtccttagagcgcgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgcgactcggaccgatg

SEQ ID NO: 13389 - DNA, 203 bp, Homo sapiens
ggcgcgccagtcctggtccgtggtgatgctgggcgagagagagccgccgcgccggagcctccttctttcctgcctctgattccgggctgtcatggcgacccccaacaatctgacccccaccaactgcagctgtctaagtcgtataccgctggagagcgatgcggccaagccagcggaggcccccgacgcgactcggaccgatg

SEQ ID NO: 13390 - DNA, 203 bp, Homo sapiens
ggcgcgccagtcctagcgcgaggtgatgctgggcgagagagagccgccgcgccggagcctccttctttcctgcctctgattccgggctgtcatggcgacccccaacaatctgacccccctaggtgctgctacgtggcccatctccgcgctggagagcgatgcggccaagccagcggaggcccccgacgcgactcggaccgatg

SEQ ID NO: 13391 - DNA, 203 bp, Homo sapiens
ggcgcgccagtcctcagtatttgtgattagaacggtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttcgactcggaccgatg

SEQ ID NO: 13392 - DNA, 203 bp, Homo sapiens
ggcgcgccagtccttccctgtagtgcactattcaacgggagatctattttccccttcgtcgatgttggagtgtcggctctcctgctagcagccggatgctggggacaagtcaccctcaccgttacggtaacagcggcaacactccttttttgccactatgcctacatggttcccggttggcaagctgacgactcggaccgatg

SEQ ID NO: 13393 - DNA, 203 bp, Homo sapiens
ggcgcgccagtcctctttggcggtgcactattcacactcgcgcgaggcaggattacttattgtgttggagtgtcggctctcctgctagcagccggatgctggggacaagtcaccctcaccgttacggtaacagcggcaacactccttttttgccactatgcctacatggttcccggttggcaagctgacgactcggaccgatg

SEQ ID NO: 13394 - DNA, 203 bp, Homo sapiens
ggcgcgccagtcctggacaaccgtgcactattcacactcgcgcgaggcttccccttcgtcgatgttggagtgtcggctctcctgctagcagccggatgctggggtgccactcttagtcccgttacggtaacagcggcaacactccttttttgccactatgcctacatggttcccggttggcaagctgacgactcggaccgatg

SEQ ID NO: 13395 - DNA, 203 bp, Homo sapiens
ggcgcgccagtcctccgctgccgtgcactattcacactcgcgcgaggcttccccttcgtcgatgttggagtgtcggtgtcagctacgtaggccggatgctggggacaagtcaccctcaccgttacggtaacagcggcaacactccttttttgccactatgcctacatggttcccggttggcaagctgacgactcggaccgatg

SEQ ID NO: 13396 - DNA, 203 bp, Homo sapiens
ggcgcgccagtcctctatagccgtggcaagacaagctcagaactgagaagctgtcaccacagttctggaggctgggaagttcaagatcaaagtgccagcagattcagtgtcatgtgaggacgtgcttcctgcttcatagataagagtagcttggagctcgatacgttgcgactgaccatctggtcgcgcgactcggaccgatg

SEQ ID NO: 13397 - DNA, 203 bp, Homo sapiens
ggcgcgccagtcctggtgtttcgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgcgactcggaccgatg

SEQ ID NO: 13398 - DNA, 203 bp, Homo sapiens
ggcgcgccagtccttaagattggtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagctaatcgcaagtatccgactcggaccgatg

SEQ ID NO: 13399 - DNA, 203 bp, Homo sapiens
ggcgcgccagtcctaggaacgggtggcaagacaagctcagaactgagaagctgtcaccacagttctggaggctgggaagttcaagatcaagtattggatgatgccagtgtcatgtgaggacgtgcttcctgcttcatagataagagtagcttggagctcggcggcacaaccagcaccatctggtcgcgcgactcggaccgatg

SEQ ID NO: 13400 - DNA, 203 bp, Homo sapiens
ggcgcgccagtcctgggagccagtggcaagacaagctcagaactgagaagctgtcaccacagttctggaggctgggctcacttccgaactagtgccagcagattcagtgtcatgtgaggacgtgcttcctgcttcatagataagagtagcttggagctcggcggcacaaccagcaccatctggtcgcgcgactcggaccgatg

SEQ ID NO: 13401 - DNA, 203 bp, Homo sapiens
ggcgcgccagtcctagtttggcgtggcaagacaagctcagaactgagatctacgtgtggagtttctggaggctgggaagttcaagatcaaagtgccagcagattcagtgtcatgtgaggacgtgcttcctgcttcatagataagagtagcttggagctcggcggcacaaccagcaccatctggtcgcgcgactcggaccgatg

SEQ ID NO: 13402 - DNA, 203 bp, Homo sapiens
ggcgcgccagtcctcactgtgagtggcagggacaaccacaaccacaacggccgggggaggagaaggcggcagcggcgattctaggcggcccaggcggcggggaggaggagaaggaggagggtggcggccgggcttggcttcggctctcgataacaacttgggcggcgcgacccggggaaccggcattgcgactcggaccgatg

SEQ ID NO: 13403 - DNA, 203 bp, Homo sapiens
ggcgcgccagtcctgcggatctgtggcagggacaaccacaaccacaacggccgggggaggaggccatacgccatttgattctaggcggcccaggcggcggggaggaggagaaggaggagggtggcggccgggcttggcttcggctccttgaggagttggcggcggcgcgacccggggaaccggcattgcgactcggaccgatg

SEQ ID NO: 13404 - DNA, 203 bp, Homo sapiens
ggcgcgccagtcctattgtcttgtggcagggacaggtgagcagtttttggccgggggaggagaaggcggcagcggcgattctaggcggcccaggcggcggggaggaggagaaggaggagggtggcggccgggcttggcttcggctccttgaggagttggcggcggcgcgacccggggaaccggcattgcgactcggaccgatg

SEQ ID NO: 13405 - DNA, 203 bp, Homo sapiens
ggcgcgccagtcctctcccaaagtggctgggctgctcgggttagatcgtcaggtgagggaggccacccatcaagaagcgaaggaagtgctggagtcgtgtgttttggctgcgcgtgatcctgcgtgggtcgggaggtgtttctgtgaaaagcctaaagattagactgtaagaaaagaaaatagaagcccgactcggaccgatg

SEQ ID NO: 13406 - DNA, 203 bp, Homo sapiens
ggcgcgccagtcctctctccacgtgggcatgggagtcagctgcacagtcactcgggaagatggaaccaatcgcagaggacttctattactaaccgatcacatgatgtcacccagacatcaggcatacccactagtgtgaaatagacatcagaattaagaaaaacgtagggtccaagtggtttcccgttcgactcggaccgatg

SEQ ID NO: 13407 - DNA, 203 bp, Homo sapiens
ggcgcgccagtcctttgtagtagtgggcatgggagtcagctgcacagtcactcgggaagatggaaccaatcgcagatagggctgccagtgaaccgatcacatgagtaatgagtttaggcaggcatacccactagtgtgaaatagacatcagaattaagaaaaacgtagggtccaagtggtttcccgttcgactcggaccgatg

SEQ ID NO: 13408 - DNA, 203 bp, Homo sapiens
ggcgcgccagtcctgcccgcttgtggtggtggtggaaggggggaggtgctagcagggccagccttgaactcgctggacagagctacagacctatggggcctggaagtgcccgctgagaaagggagaagacagagttttttaatgtcaggtgaggggttgcctccgaggcaacctccaagtcccagatccgactcggaccgatg

SEQ ID NO: 13409 - DNA, 203 bp, Homo sapiens
ggcgcgccagtcctggaggcaggtggtggtggtggaaggggggaggtgctagcagggccagccttgaactcgctggacagagctacagacctatggggcctggaagtgcccgctgagaaagggagaagacagcagaggggttgccgaggtgaggggttgcctccgaggcaaccttggtagggagacgacgactcggaccgatg

SEQ ID NO: 13410 - DNA, 203 bp, Homo sapiens
ggcgcgccagtcctcggcctccgtggtggtggtggaaggggggaggtgctagcagggccagccttgaactcgctggcacttaggtacagtctatggggcctggaagtgcccgctgagaaagggagaagacagcagaggggttgccgaggtgaggggttgcctccgaggcaacctccaagtcccagatccgactcggaccgatg

SEQ ID NO: 13411 - DNA, 203 bp, Homo sapiens
ggcgcgccagtcctcttccctggtgtaaatccaggctcgaaccctactgcgaggtggagagcctcttaaccggatgctacgggtgatgactgggaggaggagaaaaattacctctttatcttgcatgaacatcttaattttcaggaccagaggagcgagagcagcaagaaccacacccagcagcaatgcgactcggaccgatg

SEQ ID NO: 13412 - DNA, 203 bp, Homo sapiens
ggcgcgccagtcctctttaagcgtgtaaatccagttagaccaaaatgacgcgttcccctctgctcttaaccggatgctacgggtgatgactgggaggaggagaaaaattacctctttatcttgcatgaacatcttaattttcaggaccagaggagcgagagcagcaagaaccacacccagcagcaatgcgactcggaccgatg

SEQ ID NO: 13413 - DNA, 203 bp, Homo sapiens
ggcgcgccagtcctaggcgtacgtgtaaatccagttagaccaaaatgagcgaggtggagagcctcttaaccggatgctacgggtgatgacaatccatcctgcgcaaattacctctttatcttgcatgaacatcttaattttcaggaccagaggagcgagagcagcaagaaccacacccagcagcaatgcgactcggaccgatg

SEQ ID NO: 13414 - DNA, 203 bp, Homo sapiens
ggcgcgccagtcctccgggcccgtgtaaatccagttagaccaaaatgagcgaggtggagagcctcttaaccggatgctacgggtgatgactgggaggaggagaaaaattacctctttatcttgcatgaacatcttaattttcaggaccagaggagcgagaatctagtagcttgaacccagcagcaatgcgactcggaccgatg

SEQ ID NO: 13415 - DNA, 203 bp, Homo sapiens
ggcgcgccagtccttatcataggtgtgagagggaagcgccgcggcctgcgcagacgaggggtcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 13416 - DNA, 203 bp, Homo sapiens
ggcgcgccagtcctgacgtgccgtgtgagagggaagcgccgcggcctgtatttctagacctgcccttcgcctggttcgtggcgccttgtgaccccgggcccctgaacaggcattaaacgaaattgcgctgtgctcctgtgctacggcctgtggctggactgcctgctgctgcccaactggctggcaagcgactcggaccgatg

SEQ ID NO: 13417 - DNA, 203 bp, Homo sapiens
ggcgcgccagtcctatgacctagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgccccgtcaatgccttgccgactcggaccgatg

SEQ ID NO: 13418 - DNA, 203 bp, Homo sapiens
ggcgcgccagtcctgtctgagtgtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccgctaaaaacattttcgactcggaccgatg

SEQ ID NO: 13419 - DNA, 203 bp, Homo sapiens
ggcgcgccagtcctatctaacagtgtgagagggaagcgccgcggcctgtatttctagacctgcccttcgcctggttcgtggcgccttgtgaccccgggcccctgccgcctgcaagtcggaaattgcgctgtgtcgtatctggttaccctgtggctggactgcctgctgctgcccaactggctggcaagcgactcggaccgatg

SEQ ID NO: 13420 - DNA, 203 bp, Homo sapiens
ggcgcgccagtcctgtctgcccgtgtgagagggaagcgccgcggcctgtatttctagacctgcccttcgcctggttcgtggcgccttgtgtttattacggggatccgcctgcaagtcggaaattgcgctgtgctcctgtgctacggcctgtggctggactgcctgctgctgcccaactggctggcaagcgactcggaccgatg

SEQ ID NO: 13421 - DNA, 203 bp, Homo sapiens
ggcgcgccagtcctaactcctagtgtgagagggaagcgccgcggcctgtatttctagacctgcccttcgcctggttgtcacgagaaaagaaccccgggcccctgccgcctgcaagtcggaaattgcgctgtgctcctgtgctacggcctgtggctggactgcctgctgctgcccaactggctggcaagcgactcggaccgatg

SEQ ID NO: 13422 - DNA, 203 bp, Homo sapiens
ggcgcgccagtcctgcacacacgtgtgagagggatatagacgaattcttatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 13423 - DNA, 203 bp, Homo sapiens
ggcgcgccagtcctccaacggcgtgtgatcttgcgcgataaatgctgacgtgaaaacgttgcgtattgctacaacacttggttagctatttagctttactaatcaagacgccgtcgtgcagcccacaaaagtctagatacgtcacaggagagcatacgctaggtcgcgttgactgctgaatgtgtcatcgactcggaccgatg

SEQ ID NO: 13424 - DNA, 203 bp, Homo sapiens
ggcgcgccagtccttaaatggtgttaagtttcgcactactaggaatttttgcgaaaattcttaattccattcttatggtgtagtgtttgttcttttcaattggggcgtatctctctttcgcagagaccctggcccaaccctgaaatgaataaaattttactggtcgcgcgtctcaatcgaccttctagcgactcggaccgatg

SEQ ID NO: 13425 - DNA, 203 bp, Homo sapiens
ggcgcgccagtcctgggaaatcgttaagtttcgcactactaggaatttttgcgaaaattcttaattccattcttatggtgtagtgtttgttcttttcaattggggcgtatctctctttcgcagagaccctggcccaaccctgaaattcgagcggcgagggaaaaattcatcgaaaatcgaccttctagcgactcggaccgatg

SEQ ID NO: 13426 - DNA, 203 bp, Homo sapiens
ggcgcgccagtcctcacgtcaggttaccctccttagtttagctgtgagctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 13427 - DNA, 203 bp, Homo sapiens
ggcgcgccagtcctggcccttagttaccctccttccggacagcaccccctcccttctccggtagctcctacccctgcctgtgcgggcctcccaaagatttaagaccctcggtgctgcctccgacagcgccgcgctctctcagccgcccccctgcccctcgggcccccctctctgctgcccctggcgcccgactcggaccgatg

SEQ ID NO: 13428 - DNA, 203 bp, Homo sapiens
ggcgcgccagtcctgctaagtagttaccctccttccggacagcaccccctcccttctccggtagctcctacccctgcctgtgcgggcctcgtccccgcgcccagattgtaccttacaatccgacagcgccgcgctctctcagccgcccccctgcccctcgggcccccctctctgctgcccctggcgcccgactcggaccgatg

SEQ ID NO: 13429 - DNA, 203 bp, Homo sapiens
ggcgcgccagtcctcggtcgaggttaccctccttccggacagcaccccctcccttctccggtagctcctacccctgcctgtgcgggcctcgtccccgcgcccagccctcggtgctgcccttactctgcgatagctctctcagccgcccccctgcccctcgggcccccctctctgctgcccctggcgcccgactcggaccgatg

SEQ ID NO: 13430 - DNA, 203 bp, Homo sapiens
ggcgcgccagtcctagtcatctgttaccctccttccggacagcaccccctcccttctccggtagctcctacccctgcctgtgcgggcctcgtccccgcgcccagccctcggtgctgcctccgacagcgccgcatggagcggattctccccctgcccctcgggcccccctctctgctgcccctggcgcccgactcggaccgatg

SEQ ID NO: 13431 - DNA, 203 bp, Homo sapiens
ggcgcgccagtcctaaccagatgttaccctccttccggacagcaccccctcccttctccggtagctcctacccctgcctgtgcgggcctcgtccccgcgcccagccctcggtgctgcctccgacagcgccgcgctctctcagccgcccccctgcccctcgctaagtagaaatgcctgcccctggcgcccgactcggaccgatg

SEQ ID NO: 13432 - DNA, 203 bp, Homo sapiens
ggcgcgccagtcctgttgcctcgttaccctccttccggacagcaccccctcccttctccggtagctcctacccctgcctgtgcgggcctcgtccccgcgcccagccctcggtgctgcctccgacagcgccgcgctctctcagccgcttagtctgatacgcggcccccctctctgctgcccctggcgcccgactcggaccgatg

SEQ ID NO: 13433 - DNA, 203 bp, Homo sapiens
ggcgcgccagtcctcggattcagttaccctccttccggacagcaccccctcccttctccggtagctcctacccctgttaacagcttgaaggtccccgcgcccagccctcggtgctgcctccgacagcgccgcgctctctcagccgcccccctgcccctcgggcccccctctctgctgcccctggcgcccgactcggaccgatg

SEQ ID NO: 13434 - DNA, 203 bp, Homo sapiens
ggcgcgccagtccttctctagtgttaccctccttccggacagcaccccctcccttctccggtcatctactttgggtcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 13435 - DNA, 203 bp, Homo sapiens
ggcgcgccagtcctgttctagggttaccctccttccggacagcaccccgggttccggtgaacagctcctacccctgcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 13436 - DNA, 203 bp, Homo sapiens
ggcgcgccagtcctcacagttcgttccatgccccgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatccgactcggaccgatg

SEQ ID NO: 13437 - DNA, 203 bp, Homo sapiens
ggcgcgccagtcctggatcaaggttccccaacttcctcggcgctccggactcccaagtctccgccggaccctcctttggatattcctcgtgtctccgattctgacgttttttaccggtacggtggggcctccccacctgccccgcagaagatgcagttctttggccgcctggtcaataccttcagtggcgactcggaccgatg

SEQ ID NO: 13438 - DNA, 203 bp, Homo sapiens
ggcgcgccagtcctgtgttcgtgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcgtagatacactatacgactcggaccgatg

SEQ ID NO: 13439 - DNA, 203 bp, Homo sapiens
ggcgcgccagtcctgggcgcgtgttccccaacttcctcggcgctccggactcccaagtctccgccggaccctcctttggatattcctcgtgtctccgattctgagacagagggggaagacggtggggcctccgggaggatgagcacgaagatgcagttctttggccgcctggtcaataccttcagtggcgactcggaccgatg

SEQ ID NO: 13440 - DNA, 203 bp, Homo sapiens
ggcgcgccagtccttgggacaggttccccaacttttaaacaaggtgacactcccaagtctccgccggaccctcctttggatattcctcgtgtctccgattctgagacagagggggaagacggtggggcctccccacctgccccgcagaagatgcagttctttggccgcctggtcaataccttcagtggcgactcggaccgatg

SEQ ID NO: 13441 - DNA, 203 bp, Homo sapiens
ggcgcgccagtccttaacgcccgttcttaaacggcgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgcgactcggaccgatg

SEQ ID NO: 13442 - DNA, 203 bp, Homo sapiens
ggcgcgccagtcctgaggtcatgttgaagcattacaggccaggtctctgcctcggaagaagagctgaggtttgccatccagaacaagcacctctgccaccggatgtcctctgcgctggaatcagtcactgtcagcgacagacccctcggggtgtccatcacaaaagccgaggtagcccctgaagaagacgactcggaccgatg

SEQ ID NO: 13443 - DNA, 203 bp, Homo sapiens
ggcgcgccagtcctaattacgggttgattttttatttactttgcaaaacgcgtccgccattcgagcatctagtttcaacttccttttgcagcaagttctttcctgcactaatcacaattcttggaagaggagaactggacgttgtgaacagagttagctggtaaatgtcctcttaaaagatccaaaaacgactcggaccgatg

SEQ ID NO: 13444 - DNA, 203 bp, Homo sapiens
ggcgcgccagtcctattagcgggttgattttttatttactttgcaaaagtttctgataggcgtctttatatagggaaacttccttttgcagcaagttctttcctgcactaatcacaattcttggaagaggagaactggacgttgtgaacagagttagctggtaaatgtcctcttaaaagatccaaaaacgactcggaccgatg

SEQ ID NO: 13445 - DNA, 203 bp, Homo sapiens
ggcgcgccagtcctttgctaacgttgcaagcctaatgctcacctgcagagacagaattcctgagtgaacgaacagagcagctcctcttccatctccagaaatgacctccaccttcaacccccgagaatgtaagaaacagctcgtctaagggcaaaactatggcttcttcctgcgaattgagaaggacacgactcggaccgatg

SEQ ID NO: 13446 - DNA, 203 bp, Homo sapiens
ggcgcgccagtcctgcgcactagtttcccctggactcgttcataacctgattggcatgctacaggctgttgctgacggcaaggctcatttcactgagtcagtgaagccagtgctcgacctgacaaattcaatgggtgtggttcattaatgaataacatgtcttctgctgcgcccatgggttcgcgacccgactcggaccgatg

SEQ ID NO: 13447 - DNA, 203 bp, Homo sapiens
ggcgcgccagtccttacctgcggtttcccctggactcgttcataacctgattggcatgctacaggctgttgctgacggcaaggctcatttcactgagtcagtgaagccagtgctcgactaacagctgatttgcctgtgtcgggtggaatgaataacatgtcttctgctgcgcccatgggttcgcgacccgactcggaccgatg

SEQ ID NO: 13448 - DNA, 203 bp, Homo sapiens
ggcgcgccagtcctgatacttggtttcccctggactcgttcataacctgattggcatgctacaggctgttgctgacggcaaggctcattttcaaccagatcattagccagtgctcgacctgacaaattcaatcctgtgtcgggtggaatgaataacatgtcttctgctgcgcccatgggttcgcgacccgactcggaccgatg

SEQ ID NO: 13449 - DNA, 203 bp, Homo sapiens
ggcgcgccagtcctgtttctgggtttggtgcgtcgcgcttcaatcaccgcgagtttacgcgggccagttgttgctggtcgcatgggagctgctgctaaataatttctgctcagccatgtcgccggctccagatgcagccccggctcctgcgtcgatctccctgtttgacctcagcgcggatgctccggcgactcggaccgatg

SEQ ID NO: 13450 - DNA, 203 bp, Homo sapiens
ggcgcgccagtcctcctctccggtttggtgcgtcttctaagggcgtgggcgagtttacgcgggccagttgttgctggtcgcatgggagctatctagttcctggatctgctcagccatgtcgccggctccagatgcagccccggctcctgcgtcgatctccctgtttgacctcagcgcggatgctccggcgactcggaccgatg

SEQ ID NO: 13451 - DNA, 203 bp, Homo sapiens
ggcgcgccagtcctattagaaagtttggtgcgtcttctaagggcgtgggcgagtttacgcgggccagttgttgctggtcgcatgggagctgctgctaaataatttctgctcagccatgtcgccggctccagatgcagccccggctcctgcgtcgatctccctgtttgacctcaggatcatcctcgtctcgactcggaccgatg

SEQ ID NO: 13452 - DNA, 203 bp, Homo sapiens
ggcgcgccagtccttacttcttgtttggtgcgtcttctaagggcgtggtgagtgagcaattcgccagttgttgctggtcgcatgggagctgctgctaaataatttctgctcagccatgtcgccggctccagatgcagccccggctcctgcgtcgatctccctgtttgacctcagcgcggatgctccggcgactcggaccgatg

SEQ ID NO: 13453 - DNA, 203 bp, Homo sapiens
ggcgcgccagtccttctgcattgttttgaaactgacttccagagctccactgcctccctgcaccatgccctacaacttctgcctgcccagcctgagctgccgcaccagctgcgttagatggccctgtgtgccccccagctgccacggctacaccctgcccggggcctgcaacatccctgccaatgtgacgactcggaccgatg

SEQ ID NO: 13454 - DNA, 203 bp, Homo sapiens
ggcgcgccagtccttggcgccggttttgaaactgacttccagagctccactgcctccctgcaccatgccctacaacttctgcctgcccagcctgagctgccgcaccagctgctcctccatcgtgcaaacctaccccagctgccacggctacaccctgcccggggcctgcaacatccctgccaatgtgacgactcggaccgatg

SEQ ID NO: 13455 - DNA, 203 bp, Homo sapiens
ggcgcgccagtcctaatccgaggttttgaaactgacttccagagctccactgcctccctgcaccatgccctacaacttctgcctgcccagcctgagctgccgcaccagctgctcctcccggccctgtgtgccccccagctgccacggcactcttttgcccggggcctgcaacatccctgccaatgtgacgactcggaccgatg

SEQ ID NO: 13456 - DNA, 203 bp, Homo sapiens
ggcgcgccagtcctgtacgtaagttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacataggaagtttctgtccgactcggaccgatg

SEQ ID NO: 13457 - DNA, 203 bp, Homo sapiens
ggcgcgccagtcctgttcatacgttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 13458 - DNA, 203 bp, Homo sapiens
ggcgcgccagtcctcagagagtgttttgaaactgacttccagagctccactgcctccctgcaccatgccctacaacttctgcctgcccagcctgagctgccgcagtctactgatacagcggccctgtgtgccccccagctgccacggctacaccctgcccggggcctgcaacatccctgccaatgtgacgactcggaccgatg

SEQ ID NO: 13459 - DNA, 203 bp, Homo sapiens
ggcgcgccagtcctggacgttcgttttgaaactgacttccagagctcctgccggagttacatccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 13460 - DNA, 203 bp, Homo sapiens
ggcgcgccagtcctcaagacttgttttgaaactggtccatgattagtaactgcctccctgcaccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 13461 - DNA, 203 bp, Homo sapiens
ggcgcgccagtccttcgtatgttaaaagctgtccgcgcgggagcccagcaagttcgcttcactgtccctggacttgtcttggttccagaacctgacgacccggcgacggcgacgtctcttttgactaaaagacagtgtccagtgctccagcctaggagtctacggggaccgcctcccgcgccgccacccgactcggaccgatg

SEQ ID NO: 13462 - DNA, 203 bp, Homo sapiens
ggcgcgccagtcctgacccaactaaaagctgtccgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccacccgactcggaccgatg

SEQ ID NO: 13463 - DNA, 203 bp, Homo sapiens
ggcgcgccagtcctgaagaaggtaaacaggctctcgcgatcactaccaggccgtggcaggctggctgggtaccggctgtcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13464 - DNA, 203 bp, Homo sapiens
ggcgcgccagtcctgtcgggagtaaacaggctctgtatccgtggcagcggccgtggcaggctggctgggtaccggctgtcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13465 - DNA, 203 bp, Homo sapiens
ggcgcgccagtcctggagatcgtaaacaggctctgtatccgtggcagcggccgtggcaggctggctgggtaccggctgtcgctgacccaggagaagctgcctgtctacatcagcctgggctgcagcgcgctgtgagtatatacgtcgcagagcagaactcctctagggaacctggatgggaaacagcccgactcggaccgatg

SEQ ID NO: 13466 - DNA, 203 bp, Homo sapiens
ggcgcgccagtcctcgaaaggataaacaggctctgtatccgtggcagcggccgtggcaggctggctgggtgggttaatgcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13467 - DNA, 203 bp, Homo sapiens
ggcgcgccagtccttgtccggttaaacaggctctgtatccgtggcagctttgtgccagctaaggctgggtaccggctgtcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13468 - DNA, 203 bp, Homo sapiens
ggcgcgccagtcctagaggtcctaaacaggctctgtatccgtggccctaagacgggcaggctggctgggtaccggctgtcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13469 - DNA, 203 bp, Homo sapiens
ggcgcgccagtccttacccggataaacaggctctgtatccgtggccctaagacgggcaggctggctgggtgggttaatgcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13470 - DNA, 203 bp, Homo sapiens
ggcgcgccagtcctggcgcatttaaactgtgccgtgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactccccgactcggaccgatg

SEQ ID NO: 13471 - DNA, 203 bp, Homo sapiens
ggcgcgccagtcctttgcacggtaaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacagattcagttaaaaccgactcggaccgatg

SEQ ID NO: 13472 - DNA, 203 bp, Homo sapiens
ggcgcgccagtcctcatgatcctaaagaacaggaaaaagagaaaaaatcagtgatctgtgtcgagggcaatattgcaagtgggaagacgagcatttcccttacattctccaacgcgacagacgtcgaggtgttaacggagcctgtgtccaagtggagaaatgtccgtggccacaatcctctgggcctgcgactcggaccgatg

SEQ ID NO: 13473 - DNA, 203 bp, Homo sapiens
ggcgcgccagtcctgtcaccagtaaagaacaggatttcccccgttgcacagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgcgactcggaccgatg

SEQ ID NO: 13474 - DNA, 203 bp, Homo sapiens
ggcgcgccagtcctataccggctaaagatgaggtttttgctaaatttttttgagtttatatttgtatgtcttatgctgaaaaatcttgtttcctaattagtaacgggcgatgaaggacgatgggtaaatattttagggccgattctttggttttatagccaagataccctgttgataaagtcttgtggcgactcggaccgatg

SEQ ID NO: 13475 - DNA, 203 bp, Homo sapiens
ggcgcgccagtcctaagcctcgtaaatattactttcctcaaaaagagaaaacaaaaatgctagattttactttatgacttgaatgatgtggtaatgtcgaactctagtatttagaattagaatgtttcttagcggtcgtgtagttatttttatgtcataacctaggcgcagaccagctcctataacaacgactcggaccgatg

SEQ ID NO: 13476 - DNA, 203 bp, Homo sapiens
ggcgcgccagtcctgtaagacataaatcccacgagggtcctttcttggattaacccgctcaatgcccggaaatttgggcgtgcccccgcaagactgctagccgagtagtgttgggtcgcgaaaggccttgcggtactgcctgatagggtgcttgcgagtgccccgggaggtctcgtagaccgtgcacccgactcggaccgatg

SEQ ID NO: 13477 - DNA, 203 bp, Homo sapiens
ggcgcgccagtcctacacgacctaaatcccggccgatatggactcaaaaagaattaaaagaagctttgtccgatgggatagtgaagtctcacaccaacatttacaattgttatttagaaaacatagaaattatatatgtcaaggcttacttaagttagtaaaaacacatcagagtgggataagtgacacgactcggaccgatg

SEQ ID NO: 13478 - DNA, 203 bp, Homo sapiens
ggcgcgccagtcctaacgattttaaattcccgcttaagttggctggtactgccgtaataaatttaagagcagaccatgcagccatgtatctttattcccttcttgaaaagggtaaactacttattagagatacaaataaagaagttttcgttggtgacagtttggttaatgtaatctaaactttaaaacgactcggaccgatg

SEQ ID NO: 13479 - DNA, 203 bp, Homo sapiens
ggcgcgccagtcctaccatcaataaccttacactgtaaggggggggtgaagaaggggccggccttcaagcaagagcgacgcaagatggcagccaccacgggctcgggagtaaaagtccctcgcaatttccgactgttggaagaactcgaagaaggccagaaaggagtaggagatggcacagttagctgcgactcggaccgatg

SEQ ID NO: 13480 - DNA, 203 bp, Homo sapiens
ggcgcgccagtccttgaggtggtaagacacttgctgtcctaacacctgctataggctatccactgcatcatctctcctgccatacttcctactcacatcatatctattttaaagaaaaaataggcccgaacactaatcgtgccggcagtgccactgcacacacaacactacacagcaccggactgtgccgactcggaccgatg

SEQ ID NO: 13481 - DNA, 203 bp, Homo sapiens
ggcgcgccagtcctcttccacttaagacacttgctgtcctaacacctgctataggctatccactgcatcatctctcctgccatacttcctactcacatcatatctattttaaagaaaaaataggcccgaacactaatcgtgccggctaacttctgtgcatcacaacactacacatacaatacactacacgactcggaccgatg

SEQ ID NO: 13482 - DNA, 203 bp, Homo sapiens
ggcgcgccagtcctgaaacccttaagacacttgctgtcctaacacctgctataggctatccactgcatcatctctcggcggtggtcatagactcacatcatatctattttaaagaaaaaataggcccgaacactaatcgtgccggcagtgccactgcacacacaacactacacatacaatacactacacgactcggaccgatg

SEQ ID NO: 13483 - DNA, 203 bp, Homo sapiens
ggcgcgccagtcctctctctcgtaagacacttgctgtcctaacacctggcgattttaccattctgcatcatctctcctgccatacttcctactcacatcatatctattttaaagaaaaaataggcccgaacactaatcgtgccggcagtgccactgcacacacaacactacacatacaatacactacacgactcggaccgatg

SEQ ID NO: 13484 - DNA, 203 bp, Homo sapiens
ggcgcgccagtcctaagtgctctaagatcgacaccggcgactgcggcgggctcgacgaggcggctgacggggcggcggcgggaagacggccgggtgcgccttggggtttagtggcggcttctccatgggtccagccagccgcttccctgtgctgtgagtgtttccaccactccaggagacagcattcacgactcggaccgatg

SEQ ID NO: 13485 - DNA, 203 bp, Homo sapiens
ggcgcgccagtcctacggattataagcctgagaaaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcgcgactcggaccgatg

SEQ ID NO: 13486 - DNA, 203 bp, Homo sapiens
ggcgcgccagtcctagatcacctaaggataatggggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatccgactcggaccgatg

SEQ ID NO: 13487 - DNA, 203 bp, Homo sapiens
ggcgcgccagtcctcgatgcgctaaggccaatacacgggagctggttgtgagtcaccaaggaaggcagcggcagctccactcagccagtacccagatacgctgggaaccttccccagcacccaagatttactggcagatcctcttctggagcataattagcatcatcattattctggctggagcaattcgactcggaccgatg

SEQ ID NO: 13488 - DNA, 203 bp, Homo sapiens
ggcgcgccagtccttcccaccttaaggccaatacacgggagctggttgtgagtcaccaaggaaggcagcggcagctccactcagccagtacccagatacgctgggaaccttccccagccatggcttccctggggcagatcctcttccctgtgggctggttcatcatcattattctggctggagcaattcgactcggaccgatg

SEQ ID NO: 13489 - DNA, 203 bp, Homo sapiens
ggcgcgccagtcctgactagggtaaggccaatacacgggagctggttgtgagtcaccaaggaaggcagcggcagctccactcagccagtacccagatacgctgggaaccttccccagccatggcttccctggtcgcagggaggacttggagcataattagcatcatcattattctggctggagcaattcgactcggaccgatg

SEQ ID NO: 13490 - DNA, 203 bp, Homo sapiens
ggcgcgccagtcctggctcctgtaaggccaatacacgggagctggttgtgagtcaccaaggaaggcagcggcagctccactcagccagtataacctccactgacgaaccttccccagccatggcttccctggggcagatcctcttctggagcataattagcatcatcattattctggctggagcaattcgactcggaccgatg

SEQ ID NO: 13491 - DNA, 203 bp, Homo sapiens
ggcgcgccagtcctcgtcgtcgtaaggccaatactgattgtgaaaagctgagtcaccaaggaaggcagcggcagctccactcagccagtacccagatacgctgggaaccttccccagccatggcttccctggggcagatcctcttctggagcataattagcatcatcattattctggctggagcaattcgactcggaccgatg

SEQ ID NO: 13492 - DNA, 203 bp, Homo sapiens
ggcgcgccagtcctagtatctgtaagggggcggggcagtctctacacagctcagcatcctgacgcctcctccccttgcaggggcgtgaagctacttcagactctgctgtgacgacttggccgccaggcaccgatcctccccggtgagaaggtccacgaatcttactgcagacagatttgctcagcgcgcgactcggaccgatg

SEQ ID NO: 13493 - DNA, 203 bp, Homo sapiens
ggcgcgccagtcctactatgactaaggtgatccacccgtcggtcccccgggagccctggaggcgcagccccaccccggccggcgcggctcgctcccacgcccccgccgcggcctcgctggagcggacggactgagtcagagggggcgccagcgctgcaggagctgacatggacccaaatcctcgggcccgactcggaccgatg

SEQ ID NO: 13494 - DNA, 203 bp, Homo sapiens
ggcgcgccagtcctatccgcgttaatagctttcaacagagcggggaaagtgcgcatgcgctgactgagtcctcccatggcttcacagaagcagatggaggtagtgaccaaaggaactgggttccggcgccgccccaagaccatcacttacaccccggggacctgcgagctgctcagaggaggagatgccgactcggaccgatg

SEQ ID NO: 13495 - DNA, 203 bp, Homo sapiens
ggcgcgccagtcctcatcccactaatcctgttgcgtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatcgactcggaccgatg

SEQ ID NO: 13496 - DNA, 203 bp, Homo sapiens
ggcgcgccagtcctgggtttgctaatttttgggtactctgcgtcctcgcctcaccagatggagaggagaaaacctatggtggctgtgaaggacctgatgccatgtatgtcaaattgatatcatctgatggccatgaatttattgtaaaaagagaacatgcattaacatcaggcacgataaaagccatgcgactcggaccgatg

SEQ ID NO: 13497 - DNA, 203 bp, Homo sapiens
ggcgcgccagtcctatatcctttacacacctgtgatagctatccaagcgttttcttgacaggataagcgatactagtggttttgctgtttatgttaagtccaaagtcggtaattaccgactgccatcaacccaaaagggttctggcatggacaccgcattgttgagaaataatatctaaattttaaggcgactcggaccgatg

SEQ ID NO: 13498 - DNA, 203 bp, Homo sapiens
ggcgcgccagtcctcgtgacgatacacacctgtgcacatataagcgtggttttcttgacaggataagcgatactagtggttttgctgtttatgttaagtccaaatagacagtacgggaactgccatcaacccaaaagggttctggcatggacaccgcattgttgagaaataatatctaaattttaaggcgactcggaccgatg

SEQ ID NO: 13499 - DNA, 203 bp, Homo sapiens
ggcgcgccagtcctctgtttgatacacacctgtgcacatataagcgtggttttcttgacaggataagcgatactagtggttttgctgtttggtggtcactagctgtcggtaattaccgactgccatcaacccaaaagggttctggcatggacaccgcattgttgagaaataatatctaaattttaaggcgactcggaccgatg

SEQ ID NO: 13500 - DNA, 203 bp, Homo sapiens
ggcgcgccagtcctatgttgtttacagcacagatcaggtgaggagcacaccaaggagtgattacctggggcgctgttgttttctctttcccaacaagattatcatttcctttaaaaaaaatagttatcctggggcatacagccataccattctgaaggtgtcttatctcctctgatctagagagcacccgactcggaccgatg

SEQ ID NO: 13501 - DNA, 203 bp, Homo sapiens
ggcgcgccagtcctgccgtccttacagcacagatcaggtgaggagcacaccaaggagtgatttttaaaacttactctgttttctctttccatttctccagggggtttcctttaaaaaaaatagttatcctggggcatacagccataccattctgaaggtgtcttatctcctctgatctagagagcacccgactcggaccgatg

SEQ ID NO: 13502 - DNA, 203 bp, Homo sapiens
ggcgcgccagtcctcaagcgattacagcacagatcaggtgaggagcacaccaaggagtgatttttaaaacttactctgttttctctttcccaacaagattatcaggctaaaagtctttaatagttatcctggggcatacagccataccattctgaaggtgtcttatctcctctgatctagagagcacccgactcggaccgatg

SEQ ID NO: 13503 - DNA, 203 bp, Homo sapiens
ggcgcgccagtccttccacgtgtacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgtgtgtccccagtgtcgactcggaccgatg

SEQ ID NO: 13504 - DNA, 203 bp, Homo sapiens
ggcgcgccagtcctcccttcgttacagcacagatcaggtgaggagcactaagtaagaatccatttaaaacttactctgttttctctttcccaacaagattatcatttcctttaaaaaaaatagttatcctggggcatacagccataccattctgaaggtgtcttatctcctctgatctagagagcacccgactcggaccgatg

SEQ ID NO: 13505 - DNA, 203 bp, Homo sapiens
ggcgcgccagtcctgcctaagctacagccaacatgaaggggggaggtgctagcagggccagccttgaactcgctggacagagctacagacctatggggcctggaagtgcccgctgagaaagggagaagacagcagaggggttgccgaggtgaggggttgcctccgaggcaacctccaagtcccagatccgactcggaccgatg

SEQ ID NO: 13506 - DNA, 203 bp, Homo sapiens
ggcgcgccagtccttgaatacgtaccaattgctattgtaaaaagtgttaaaacatcgcaaccgtttgtttcataacaaaagccttaggcatctcctatggcaggaagaagcggagacagcgacgaagagctcatcagaacagtcagactcatcaagcttctctatcaaagcagtaagtagtacatgtacgactcggaccgatg

SEQ ID NO: 13507 - DNA, 203 bp, Homo sapiens
ggcgcgccagtcctaaccgtaataccaattgctattgtaaaaagtgttgctttcattgccaagtttgtttcataacaaaagccttaggcatctcctatggcaggaagaagcggagacagcgacgaagagctcatcagaacagtcagactcatcaagcttctctatcaaagcagtggtcgtggggcccccgactcggaccgatg

SEQ ID NO: 13508 - DNA, 203 bp, Homo sapiens
ggcgcgccagtcctgtcgatcctacctttaaagcggggcccggagccttccctccactgccctcgaacgcctcacttcctaagtctctgcatttctcagtcagtggacagcttttgggactcttgtgtgaggactttgggggaccaggccaggctgggcctctgctgattgagatcttgggatccagacgactcggaccgatg

SEQ ID NO: 13509 - DNA, 203 bp, Homo sapiens
ggcgcgccagtcctggcccgcttacgcattaggtcccttcggtgagcatccctcggccttgttctgaatgcacacatgtctaggggctaaggatgtcctacaggtacccgcacgtaaccttcagagagtgcggatctgagtaggagaccgtggtgcactgctttacagatgcagcccggtttaaaaagcgactcggaccgatg

SEQ ID NO: 13510 - DNA, 203 bp, Homo sapiens
ggcgcgccagtcctccagtatgtacgcattaggtggtaagccgagctctccctcggccttgttctgaatgcacacaaactgttctaaatgggatgtcctacaggtacccgcacgtaaccttcagagagtgcggatctgagtaggagaccgtggtgcactgctttacagatgcagcccggtttaaaaagcgactcggaccgatg

SEQ ID NO: 13511 - DNA, 203 bp, Homo sapiens
ggcgcgccagtcctgagtaccttacgcattaggtggtaagccgagctctccctcggccttgttctgaatgcacacatgtctaggggctaactcccaagccggcctacccgcacgtaaccttcagagagtgcggatctgagtaggagaccgtggtgcactgctttacagatgcagcccggtttaaaaagcgactcggaccgatg

SEQ ID NO: 13512 - DNA, 203 bp, Homo sapiens
ggcgcgccagtccttccaaggctacgcattaggtggtaagccgagctctccctcggccttgttctgaatgcacacatgtctaggggctaaggatgtcctacaggtacccgcacgtaaccttcagagagtgcgatcggcgaccttgcaccgtggtgcactgctttacagatgcagcccggtttaaaaagcgactcggaccgatg

SEQ ID NO: 13513 - DNA, 203 bp, Homo sapiens
ggcgcgccagtcctttcgcttttacgcattaggtggtaagccgagctctccctcggccttgttctgaatgcacacatgtctaggggctaaggatgtcctacaggtacccgcacgtaaccttcagagagtgcggatctgagtaggagaccgtggtgcactgctttacagatgcagcccggtttaaaaagcgactcggaccgatg

SEQ ID NO: 13514 - DNA, 203 bp, Homo sapiens
ggcgcgccagtcctccaggctatacgcattaggtggtaagccgagctctccctcggccttgttctgaatgcacacatgtctaggggctaaggatgtcctacaggtacccgcacgtaaccttcagagagtgcggatctgagtaggagttgccctcatgaaactttacagatgcagcccggtttaaaaagcgactcggaccgatg

SEQ ID NO: 13515 - DNA, 203 bp, Homo sapiens
ggcgcgccagtcctagcttccctactgatccaaaatggaagactttgtgcgacagtgcttcaatccaatgattgtcgagcttgcggaaaagacaatgaaggaatatggggaagacccgaaaattgaaacaaataagttcgctgcaatatgcacacacttagaagtctgcttcatgtattcagacttcccgactcggaccgatg

SEQ ID NO: 13516 - DNA, 203 bp, Homo sapiens
ggcgcgccagtcctgtagcaaatactttccggtagcggtgccagggcagtggcctaatacggaactccatttcccgcatgcagggcgattggccgctgaactcagaagcgggaggccggttccggttgcatcagcgagggattcacggcgaaatgagactgttcgtgagtgatggcgtcccgggttgccgactcggaccgatg

SEQ ID NO: 13517 - DNA, 203 bp, Homo sapiens
ggcgcgccagtcctccgcgagctactttccggtagcggtgccagggcagtggcctaatacggggggtgcaacgattgcgtgcctcgcggaggccgctgaactcagaagcgggaggccggttccggttgcatcagcgagggattcacggcgaaatgagactgttcgtgagtgatggcgtcccgggttgccgactcggaccgatg

SEQ ID NO: 13518 - DNA, 203 bp, Homo sapiens
ggcgcgccagtccttagtgaattactttccggtagcggtgccagggcataatttagcactaaaactccatttcccggcgtgcctcgcggaggccgctgaactcagaagcgggaggccggttccggttgcatcagcgagggattcacggcgaaatgagactgttcgtgagtgatggcgtcccgggttgccgactcggaccgatg

SEQ ID NO: 13519 - DNA, 203 bp, Homo sapiens
ggcgcgccagtcctgtagaggctagaaaccagccaggccaatgtgggaaaaaggatagcccaaaggacaagaaaacacttctcactatgaattggtttggaagtaacttcttcaggtgtcctgaggatctttccttactcaacataggggagactctgttgtcacacatgtcatctgaagatgaacatcgactcggaccgatg

SEQ ID NO: 13520 - DNA, 203 bp, Homo sapiens
ggcgcgccagtcctcgcaagtttagaaaccagcttattgccaaagggaaaaaggatagcccaaaggacaagaaaacacttctcactatgaattggtttggaagtaacttcttcaggtgcggaagcttatgcgccttactcaacatatactcacctctgttgtcacacatgtcatctgaagatgaacatcgactcggaccgatg

SEQ ID NO: 13521 - DNA, 203 bp, Homo sapiens
ggcgcgccagtcctagtgcaaatagaaaccagcttattgccaaagggagtctccgagctatcaaggacaagaaaacacttctcactatgaattggtttggaagtaacttcttcaggtgtcctgaggatctttccttactcaacatatactcacctctgttgtcacacatgtcatctgaagatgaacatcgactcggaccgatg

SEQ ID NO: 13522 - DNA, 203 bp, Homo sapiens
ggcgcgccagtccttaacacgttagaacatacgggagacgaagactgagctgttttggctgcatttctggcctcgagccgcagtcagcttctccccgtagaacccggcagtaggagacttagaatcgaatctcttctccctcccgcctcctgtttttggctttttgagaaaccttatcatccaacacacgactcggaccgatg

SEQ ID NO: 13523 - DNA, 203 bp, Homo sapiens
ggcgcgccagtcctccgcaggttagactctggtaacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacacgactcggaccgatg

SEQ ID NO: 13524 - DNA, 203 bp, Homo sapiens
ggcgcgccagtcctggaacgcctagagctgtaatgccagctggttgtggaccagccgtgacctggggcaacccagccaacctcaccgtccaatgggctgcagccacctctctccagtgaggtctgagacccagccttaacgaggctacccccttccaggtccggccgtagcacctccgcgccgtcgcccgactcggaccgatg

SEQ ID NO: 13525 - DNA, 203 bp, Homo sapiens
ggcgcgccagtccttagatttctagattaaacataatcatgcaaaatcactattttgtactactaactcattaagaaaaacttaggatccaagagatttactctaggatctcctattacagagtatgagacatagttgagagttcaacttgcaaaactctaaccttcactctaataacaattcatccacgactcggaccgatg

SEQ ID NO: 13526 - DNA, 203 bp, Homo sapiens
ggcgcgccagtcctatagcgtatagattaaacataatcatgcaaaatcactattttgtactactaactcattaagaaaaacttaggatccaagagatttactcttcacggaatacgatagcttagcagtcattagttgagagttcaacttgcaaaactctaaccttcactctaataacaattcatccacgactcggaccgatg

SEQ ID NO: 13527 - DNA, 203 bp, Homo sapiens
ggcgcgccagtcctgtcgcagctagattaaacataatcatgcaaaatcgggcaagacctaagctaactcattaagaaaaacttaggatccaagagatttactctaggatctcctattaagcttagcagtcattagttgagagttcaacttgcaaaactctaaccttcactctaataacaattcatccacgactcggaccgatg

SEQ ID NO: 13528 - DNA, 203 bp, Homo sapiens
ggcgcgccagtcctctacgatttagattcgcgaatcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagcgactcggaccgatg

SEQ ID NO: 13529 - DNA, 203 bp, Homo sapiens
ggcgcgccagtcctgggtccgatagattctatcttccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 13530 - DNA, 203 bp, Homo sapiens
ggcgcgccagtcctgcttaacatagccacgaggacgagaagaagggagccggaggagctggtcgctgtcggctaagcaagattggagctactcgtcgtccacctccagctcgcgtaagggtggctgtgcgactgcggccatttgtgtcacagcgtatcctagcaagtgatcccccctgtgtgcggggccgactcggaccgatg

SEQ ID NO: 13531 - DNA, 203 bp, Homo sapiens
ggcgcgccagtcctctcgtgactagccacgaggacgagaagaagggagccggaggagctggtcgctgtcggctaagcaagattggagctatcttggtcggtatcccagctcgcgtaagggtggctgtgcgactgcggccatttgtggatggaacagcgggagcaagtgatcccccctgtgtgcggggccgactcggaccgatg

SEQ ID NO: 13532 - DNA, 203 bp, Homo sapiens
ggcgcgccagtcctgtaactgctagccacgaggacgagaagaagggaggttccccttgcaaccgctgtcggctaagcaagattggagctactcgtcgtccacctccagctcgcgtaagggtggctgtgcgactgcggccatttgtggatggaacagcgggagcaagtgatcccccctgtgtgcggggccgactcggaccgatg

SEQ ID NO: 13533 - DNA, 203 bp, Homo sapiens
ggcgcgccagtccttatataggtagccacgaggagcgatcaggccttaccggaggagctggtcgctgtcggctaagcaagattggagctactcgtcgtccacctccagctcgcgtaagggtggctgtgcgactgcggccatttgtggatggaacagcgggagcaagtgatcccccctgtgtgcggggccgactcggaccgatg

SEQ ID NO: 13534 - DNA, 203 bp, Homo sapiens
ggcgcgccagtcctccgtaagatagcctccccctggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaaccgactcggaccgatg

SEQ ID NO: 13535 - DNA, 203 bp, Homo sapiens
ggcgcgccagtcctggttgacctagcgcaggagaaggctatctcggtccccagagaagcctgcgataggtgagtttctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 13536 - DNA, 203 bp, Homo sapiens
ggcgcgccagtcctcaactgactagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 13537 - DNA, 203 bp, Homo sapiens
ggcgcgccagtcctggaaagtgtagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctgattgatgttttgacgactcggaccgatg

SEQ ID NO: 13538 - DNA, 203 bp, Homo sapiens
ggcgcgccagtcctccacaccatagcgcaggagaaggctatctcggtcgatgtttggattccgacccacacgcgggctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 13539 - DNA, 203 bp, Homo sapiens
ggcgcgccagtcctactcgctctagcgcaggagattatgtgggtccgacccagagaagcctggacccacacgcgggctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 13540 - DNA, 203 bp, Homo sapiens
ggcgcgccagtcctgggcgatataggatctgtgggactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcacgactcggaccgatg

SEQ ID NO: 13541 - DNA, 203 bp, Homo sapiens
ggcgcgccagtcctggtatagctaggccacgtaggcccgtaagatattataactattttattatattttattcaccccccacattaatcccagttaaagctttataactataagtaagccgtgccgaaacgttaatcggtcgctagacctaatcgccgccttagtttaattttccaaaatttatttttcgactcggaccgatg

SEQ ID NO: 13542 - DNA, 203 bp, Homo sapiens
ggcgcgccagtcctctcaattataggctacgggtaggggacgcgcatataatacttctatgaagagatgccttggatagggtaacagcggcggatattggtgagttgttaagacaaaaaccattcaacgccggaggactgactctcatccagtggatgcattgagtggattgactgtcagggctgtctcgactcggaccgatg

SEQ ID NO: 13543 - DNA, 203 bp, Homo sapiens
ggcgcgccagtccttacgcccttaggttataatgttaggactataaaaattagcttaatgcatttagtaatttaaggcttagttatttaactttacttatcaagatggccgttggcagccccacgaaatctagattagtccgaatgtcctattttgattacccttcggcggcactcagaaactcacctcgactcggaccgatg

SEQ ID NO: 13544 - DNA, 203 bp, Homo sapiens
ggcgcgccagtcctgtggcttatagtgtgtattacaataattaaactaattaagctttgtttcacttgccatatgttttgtaatagaacaccactcattgaacgtaaaaatgtgtaccacatttaccaatcatatatgcacatagaccctttccctaaacgagttattgatttctaaactaaacgacacgactcggaccgatg

SEQ ID NO: 13545 - DNA, 203 bp, Homo sapiens
ggcgcgccagtcctcaattgtgtagttgaacgaatgggctccctatccggacaggtggctcttgccctttagactacagttcccagcatgcccaggcgattgcgtcccagaaccgacgtcccaccgccttcccacatcggatcgcagggctcccaaaatggcctataacattcacgtgaatggagtcccgactcggaccgatg

SEQ ID NO: 13546 - DNA, 203 bp, Homo sapiens
ggcgcgccagtccttcgtgcggtataagatacacctgcaaaggcggcacaaccccagtgccacgttgtgagttggatagttgtggaaagaccgccgatcggacgctcaagcgtattcaacaaggggctgaaggatgcccagaaggtaccccattgtatgggatctgatctggggcctcggtgcacatgcgactcggaccgatg

SEQ ID NO: 13547 - DNA, 203 bp, Homo sapiens
ggcgcgccagtccttgcgttagtataagatacacctgcaaaggcggcacaaccccagtgccacgttgtgagttggatagttgtggaaagagtcaaatggctctcctcaagcgtattcaacaaggggctgaagcgcctggtcccaaaaccccattgtatgggatctgatctggggcctcggtgcacatgcgactcggaccgatg

SEQ ID NO: 13548 - DNA, 203 bp, Homo sapiens
ggcgcgccagtcctcgaggtattataagatacacctgcaaaggcggcacaaccccagtgccacgttgtgagttggatagttgtggaaagagtcaaatggctctcctcaagcgtattcaacaaggggctgaaggatgcccagaaggtaccccattgtatggctatattcgccatccctcggtgcacatgcgactcggaccgatg

SEQ ID NO: 13549 - DNA, 203 bp, Homo sapiens
ggcgcgccagtccttccttcagtataagatacacctgcaaaggcggcacaaccccagtgccacgttgtgagttggatagttgtggaaagagtcaaatggctctcctcaagcgtattcaacaaggggctgaaggatgcccagaaggttaaaaccgcagcaagatctgatctggggcctcggtgcacatgcgactcggaccgatg

SEQ ID NO: 13550 - DNA, 203 bp, Homo sapiens
ggcgcgccagtcctcctcaaactataagatacacctgcaaaggcggcacaaccccagtgccagacatcacaggttttagttgtggaaagagtcaaatggctctcctcaagcgtattcaacaaggggctgaaggatgcccagaaggtaccccattgtatgggatctgatctggggcctcggtgcacatgcgactcggaccgatg

SEQ ID NO: 13551 - DNA, 203 bp, Homo sapiens
ggcgcgccagtccttccaattttataagatacactccatgctcgctttcaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgcgactcggaccgatg

SEQ ID NO: 13552 - DNA, 203 bp, Homo sapiens
ggcgcgccagtccttctcctgatatacaattttgagaggttaataagaaggaagtagtgctatcttaataattaggttaactatttagttttactgttcaggatgcctattggcagccagccgtcgctatatacaccctctctgcttcttatatgattaggttgtcatttagaataagaaaataacctcgactcggaccgatg

SEQ ID NO: 13553 - DNA, 203 bp, Homo sapiens
ggcgcgccagtcctacattatttatactggctgcttatggtgacaattgagagattgttaccatatagctattggattggccatccggtgaccaatagagctattatatatctctttgttgggtttataccacttagcttgaaagaggttaaaacattactcaagtccccactattgaatacagcaaacgactcggaccgatg

SEQ ID NO: 13554 - DNA, 203 bp, Homo sapiens
ggcgcgccagtcctagaagccgtatactggctgcttatggtgacaattgagagattgttaccatatagctattggattggccatccggtgctggcatctcggcctatatatctctttgttgggtttataccacttagcttgaaagaggttaaaacattacaattcattgttaagttgaatacagcaaacgactcggaccgatg

SEQ ID NO: 13555 - DNA, 203 bp, Homo sapiens
ggcgcgccagtcctgtactttgtatactggctgcttatggtgacaattgagagattgttacccctcgaactcctctttggccatccggtgaccaatagagctattatatatctctttgttgggtttataccacttagcttgaaagaggttaaaacattacaattcattgttaagttgaatacagcaaacgactcggaccgatg

SEQ ID NO: 13556 - DNA, 203 bp, Homo sapiens
ggcgcgccagtcctgaacctggtatagttaaggttgcgcttgcctattgttatgcgacatcgaggatggcgcgttgcagtccaacaagatccagggactgtacagaattttcctatacctcgagtcgggtttggaatctaaggttgactcgctgtaaataatgtaaatatgaaacaaatgaatgtaaacgactcggaccgatg

SEQ ID NO: 13557 - DNA, 203 bp, Homo sapiens
ggcgcgccagtcctgcagcctgtatagttaaggttgcgcttgcctatttaggcatacttctcaggatggcgcgttgcagtccaacaagatccagggactgtacagaattttcctatacctcgagtcgggtttccgtatatgctcaaactcgctgtaaataatgtaaatatgaaacaaatgaatgtaaacgactcggaccgatg

SEQ ID NO: 13558 - DNA, 203 bp, Homo sapiens
ggcgcgccagtcctgtgatctctatagttaaggttgcgcttgcctatttaggcatacttctcaggatggcgcgttgcagtccaacaagatccagggactgtacagaattttcctatacctcgagtcgggtttggaatctaaggttgactcgctgtaaataatgtaaatatgaaatgctaattctacggcgactcggaccgatg

SEQ ID NO: 13559 - DNA, 203 bp, Homo sapiens
ggcgcgccagtcctaaacatactatcagcggatgttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcacccgactcggaccgatg

SEQ ID NO: 13560 - DNA, 203 bp, Homo sapiens
ggcgcgccagtcctgcgtgtaatatcgaaggctccggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttacgagtctccattgcccgactcggaccgatg

SEQ ID NO: 13561 - DNA, 203 bp, Homo sapiens
ggcgcgccagtccttttatcattatctggtcggtcatctctgtaacctaagcgtgtgatgtcaattggtctttaaaactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 13562 - DNA, 203 bp, Homo sapiens
ggcgcgccagtccttcagaagatatctggtcggtcatctctgtaacctccctaccaaggactaattggtctttaaaactcctcaatgcaccgggcgcggtggctcacgcctgtaatcccagcactttgggaggccgaggcgggcagatcacgaggtcaggttcagcgccatcggttggctaacaagaacgactcggaccgatg

SEQ ID NO: 13563 - DNA, 203 bp, Homo sapiens
ggcgcgccagtcctctgtgggctatctggtcggtcatctctgtaacctccctaccaaggactaattggtctttaaaactcctcaatgcaccgggcgcggtggctcacgcctgtaatcccagcactttgggagtgttcatgaattccatcacgaggtcaggaaatcgagaccatcttggctaacaagaacgactcggaccgatg

SEQ ID NO: 13564 - DNA, 203 bp, Homo sapiens
ggcgcgccagtcctgcagattctatctggtcggtcatctctgtaacctccctaccaaggactttacatataagttgactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 13565 - DNA, 203 bp, Homo sapiens
ggcgcgccagtcctatggacgctatctggtcggtgtggataccttgacccctaccaaggactaattggtctttaaaactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 13566 - DNA, 203 bp, Homo sapiens
ggcgcgccagtcctgtttccaatatgctaaggggactcgtctccacctcgtaaaggaaactccccaagggaatccctgtcccctattttcaatgtaccagcaaattccaagacagtcctagcctatagaactcctacctcccatcccctgaggtggtccccattcctccctcccttcctccccccgcccgactcggaccgatg

SEQ ID NO: 13567 - DNA, 203 bp, Homo sapiens
ggcgcgccagtccttgcgtatctatgctaaggggactcgtctccacctcgtaaaggaaactccccaagggaatccctgtcccctattttcctatccttctacccgaagttagtttgattagcctatagaactcctacctcccatcccctgaggtggtccccattcctccctcccttcctccccccgcccgactcggaccgatg

SEQ ID NO: 13568 - DNA, 203 bp, Homo sapiens
ggcgcgccagtcctttgctttatatgctaaggggactcgtctccacctcgtaaaggaaactccccaagggaatccctgtcccctattttcctatccttctacccttccaagacagtccatataacgccttagcctacctcccatcccctgaggtggtccccattcctccctcccttcctccccccgcccgactcggaccgatg

SEQ ID NO: 13569 - DNA, 203 bp, Homo sapiens
ggcgcgccagtccttactaccatatgctaaggggactcgtctccacctcgtaaaggaaactccccaagggaatccctgtcccctattttcctatccttctacccttccaagacagtcctagcctatagaactcctacctcccatcccctgaggtggtcccaggcttgattgtgattcctccccccgcccgactcggaccgatg

SEQ ID NO: 13570 - DNA, 203 bp, Homo sapiens
ggcgcgccagtcctgattagattatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccagatgggtagtcatcgactcggaccgatg

SEQ ID NO: 13571 - DNA, 203 bp, Homo sapiens
ggcgcgccagtccttcttactttatgctaaggggactcgtctccaccttaatgcattgttatcccaagggaatccctgtcccctattttcctatccttctacccttccaagacagtcctagcctatagaactcctacctcccatcccctgaggtggtccccattcctccctcccttcctccccccgcccgactcggaccgatg

SEQ ID NO: 13572 - DNA, 203 bp, Homo sapiens
ggcgcgccagtcctgacatatttatgtatgtatgacgcaggtcccggcatacacatatacacatattggtttttttaatcatttgagagttagttgaagataaaaacccatcacccctaaatgtattccaaagaataagaacattgttttatacatagcacacttaacaaaatcaagaaatttaacatcgactcggaccgatg

SEQ ID NO: 13573 - DNA, 203 bp, Homo sapiens
ggcgcgccagtcctagtctacatatgtatgtatgtatgtatatgtattatacacatatacacatattggtttttttaatcatttgagagttagttgaagataaaaacccatcaccccttgcatagaatttcggaataagaacattgttttatacatagcacacttaacaaaatcaagaaatttaacatcgactcggaccgatg

SEQ ID NO: 13574 - DNA, 203 bp, Homo sapiens
ggcgcgccagtcctataaagtttatgtatgtatgtatgtatatgtattcacacttagccacgatattggtttttttaatcatttgagagttagttgaagataaaaacccatcacccctaaatgtattccaaagaataagaacattgttttatacatagcacacttaacaaaatcaagaaatttaacatcgactcggaccgatg

SEQ ID NO: 13575 - DNA, 203 bp, Homo sapiens
ggcgcgccagtcctaaggagcgtatgtgaggggactgtttcctcttctttagcttcttccaccagaagggcctccaggattttgacactctgctcctgagtggtgatggaaatactctctacgtgggggctcgagaagccattctggccttggatatccaggatccaggggtccccaggctaaagaaccgactcggaccgatg

SEQ ID NO: 13576 - DNA, 203 bp, Homo sapiens
ggcgcgccagtcctggacccattatgtgaggggatgaacgtagggcaccctttcaaggtaggcagaagggcctccaggattttgacactctgctcctgagtggtgatggaaatactctctacgtgggggctcgagaagccattctggccttggatatccaggatccaggggtccccaggctaaagaaccgactcggaccgatg

SEQ ID NO: 13577 - DNA, 203 bp, Homo sapiens
ggcgcgccagtcctgaccactctatgtgaggggatgaacgtagggcacttagcttcttccaccagaagggcctccaggattttgacactctgctcctgagtggtagcaacgcctggtcctacgtgggggctcgagaagccattctggccttggatatccaggatccaggggtccccaggctaaagaaccgactcggaccgatg

SEQ ID NO: 13578 - DNA, 203 bp, Homo sapiens
ggcgcgccagtcctgtcattcttatgtgaggggatgaacgtagggcacttagcttcttccaccagaagggcctccaggattttgacactctgctcctgagtggtgatggaaatactctctacgtgggggctcactcgaatgcggcagccttggatatccaggatccaggggtccccaggctaaagaaccgactcggaccgatg

SEQ ID NO: 13579 - DNA, 203 bp, Homo sapiens
ggcgcgccagtccttgcaggactatgtgaggggatgaacgtagggcacttagcttcttccacgcttctaaagatgtggattttgacactctgctcctgagtggtgatggaaatactctctacgtgggggctcgagaagccattctggccttggatatccaggatccaggggtccccaggctaaagaaccgactcggaccgatg

SEQ ID NO: 13580 - DNA, 203 bp, Homo sapiens
ggcgcgccagtcctatccactatatgttgaatgaggtgtatcaaactaaggagaccttctaacagccaggtcataggaatataaataaaaataagaataaaattgattccatcggaagattcatttcaagaagtgatcaaatcaaagcggttggcagacctaccaatcatataccacaagactcgacacgactcggaccgatg

SEQ ID NO: 13581 - DNA, 203 bp, Homo sapiens
ggcgcgccagtcctggaatcaatatgttgaatgaggtgtatcaaactatttgagaaggagcccagccaggtcataggaatataaataaaaataagaataaaattgattccatcggaagattcatttcaagaagtgatcaaatcaaagcggttggcagacctaccaatcatataccacaagactcgacacgactcggaccgatg

SEQ ID NO: 13582 - DNA, 203 bp, Homo sapiens
ggcgcgccagtcctaacgcggctattcatttgatgggtaaatattttagggccgattctttggttttatagccaagataccctgttgataaagtcttgtgggaggggcggattttaaagcttattttgaagctttttaaaaaagacatccttacctgttttaactgtagattatattaacttaaatagcgactcggaccgatg

SEQ ID NO: 13583 - DNA, 203 bp, Homo sapiens
ggcgcgccagtccttctatgcttattcgatttggcagcgagcctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagacgactcggaccgatg

SEQ ID NO: 13584 - DNA, 203 bp, Homo sapiens
ggcgcgccagtccttggagtagtattggctgcttatggtgacaatcaaaaagttgttaccatatagctattggattggccatccggtgtgcaacagggcaattgtttacctatttattggttttgtaccattatcactgaagtctgtgatcactctcaaattcattttgaccctcaacacaatcaaaccgactcggaccgatg

SEQ ID NO: 13585 - DNA, 203 bp, Homo sapiens
ggcgcgccagtccttttacgactattggctgcttatggtgacaatcaaaaagttgttaccatatagctattggattggccatccggtgtgcaacagggcaattgtttacctatttattggttttgtaccattgaagggtctaggattgatcactctcaaattcattttgaccctcaacacaatcaaaccgactcggaccgatg

SEQ ID NO: 13586 - DNA, 203 bp, Homo sapiens
ggcgcgccagtcctgtcgtcaatattggctgcttatggtgacaatcaaaaagttgttaccatcctagagacatgggggccatccggtgtgcaacagggcaattgtttacctatttattggttttgtaccattatcactgaagtctgtgatcactctcaaattcattttgaccctcaacacaatcaaaccgactcggaccgatg

SEQ ID NO: 13587 - DNA, 203 bp, Homo sapiens
ggcgcgccagtccttttgtccctattggctgcttatggtgacaatcaattctagcggcaacaatagctattggattggccatccggtgtgcaacagggcaattgtttacctatttattggttttgtaccattatcactgaagtctgtgatcactctcaaattcattttgaccctcaacacaatcaaaccgactcggaccgatg

SEQ ID NO: 13588 - DNA, 203 bp, Homo sapiens
ggcgcgccagtcctatacgtcttatttctcaactaacgacttgtacgttgctcttagaggactagcaaccgttatactcagcctttctagaaaggttgagttatataacggtgaatgtgtatacttgttttgtgaacacccagctgttggaatagtcaacacagatttcaaattagaaatccactaagcgactcggaccgatg

SEQ ID NO: 13589 - DNA, 203 bp, Homo sapiens
ggcgcgccagtccttaaggaactcaacaacatcaataaaacagacatcaatccattgaatcaactgccagaccgaacaaacaaatgtccgtcagcggaaccaccaaccaatcaatcaaccaactgatccatcagcaacctgacgaaattaacaatatagtccatgttgtcctgaaagatggggcaaatcgactcggaccgatg

SEQ ID NO: 13590 - DNA, 203 bp, Homo sapiens
ggcgcgccagtccttggcattctcaagccctccggtagagaagccaagaatgtcctgaaggtaccccgcgcgcgggatctgatcaggagaccaattggcagtgctttacgctgccactttggtttaaaaactagtgacttcctaggaaaccaagtggtcttggttttccaattttgttgactgacaatcgactcggaccgatg

SEQ ID NO: 13591 - DNA, 203 bp, Homo sapiens
ggcgcgccagtcctactctgtttcaagccctccggtagagaagccaagaatgtcctgaaggtaccccgcgcgcgggatctgatcaggagaccaattggcagtgctttacgctgccactttggtttaaaaactgtcacagcttctccaaaccaagtggtcttggttttccaatttgaggcggaacagcgcgactcggaccgatg

SEQ ID NO: 13592 - DNA, 203 bp, Homo sapiens
ggcgcgccagtcctcccaccgatcaagccctccggtagagaagccaagaatgtcctgaaggtaccccgcgcgcgggatctgatcaggagaccaattggcagtgctttacgctgccactttggtttaaaaactgtcacagcttctccaaaccaagtggtcttggttttccaattttgttgactgacaatcgactcggaccgatg

SEQ ID NO: 13593 - DNA, 203 bp, Homo sapiens
ggcgcgccagtcctctcttctatcaagccctccggtagagaagccaagaatgtcctgaaggtaccccgcgcgcgggatctgatcaggagaccaattggcagtgctttacgctgccactttggtttaaaaactgtcacagcttctccttcagcgagatggctggttttccaattttgttgactgacaatcgactcggaccgatg

SEQ ID NO: 13594 - DNA, 203 bp, Homo sapiens
ggcgcgccagtcctagacaatatcaagccctccggtagagaagccaagaatgtcctgaaggtaccccgcgcgcggggctccgcagtattcccaattggcagtgctttacgctgccactttggtttaaaaactgtcacagcttctccaaaccaagtggtcttggttttccaattttgttgactgacaatcgactcggaccgatg

SEQ ID NO: 13595 - DNA, 203 bp, Homo sapiens
ggcgcgccagtcctgagcattgtcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagcccgactcggaccgatg

SEQ ID NO: 13596 - DNA, 203 bp, Homo sapiens
ggcgcgccagtcctggcacggatcaatgacctgttttcttctgtaaccacaggttcggtggtgagaggaagcctcgcagaatccagcagaatcctcacagaatccagcagcagctctgctggggacatggtccatggtgcaacccatctggtgcataccgcctgacctcctgatgctcaggagaagcccgactcggaccgatg

SEQ ID NO: 13597 - DNA, 203 bp, Homo sapiens
ggcgcgccagtcctactggttttcaatgacctgttttcttctgtaaccacaggttcggtggtgagaggaagcctcgcagaatccagcagaatcctcacagaatccagcagcagctctgctggggacatggtctcgtacaaggaagtcagcaaagccctgacctgacctcctgatgctcaggagaagcccgactcggaccgatg

SEQ ID NO: 13598 - DNA, 203 bp, Homo sapiens
ggcgcgccagtccttgtaagagtcaatgacctgttttcttctgtaaccacaggttcggtggtgagaggaagcctcgcagaatccagcagacgttgtcgttcgaacagcagcagctctgctggggacatggtccatggtgcaacccacagcaaagccctgacctgacctcctgatgctcaggagaagcccgactcggaccgatg

SEQ ID NO: 13599 - DNA, 203 bp, Homo sapiens
ggcgcgccagtccttaaacgcgtcacatcaccagtgtatcctcagctcctaacactgtgtctggtacacattgtttgatggttttgatgtttcagattcgttatatttcacaaacacaaggcttgccagctgaatatcttctcagtgccggaacaaaaaccttggtagcccgatacagagatcctaatcgactcggaccgatg

SEQ ID NO: 13600 - DNA, 203 bp, Homo sapiens
ggcgcgccagtcctgtcctggctcacatcaccagtgtatcctcagctctcctacgccaacacggtacacattgtttgatggttttgatgtttcagattcgttatatttcacaaacacaaggcttgccagctgaatatcttctcagtgccggaacaaaaacaaccaggtttttcaacagagatcctaatcgactcggaccgatg

SEQ ID NO: 13601 - DNA, 203 bp, Homo sapiens
ggcgcgccagtcctgccaagattcaccagagcggaacaagaaagagaacggccaccggggtcggctgggacagactgcgggcacgtccccttccagaggctttaactgaaaaatagaacccaggaaggtgtggacactgccagcggctgcagccgacttggaatgacctgggagacaaatacaacagccgactcggaccgatg

SEQ ID NO: 13602 - DNA, 203 bp, Homo sapiens
ggcgcgccagtccttccaaacgtcactcccagactccttgcggagctcaaaatacctacgacggctggtcactactccgagcctgtgacgtttgcggcagccaggccgtcgacgatgcccagtgaaactctctgggaaattgcaaaagctgaagtggaaaaaaggggaattaatggaagtgaaggtgacgactcggaccgatg

SEQ ID NO: 13603 - DNA, 203 bp, Homo sapiens
ggcgcgccagtcctagtagttctcactcccagactccttgcggagctcgccgcctgattctaggctggtcactactagatattcaccgactttgcggcagccaggccgtcgacgatgcccagtgaaactctctgggaaattgcaaaagctgaagtggaaaaaaggggaattaatggaagtgaaggtgacgactcggaccgatg

SEQ ID NO: 13604 - DNA, 203 bp, Homo sapiens
ggcgcgccagtcctgttacaattcactcccagactccttgcggagctcgccgcctgattctaggctggtcactactccgagcctgtgacggccaataaccagccgccgtcgacgatgcccagtgaaactctctgggaaattgcaaaagctgaagtggaaaaaaggggaattaatggaagtgaaggtgacgactcggaccgatg

SEQ ID NO: 13605 - DNA, 203 bp, Homo sapiens
ggcgcgccagtcctggccacggtcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgacgactcggaccgatg

SEQ ID NO: 13606 - DNA, 203 bp, Homo sapiens
ggcgcgccagtcctgggcatcatcactcccagactccttgcggagctcgccgcctgattctaggctggtcactactccgagcctgtgacgtttgcggcagccaggccgtcgacgatgcccagtgaaactctctgggaaattgcaaatcacagccatatctaaaggggaattaatggaagtgaaggtgacgactcggaccgatg

SEQ ID NO: 13607 - DNA, 203 bp, Homo sapiens
ggcgcgccagtccttaagtctatcactctcataatcctcttacagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaacccgactcggaccgatg

SEQ ID NO: 13608 - DNA, 203 bp, Homo sapiens
ggcgcgccagtcctcacggatgtcactgctatagagaaatttgcttaagacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaacgactcggaccgatg

SEQ ID NO: 13609 - DNA, 203 bp, Homo sapiens
ggcgcgccagtccttaaagtaatcactgctatagtacgcgggtggctgactggcagataagactgctgtggctgtctcggaacccgtggtcctccgcttcatgattttctgccgtctcttggcaaaaatggcaaataatgatgctgttctgaagagactggagcagaagggtgcagaggcagatcaaacgactcggaccgatg

SEQ ID NO: 13610 - DNA, 203 bp, Homo sapiens
ggcgcgccagtccttgcaccggtcactgctatagtacgcgggtggctggacctacatgcttcctgctgtggctgtctcggaacccgtggtcctccgcttcatgacagcggcgtcaaatttggcaaaaatggcaaataatgatgctgttctgaagagactggagcagaagggtgcagaggcagatcaaacgactcggaccgatg

SEQ ID NO: 13611 - DNA, 203 bp, Homo sapiens
ggcgcgccagtcctacttgggttcactgctatagtacgcgggtggctggacctacatgcttcctgctgtggctgtctcggaacccgtggtcctccgcttcatgattttctgccgtctccatcagttgccactaaataatgatgctgttctgaagagactggagcagaagggtgcagaggcagatcaaacgactcggaccgatg

SEQ ID NO: 13612 - DNA, 203 bp, Homo sapiens
ggcgcgccagtccttcaccgcttcactgctatagtacgcgggtggctggacctacatgcttcctgctgtggctgtctcggaacccgtggtcctccgcttcatgattttctgccgtctcttggcaaaaatggctcggcgatgacgccttctgaagagactggagcagaagggtgcagaggcagatcaaacgactcggaccgatg

SEQ ID NO: 13613 - DNA, 203 bp, Homo sapiens
ggcgcgccagtcctcaaagcactcactgctatagtacgcgggtggctggacctacatgcttctcatgcaacacccatcggaacccgtggtcctccgcttcatgattttctgccgtctcttggcaaaaatggcaaataatgatgctgttctgaagagactggagcagaagggtgcagaggcagatcaaacgactcggaccgatg

SEQ ID NO: 13614 - DNA, 203 bp, Homo sapiens
ggcgcgccagtcctacttatactcacttctaactgcgataaatgctgacgtgaaaacgttgcgtattgctacaacacttggttagctatttagctttactaatcaagacgccgtcgtgcagcccacaaaagtctagatacgtcacaggagagcatacgctaggtcgcgttgactatccttatatatgacgactcggaccgatg

SEQ ID NO: 13615 - DNA, 203 bp, Homo sapiens
ggcgcgccagtcctggattatctcagccgcccgagggcgctgcgctgagccttacactctatgattgctcctaccgactcccatgaggaagtgcgatcgggaacctcctatatacttccgtttgcctcgcggtttctttctttccgcgccgatagcgctcacgcaagcatggttggatcgatagtcttcgactcggaccgatg

SEQ ID NO: 13616 - DNA, 203 bp, Homo sapiens
ggcgcgccagtcctatcatccgtcagccgcccgagggcgctgcgctgagccttacactctatgattgctcctaccgactcccatgaggaagtgcgatcgggaacctcctatatacttccgtttgcctcgcggtttctttctttccgtttatcggcattgaacgcaagcatggttaacgtccctaaaaccgactcggaccgatg

SEQ ID NO: 13617 - DNA, 203 bp, Homo sapiens
ggcgcgccagtccttcaggacgtcagccgcccgagggcgctgcgctgagccttacactctatgattgctcctaccgactcccatgaggaagtgcgatcgggaacctcctatatacttcttccgtggcgcatttttctttctttccgcgccgatagcgctcacgcaagcatggttaacgtccctaaaaccgactcggaccgatg

SEQ ID NO: 13618 - DNA, 203 bp, Homo sapiens
ggcgcgccagtcctgataatcatcagccgcccgagggcgctgcgctgagccttacactctattgcattctactttcactcccatgaggaagtgcgatcgggaacctcctatatacttccgtttgcctcgcggtttctttctttccgcgccgatagcgctcacgcaagcatggttaacgtccctaaaaccgactcggaccgatg

SEQ ID NO: 13619 - DNA, 203 bp, Homo sapiens
ggcgcgccagtccttcccataatcagccggcgccgcgaatgttcaagttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccgactcggaccgatg

SEQ ID NO: 13620 - DNA, 203 bp, Homo sapiens
ggcgcgccagtccttagagcgctcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccgactcggaccgatg

SEQ ID NO: 13621 - DNA, 203 bp, Homo sapiens
ggcgcgccagtcctcagtattttcagccggcgccgcgccgccgggtgttactttgccccgcctctaacctaacacccctcctgtcaccgcctgttccggctatggtcccgtccggtgttctgtaagttggcaacctaggctcctgacgcgaccctggtcctgatggcggcggcgacggccgcggcagccgactcggaccgatg

SEQ ID NO: 13622 - DNA, 203 bp, Homo sapiens
ggcgcgccagtccttatactgttcagcgagcgcagcctgcacgcccgcctcgcgtcccgggggggtcccgcctcccaccccgcctctggacttgtctctttccccgcgcgcgcggacagagccggcgtttaggcccgagcgagcccaatttttctacctggggaagacaacgcgggcaccgattcgcccgactcggaccgatg

SEQ ID NO: 13623 - DNA, 203 bp, Homo sapiens
ggcgcgccagtcctaagagacatcagcgagcgcagcctgcacgcccgcctcgcgtcccgggggggtcccgcctcccaccccgcctctggacttgtctctttccccgcgcgcgcggacagagccggcgtttaggcccgagcgagcccgggggccgccggccgggaagacaacgcgtagtttagagacgtcgactcggaccgatg

SEQ ID NO: 13624 - DNA, 203 bp, Homo sapiens
ggcgcgccagtcctgtacggcctcagcgagcgcagcctgcacgcccgcctcgcgtcccgggggggtcccgcctcccaccccgcctctggacttgtctctttccccgcgcgcgcggacagagccggcgtttagtaggcctgctctatgggggccgccggccgggaagacaacgcgggcaccgattcgcccgactcggaccgatg

SEQ ID NO: 13625 - DNA, 203 bp, Homo sapiens
ggcgcgccagtcctaattcgtttcagcgagcgcagcctgcacgcccgcctcgcgtcccgggggggtcccgcctcccttagatttgactcgcttgtctctttccccgcgcgcgcggacagagccggcgtttaggcccgagcgagcccgggggccgccggccgggaagacaacgcgggcaccgattcgcccgactcggaccgatg

SEQ ID NO: 13626 - DNA, 203 bp, Homo sapiens
ggcgcgccagtcctagggcttttcaggccccctccgcctccacccctgccctcctcaggccccctccgcctccacccctgccctcctcaggccccctgcgtcccaaggcttcggagtccaggccccctccgcctccggctccgtcctcctctggccccctccgcccccggccccggccccacggcgggcgactcggaccgatg

SEQ ID NO: 13627 - DNA, 203 bp, Homo sapiens
ggcgcgccagtcctagtattaatcaggccccctccgcctccacccctgccctcctcaggccccctccgcctccacccctgccctcctcaggccccctgcgtccccgcctcgtcctcctcaggccccctccgcctccggctccgtccgggcggtattgggcccgcccccggccccggccccacggcgggcgactcggaccgatg

SEQ ID NO: 13628 - DNA, 203 bp, Homo sapiens
ggcgcgccagtcctaaagcacttcaggccccctccgcctccacccctgccctcctcaggccccctccgcctccacccctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13629 - DNA, 203 bp, Homo sapiens
ggcgcgccagtcctctatagcctcaggccccctccgcctccacccctgccctcctcaggccccctccgcctccacccctgccctcctcaggccccctgcgtccccgcctcgtcctcctcaggccccctccgcctccggctccgtcctcctctggccccctccgcccccggccccttgttggtaagaatcgactcggaccgatg

SEQ ID NO: 13630 - DNA, 203 bp, Homo sapiens
ggcgcgccagtcctaggaacggtcaggccccctccgcctccacccctgccctcctcaggcccgagtttgaatactgcctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13631 - DNA, 203 bp, Homo sapiens
ggcgcgccagtcctgggagccatcaggccccctccgcctccacccctggatcgtgtgactatcctccgcctccacccctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13632 - DNA, 203 bp, Homo sapiens
ggcgcgccagtcctagtttggctcaggccccctctttacggtaaaaccccctcctcaggccccctccgcctccacccctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13633 - DNA, 203 bp, Homo sapiens
ggcgcgccagtcctaccggtgctcaggcggaaggagcagtcctctgaagcttgaggagcctctagaactatgagcccgaggccttcccctctcccagagcgcagaggctttgaaggctacctctgggaagccaaaacgaccgcttggctgcgggagctgaaactgcgccatcgtcactgtcggcggcccgactcggaccgatg

SEQ ID NO: 13634 - DNA, 203 bp, Homo sapiens
ggcgcgccagtcctttagccgatcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtactccagcatttggcgactcggaccgatg

SEQ ID NO: 13635 - DNA, 203 bp, Homo sapiens
ggcgcgccagtcctcctgggtctcaggcggaaggagcagtcctctgaagcttgaggagcctctagaactatgagcccgaggccttcccctctcccagagcgcagaggctttgaaggctacctctgggaagccgctcaccgtcggaattcaaccattgctcaactgcgccatcgtcactgtcggcggcccgactcggaccgatg

SEQ ID NO: 13636 - DNA, 203 bp, Homo sapiens
ggcgcgccagtcctgggctccctcaggcggaaggagcagtcctctgaagcttgaggagcctctagaactatgagcccgaggccttcccctctcccagagcgcaggtcgagacggattgacctctgggaagccgctcaccgtcggaagctgcgggagctgaaactgcgccatcgtcactgtcggcggcccgactcggaccgatg

SEQ ID NO: 13637 - DNA, 203 bp, Homo sapiens
ggcgcgccagtcctgtgtttagtcatcgtgcgtcagagtgagcccggatggggcggcgggctaataatcgagggttgctgatccgagccgagcgggccgtatctccttgtcggcgccgctgattcccggctctgcggaggcctctaggcagccgcgcagcttccgtgtttgctgcgcccgcactgcgacgactcggaccgatg

SEQ ID NO: 13638 - DNA, 203 bp, Homo sapiens
ggcgcgccagtcctctcggccatcatcgtgcgtcagagtgagcccggatggggcggcgggcttcgggagcgcccgggctgatccgagccgagcgggccgtatctccttgtcggcgccgctgattcccggctcgtgtcgtatactgtggcagccgcgcagcttccgtgtttgctgcgcccgcactgcgacgactcggaccgatg

SEQ ID NO: 13639 - DNA, 203 bp, Homo sapiens
ggcgcgccagtcctgggtaaggtcatcgtgcgtcagagtgagcccggatggggcggcgggcttcgggagcgcccgggctgatccgagccgagcgggccgtatctccttgtcggcgccgctgattcccggctctgcggaggcctctactactgtaacatagttccgtgtttgctgcgcccgcactgcgacgactcggaccgatg

SEQ ID NO: 13640 - DNA, 203 bp, Homo sapiens
ggcgcgccagtcctatgagccctcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcagccaggtctgcaataacgcccgcactgcgacgactcggaccgatg

SEQ ID NO: 13641 - DNA, 203 bp, Homo sapiens
ggcgcgccagtcctcgtgtcattcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgacgactcggaccgatg

SEQ ID NO: 13642 - DNA, 203 bp, Homo sapiens
ggcgcgccagtccttccaccattcatcgtgcgtcagagtgagcccggatggggcggcgggcttcgggagcgcccgggctgatccgagccggcttatgtcctaagccttgtcggcgccgctgattcccggctctgcggaggcctctaggcagccgcgcagcttccgtgtttgctgcgcccgcactgcgacgactcggaccgatg

SEQ ID NO: 13643 - DNA, 203 bp, Homo sapiens
ggcgcgccagtccttgaccgaatcatgggttcggtggtggtggcgcttatcaatcgaaggcggcccaccacctcccagatagagcggcggcactgtagggaagaccggggaccggtcactaccaaggacgcagacctctttttgagtatcacgcctccggaagtagttgggcaagcccacctatatgtcgactcggaccgatg

SEQ ID NO: 13644 - DNA, 203 bp, Homo sapiens
ggcgcgccagtcctggaggcagtcatgggttcggtggtggtggcgctttaggcagcctccacgcccaccacctcccagatagagcggcggcactgtagggaagaccggggaccggtcactaccaaggacgcagacctctttttgagacgtggaggcgtacaagtagttgggcaagcccacctatatgtcgactcggaccgatg

SEQ ID NO: 13645 - DNA, 203 bp, Homo sapiens
ggcgcgccagtcctgcgtaatttcatgggttcggtggtggtggcgctttaggcagcctccacgcccaccacctcccagatagagcggcggcactgtagggaagattctactaaccgtgctaccaaggacgcagacctctttttgagtatcacgcctccggaagtagttgggcaagcccacctatatgtcgactcggaccgatg

SEQ ID NO: 13646 - DNA, 203 bp, Homo sapiens
ggcgcgccagtcctccgggccctcattcattcaacaaatacgaatgtgcagcggtgctggggtcatgatggctcggtgggcagcgaggggaaactttaatcaagggagcacagtgcggattctattctgaaagtcaagaagacatcatccggaatattgccaggcacctcgcccaggtcggggacagccgactcggaccgatg

SEQ ID NO: 13647 - DNA, 203 bp, Homo sapiens
ggcgcgccagtcctttcgtctgtcattcattcaacaaatacgaatgtgcagcggtgctggggtcatgatggctcggtgggcagcgaggggccgggccggctggaggagcacagtgcggattctattctgaaagtcaagaagacatcatccggaatattgccaggcacctcgccccatcttaacctcttcgactcggaccgatg

SEQ ID NO: 13648 - DNA, 203 bp, Homo sapiens
ggcgcgccagtccttatcatagtcattcattcaagcctactaggctaccagcggtgctggggtcatgatggctcggtgggcagcgaggggccgggccggctggaggagcacagtgcggattctattctgaaagtcaagaagacatcatccggaatattgccaggcacctcgcccaggtcggggacagccgactcggaccgatg

SEQ ID NO: 13649 - DNA, 203 bp, Homo sapiens
ggcgcgccagtcctgtgtgctatccacaggcctatgctgtgatatctggggctcctgctgctatagctggatttgcagctttactgcaaactgtgactggtgtgagcgctgttgctcaagtggggtatagatcaaccttatcggatgatcacaaagtttctactgttggtttatatcaacaaccaggacgactcggaccgatg

SEQ ID NO: 13650 - DNA, 203 bp, Homo sapiens
ggcgcgccagtcctacttaatgtccacaggcctatgctgtgatatctggggctcctgctgctatagctggatttgcagctttactgcaaactgtgactggtgtgagcgctgttgctcaagtggggtatagattttttagtgactgggatcacaaagtttctactgttggtttatcatccgtgtatccgcgactcggaccgatg

SEQ ID NO: 13651 - DNA, 203 bp, Homo sapiens
ggcgcgccagtcctgcatgtcgtccacaggcctatgctgtgatatctggggctcctgctgctccctaatccgactgagctttactgcaaactgtgactggtgtgagcgctgttgctcaagtggggtatagattttttagtgactgggatcacaaagtttctactgttggtttatatcaacaaccaggacgactcggaccgatg

SEQ ID NO: 13652 - DNA, 203 bp, Homo sapiens
ggcgcgccagtcctatctaacatccagacccacccctgggcggaactcctcggccaggtcctggagtcccgtaacacccttcccctggagccatgctgggccctagcccgggtccctcgccgggctccgcccacagcatgatggggcccagcccagggccgccctcagcaggacaccccatccccacccgactcggaccgatg

SEQ ID NO: 13653 - DNA, 203 bp, Homo sapiens
ggcgcgccagtcctttcgcgcgtccagacccacccctgggcggaactcctcggccaggtccttccccgggccctggcccttcccctggagccatgctgggccctagcccgggtccctcgccgggctccgcccacagcatgatggggaaggttatgtttttgccctcagcaggacaccccatccccacccgactcggaccgatg

SEQ ID NO: 13654 - DNA, 203 bp, Homo sapiens
ggcgcgccagtcctaactcctatccagacccacccctgggcggaactcctcggccaggtccttccccgggccctggcccttcccctggagccatgctgggccctagcccgggtccctcgccgggctccgcccacagcatgatggggcccagcccagggcctagacagcagtcgaaccccatccccacccgactcggaccgatg

SEQ ID NO: 13655 - DNA, 203 bp, Homo sapiens
ggcgcgccagtccttattaagttccagacccacccctgggcggaactcctcggccaggtccttccccgggccctggcccttcccctggagccatgctgggccctagcccgggtccctcttgtcaggggcgttacagcatgatggggcccagcccagggccgccctcagcaggacaccccatccccacccgactcggaccgatg

SEQ ID NO: 13656 - DNA, 203 bp, Homo sapiens
ggcgcgccagtcctcgataacgtccagacccacccctgggcggaactcctcggccaggtccttccccgggccctgggagacaagagacgtccatgctgggccctagcccgggtccctcgccgggctccgcccacagcatgatggggcccagcccagggccgccctcagcaggacaccccatccccacccgactcggaccgatg

SEQ ID NO: 13657 - DNA, 203 bp, Homo sapiens
ggcgcgccagtcctattggacctccatgatttttcatcatagtggaaagctgttctctgtgttaaaccaatcagttgcgaccttctcttaacagtgtgaagtgagggggtctctctccctccttctccttcctctgtgattcaccttcctttttaccctgccctgcggcggctccgccccttaccttccgactcggaccgatg

SEQ ID NO: 13658 - DNA, 203 bp, Homo sapiens
ggcgcgccagtcctaacattggtccatgattttttgaatctagactgggctgttctctgtgtagccgtcccatccggcgaccttctcttaacagtgtgaagtgagggggtctctctccctccttctccttcctctgtgattcaccttcctttttaccctgccctgcggcggctccgccccttaccttccgactcggaccgatg

SEQ ID NO: 13659 - DNA, 203 bp, Homo sapiens
ggcgcgccagtccttgttgtaatccatgattttttgaatctagactgggctgttctctgtgttaaaccaatcagttaattgtcaagtgacacagtgtgaagtgagggggtctctctccctccttctccttcctctgtgattcaccttcctttttaccctgccctgcggcggctccgccccttaccttccgactcggaccgatg

SEQ ID NO: 13660 - DNA, 203 bp, Homo sapiens
ggcgcgccagtcctggtttcggtccatgattttttgaatctagactgggctgttctctgtgttaaaccaatcagttgcgaccttctcttaacagtgtgaagtgaaatccggaaggaaactccttctccttcctctgtgattcaccttcctttttaccctgccctgcggcggctccgccccttaccttccgactcggaccgatg

SEQ ID NO: 13661 - DNA, 203 bp, Homo sapiens
ggcgcgccagtcctttattcggtccatgattttttgaatctagactgggctgttctctgtgttaaaccaatcagttgcgaccttctcttaacagtgtgaagtgagggggtctctctccctccttctccttccgagagaggcggaggtcctttttaccctgccctgcggcggctccgccccttaccttccgactcggaccgatg

SEQ ID NO: 13662 - DNA, 203 bp, Homo sapiens
ggcgcgccagtccttgttcgcatccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttccgactcggaccgatg

SEQ ID NO: 13663 - DNA, 203 bp, Homo sapiens
ggcgcgccagtccttcgagagatccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctctaatagcgcgggggcgactcggaccgatg

SEQ ID NO: 13664 - DNA, 203 bp, Homo sapiens
ggcgcgccagtcctgctacggttccatgattttttgaatctagactgggctgttctctgtgttaaaccaatcagttgcgaccttctcttaacagtgtgaagtgagggggtctctctccctccttctccttcctctgtgattcaccttcctttttaccctggggcaacttcataacgccccttaccttccgactcggaccgatg

SEQ ID NO: 13665 - DNA, 203 bp, Homo sapiens
ggcgcgccagtccttcattccttcccaactgctagtggctgagtccctggcggggcgcggcggtggaaggtgtcgcgtacgggcttcccgagctgacgtggcttcgcgacttgcttctgcagctggagcctcaggcggcagcgcttctagaaatgctgagccgattatcaggattagcaaatgttgttcgactcggaccgatg

SEQ ID NO: 13666 - DNA, 203 bp, Homo sapiens
ggcgcgccagtcctgtaaaccgtcccaactgctagtggctgagtccctggcggggcgcggcggtggaaggtgtcgcgtacgggcttcccgagctgacgtggcttgaattgggaggggggcagctggagcctcaggcggcagcgcttaggatccattgcttccgattatcaggattagcaaatgttgttcgactcggaccgatg

SEQ ID NO: 13667 - DNA, 203 bp, Homo sapiens
ggcgcgccagtcctcgttgctgtcccaactgctagtggctgagtccctggcggggcgcggcggtggaaggtgtcgcgtacgggcttcccgagctgacgtggcttgaattgggaggggggcagctggagcctcgctttcagcgtggcctagaaatgctgagccgattatcaggattagcaaatgttgttcgactcggaccgatg

SEQ ID NO: 13668 - DNA, 203 bp, Homo sapiens
ggcgcgccagtcctgagcggcatcccgtcggagtccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgcccgactcggaccgatg

SEQ ID NO: 13669 - DNA, 203 bp, Homo sapiens
ggcgcgccagtcctggcatgtctccctagagcagacagtcaattgtagagcctgcactctcagaaatcagacttgagtggccggaacccttgagaccagaggcttaccatgctgctccctaggagggccaggaactgctgacgtgaccactggacagttattcgtgtctcttacaattaccaaacagacgactcggaccgatg

SEQ ID NO: 13670 - DNA, 203 bp, Homo sapiens
ggcgcgccagtccttgcgagtatccctagagcaggggtgtttgccagcagcctgcactctcagaaatcagacttgagtggccggaacccttgagaccagaggctacattgaaatacagctaggagggccaggaactgctgacgtgaccactggacagttattcgtgtctcttacaattaccaaacagacgactcggaccgatg

SEQ ID NO: 13671 - DNA, 203 bp, Homo sapiens
ggcgcgccagtcctagtcatcttccctagcttgactctcaacaaaaagccaccgacattaagagagagagtattgctgcttagttaactgcaggccctatttagggttaccgcccaggatctgcaacagcattcctgtatcatccagggcaccggtggacttggtgaggattgagttgacctcatcatcgactcggaccgatg

SEQ ID NO: 13672 - DNA, 203 bp, Homo sapiens
ggcgcgccagtcctaaccagattccctctccttacctgcgtcctcgggggcgtgcgcaccaccccccctcccgcctaggaggggggagggccccctcttggccaatcgtcggctacgatttaaactcccctggagactgcggctactgccaccgccttgcctccactgcctcttcgcgcagcacacagcgactcggaccgatg

SEQ ID NO: 13673 - DNA, 203 bp, Homo sapiens
ggcgcgccagtcctattccttctccctctccttacctgcgtcctcgggggcgtgcgcaccaccccccctcccgcctaggaggggggagggccccctcttggccaccgccttcgcggcctttaaactcccctgctatactgttactatgccaccgccttgcctccactgcctcttcgcgcagcacacagcgactcggaccgatg

SEQ ID NO: 13674 - DNA, 203 bp, Homo sapiens
ggcgcgccagtcctgttgcctctccctctccttacctgcgtcctcgggggcgtgcgcaccaccccccctcccgcctaggaggggggagggccccctcttggccaccgccttcgcggcctttaaactcccctggagactgcggcagtaagtaccgccttgcctccactgcctcttcgcgcagcacacagcgactcggaccgatg

SEQ ID NO: 13675 - DNA, 203 bp, Homo sapiens
ggcgcgccagtcctatgcattttccctctccttacctgcgtcctcgggggcgtgcgcaccaccccccctcccgcctaggaggggggagggccccctcttggccaccgccttcgcggcctttatgaggggctggagactgcggcagtaagtaccgccttgcctccactgcctcttcgcgcagcacacagcgactcggaccgatg

SEQ ID NO: 13676 - DNA, 203 bp, Homo sapiens
ggcgcgccagtcctttcggcactccctctccttacctgcgtcctcgggggcgtgcgcaccaccccccctcccgcctaggaggggggagggccccctcttggccaccgccttcgcggcctttatgaggggctggagactgcggctactgccaccgccttgcctccactgcctcttcgcgcagcacacagcgactcggaccgatg

SEQ ID NO: 13677 - DNA, 203 bp, Homo sapiens
ggcgcgccagtcctcattctcatccctctccttacctgcgtcctcgggggcgtgcgcaccaccccccctcccgcctaggaggggggagggtaaagaaccatgacccgccttcgcggcctttaaactcccctggagactgcggctactgccaccgccttgcctccactgcctcttcgcgcagcacacagcgactcggaccgatg

SEQ ID NO: 13678 - DNA, 203 bp, Homo sapiens
ggcgcgccagtccttgtaattatccctctccttacctgcgtcctcgggggcgtgcgcaccaccccccctcccgccttcatctatactttcccccctcttggccaccgccttcgcggcctttaaactcccctggagactgcggctactgccaccgccttgcctccactgcctcttcgcgcagcacacagcgactcggaccgatg

SEQ ID NO: 13679 - DNA, 203 bp, Homo sapiens
ggcgcgccagtcctcacagttctccctctccttacctgcgtcctcgggggcgtgcgcaccacgattggagaataaaaggaggggggagggccccctcttggccaccgccttcgcggcctttaaactcccctggagactgcggctactgccaccgccttgcctccactgcctcttcgcgcagcacacagcgactcggaccgatg

SEQ ID NO: 13680 - DNA, 203 bp, Homo sapiens
ggcgcgccagtcctacatctgctccctctccttagggagacaagatcaggcgtgcgcaccaccccccctcccgcctaggaggggggagggccccctcttggccaccgccttcgcggcctttaaactcccctggagactgcggctactgccaccgccttgcctccactgcctcttcgcgcagcacacagcgactcggaccgatg

SEQ ID NO: 13681 - DNA, 203 bp, Homo sapiens
ggcgcgccagtcctatgcttggtcccttacacatatgattatgtagcgtgcttattagtagtagatacatctaaatgtacaggacttaggataagttttgattatataagataggatgtgaaggctccgatttgtgaataggtttttatattcgaagtaggtagtattgcgcatactattaattccaccgactcggaccgatg

SEQ ID NO: 13682 - DNA, 203 bp, Homo sapiens
ggcgcgccagtcctgggcgcgttcccttacacatatgattatgtagcgtgcttattagtagtagatacatctaaattctacaacgacctaataagttttgattatataagataggatgtgaaggctccgatttgtgaataggttttggccaatcctcggcgtagtattgcgcatactattaattccaccgactcggaccgatg

SEQ ID NO: 13683 - DNA, 203 bp, Homo sapiens
ggcgcgccagtcctcgtacgattccgacctgggaccgacaatagacttgagcaatgtttgctgtcttccattggagtgactgaatttctacatgacggctttttgacaagacttaaaacctgtcttggatagagaatatttagccatttacctaaaaatggtattttttacatgcaatgcatgtggtgcgactcggaccgatg

SEQ ID NO: 13684 - DNA, 203 bp, Homo sapiens
ggcgcgccagtcctgcagtgagtccgacctgggaggctggggctcagagagcaatgtttgctgtcttccattggagatgaatctaccgcgcatgacggctttttgacaagacttaaaacctgtcttggatagagaatatttagccatttacctaaaaatggtattttttacatgcaatgcatgtggtgcgactcggaccgatg

SEQ ID NO: 13685 - DNA, 203 bp, Homo sapiens
ggcgcgccagtcctaacctccttccgatggcaatccaagcccttcacaagtctatacaacatccgagtacctatcacaacctccatctccatccaacacaacaaaccagtagtcattaaaaagcgtattatttaccctgcgtccctccaaatcaaccagaatcaaaatcaactctggggcaaataacacgactcggaccgatg

SEQ ID NO: 13686 - DNA, 203 bp, Homo sapiens
ggcgcgccagtcctattaggggtccggactcttcccgcaacccctccgagaggtccggtattcgcctcgaggcggcggcggccaccgagacagcagcgcaccttcccccatcccttccccttatcccccagcccaaaagggcccggtctgcgccccacccccgcccgtccgcccgctacgccgccgcccgactcggaccgatg

SEQ ID NO: 13687 - DNA, 203 bp, Homo sapiens
ggcgcgccagtcctagatatcatccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgcccgactcggaccgatg

SEQ ID NO: 13688 - DNA, 203 bp, Homo sapiens
ggcgcgccagtcctgctgagactccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgccctgcgtcggtaacggcgactcggaccgatg

SEQ ID NO: 13689 - DNA, 203 bp, Homo sapiens
ggcgcgccagtcctttcagccttccggactcttcccgcaacccctccggctccctttccgcacgcctcgaggcggcggcggccaccgagacagcagcgcaccttcccccatcccttccccttatcccccagcccaaaagggcccggtctgcgccccacccgaagtacaggataagctacgccgccgcccgactcggaccgatg

SEQ ID NO: 13690 - DNA, 203 bp, Homo sapiens
ggcgcgccagtcctcgcctacttccggactcttcccgcaacccctccggctccctttccgcacgcctcgaggcggcggcggccaccgagacagcagcgcaccttcccccatcccttccccttatcccccagctgttgccccataattctgcgccccacccccgcccgtccgcccgctacgccgccgcccgactcggaccgatg

SEQ ID NO: 13691 - DNA, 203 bp, Homo sapiens
ggcgcgccagtcctttcaaagttccggactcttcccgcaacccctccggctccctttccgcacgcctcgaggcggcggcggccaccgagagtttctacggttaacccccatcccttccccttatcccccagcccaaaagggcccggtctgcgccccacccccgcccgtccgcccgctacgccgccgcccgactcggaccgatg

SEQ ID NO: 13692 - DNA, 203 bp, Homo sapiens
ggcgcgccagtcctttggttgctccggactcttcccgcaacccctccggctccctttccgcatcaaggtctcgaaaggcggccaccgagacagcagcgcaccttcccccatcccttccccttatcccccagcccaaaagggcccggtctgcgccccacccccgcccgtccgcccgctacgccgccgcccgactcggaccgatg

SEQ ID NO: 13693 - DNA, 203 bp, Homo sapiens
ggcgcgccagtcctgcaccagttccgttgattagcctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagcgactcggaccgatg

SEQ ID NO: 13694 - DNA, 203 bp, Homo sapiens
ggcgcgccagtcctgacatcgatcctaagtggtcgactcaaccgttaccagtgtctctgagcttctggcaagtatgaggcaaggatttcacagaagaacttggagcaaaaattcccactgtcatagctataggctgtccagtcttgagggagctgcaggaacaggaaaaagagaccttcagagaagaccgactcggaccgatg

SEQ ID NO: 13695 - DNA, 203 bp, Homo sapiens
ggcgcgccagtcctctgaggcttcctaagtggtctggaacctaacctgcagtgtctctgagcttctggcaagtatgaggcaaggatttcacagaagaacttggagcaaaaattcccactgtcatagctataggctgtccagtcttgcttccaaccgcattacaggaaaaagagaccttcagagaagaccgactcggaccgatg

SEQ ID NO: 13696 - DNA, 203 bp, Homo sapiens
ggcgcgccagtcctccctcaagtcctcaaggtttagagacacacggtcactgcagctgaagccgctgcccctgctacagatgaagaaaaggaggctgggagagccaaggatcacgcagcaaggaagaaacagacccaggtgcagactcaggcaccaccaggaccagctgatcattccagcccacagcacgactcggaccgatg

SEQ ID NO: 13697 - DNA, 203 bp, Homo sapiens
ggcgcgccagtccttcccgaggtcctcagacccggcccggtcttcgcgcccggactcctggcatgccgtggttcaccactcaccgctctgacgggtgcagacgcgggagttgtcccagactgtggagtggcgggcacggccccagccccccttcccttccctgaccccttcttgccatcgccccagaccgactcggaccgatg

SEQ ID NO: 13698 - DNA, 203 bp, Homo sapiens
ggcgcgccagtccttctgcatttcctcagacccggcccggtcttcgcgcccggactcctggcgccagcgctaggcgcactcaccgctctgacgggtgcagacgcgggagttgtcccagactgtggagtggcgaagtgccagttttacccccttcccttccctgaccccttcttgccatcgccccagaccgactcggaccgatg

SEQ ID NO: 13699 - DNA, 203 bp, Homo sapiens
ggcgcgccagtccttggcgccgtcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagaccgactcggaccgatg

SEQ ID NO: 13700 - DNA, 203 bp, Homo sapiens
ggcgcgccagtcctaatccgagtcctcagacccggcccggtcttcgcgcccggactcctggcgccagcgctaggcgcactcaccgctctgacgggtgcagacgcgggagttgtcccagactgtggagtggcgggcacggccccagccccccttcccttccgaattgggaagagaccatcgccccagaccgactcggaccgatg

SEQ ID NO: 13701 - DNA, 203 bp, Homo sapiens
ggcgcgccagtcctcggcagcgtcctcagacccggcccggtcttcgcgcccggactcctggcgccagcgctaggcgcactcaccgctctgacgggtgcagacgcgggagttgtcccagactgtggagtggcgggcacggccccagcgtagagggtaacagctgaccccttcttgccatcgccccagaccgactcggaccgatg

SEQ ID NO: 13702 - DNA, 203 bp, Homo sapiens
ggcgcgccagtcctgtacgtaatcctcagacccggcccggtcttcgcgcccggactcctggcgccagcgctaggcgcactcaccgctctgacgggtgcagacgcgggagttgtcccagggatcatccccaatggcacggccccagccccccttcccttccctgaccccttcttgccatcgccccagaccgactcggaccgatg

SEQ ID NO: 13703 - DNA, 203 bp, Homo sapiens
ggcgcgccagtcctgttcatactcctcagacccggcccggtcttcgcgcccggactcctggcgccagcgctaggcgcactcaccgctctgcacttgaattttatgggagttgtcccagactgtggagtggcgggcacggccccagccccccttcccttccctgaccccttcttgccatcgccccagaccgactcggaccgatg

SEQ ID NO: 13704 - DNA, 203 bp, Homo sapiens
ggcgcgccagtcctcaaccacctcctcagacccggcccggtcttcgcggggtccactgcatggccagcgctaggcgcactcaccgctctgacgggtgcagacgcgggagttgtcccagactgtggagtggcgggcacggccccagccccccttcccttccctgaccccttcttgccatcgccccagaccgactcggaccgatg

SEQ ID NO: 13705 - DNA, 203 bp, Homo sapiens
ggcgcgccagtcctccttagagtcctggctgcggggcgagccgggcgtctgctgcagcggccgcggtggctgaggaggcccgagaggagtcggtggcagcggcggcggcgggaccggcagcagcagcagcagcagcagcagcagcaaccactagcctcctgccccgcggcgctgccgcacgagccccacgactcggaccgatg

SEQ ID NO: 13706 - DNA, 203 bp, Homo sapiens
ggcgcgccagtcctcactttcctcctggctgcggggcgagccgggcgtctgctgcagcggccgcggtggctgaggaggcccgagaggagtcggtggcagcggcggcggcgggaccggcccttaatatttttccagcagcagcagcaaccactagcctcctgccccgcggcgctgccgcacgagccccacgactcggaccgatg

SEQ ID NO: 13707 - DNA, 203 bp, Homo sapiens
ggcgcgccagtcctctggaaggtccttgaacttttggccgccatgtgcttcccgaaggtcctactgctcacgcaacagaagctgaaggcccgaatgcaccaggccatagaaagattttatgataaaatgcaaaatgcagaatcaggacgtggacaggacgacttcaaagagggctacctggagacagtcgactcggaccgatg

SEQ ID NO: 13708 - DNA, 203 bp, Homo sapiens
ggcgcgccagtcctgaagaaggtccttgaacttttggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtcgactcggaccgatg

SEQ ID NO: 13709 - DNA, 203 bp, Homo sapiens
ggcgcgccagtccttggacccttcgcaagctcttaaatttgacaatggatgaaaaagtctttgttttgaaagattttatcagaagacaagtgcctgacatacctgaactgtcttatcagaaggaggcattactttctcaagtcgaagtaccaatggtcttaacagagggcttcaagctcctatcatgccgactcggaccgatg

SEQ ID NO: 13710 - DNA, 203 bp, Homo sapiens
ggcgcgccagtcctgtcgggagtcgcactttcaaaaggaacaagatatgtgctgaagtccagataacagccaagcaacctgaccaagaactaccaactctattctatagactaaaaagtcgccattttagttatataaaaatcaagttagaataagaattaaatcaatcaagaacgggacaaataaaacgactcggaccgatg

SEQ ID NO: 13711 - DNA, 203 bp, Homo sapiens
ggcgcgccagtcctcgaaaggatcgccgccacctccgcctcttcagtctcctggtcttcgtcctgctcgcgctgaccacctctcagggaaagggggggacataggggcgtcgcggggccccggcgaatgcgccccccgccgcctctcgggctgcgccgcctcgcggggatgaagcaccggccgtgaagcgactcggaccgatg

SEQ ID NO: 13712 - DNA, 203 bp, Homo sapiens
ggcgcgccagtccttgtccggttcgccgccacctccgcctcttcagtctcctggtcttcgtcgccgctctctctctcacctctcagggaaagggggggacatagacagtcaagtacctcccggcgaatgcgccccccgccgcctctcgggctgcgccgcctcgcggggatgaagcaccggccgtgaagcgactcggaccgatg

SEQ ID NO: 13713 - DNA, 203 bp, Homo sapiens
ggcgcgccagtcctggcgcatttcgccgccacctccgcctcttcagtctcctggtcttcgtcgccgctctctctctcacctctcagggaaagggggggacataggggcgtcgcggggccccggcgaatgcgccccccgccgcctctaaaatacacgtatttcgcggggatgaagcaccggccgtgaagcgactcggaccgatg

SEQ ID NO: 13714 - DNA, 203 bp, Homo sapiens
ggcgcgccagtcctccctgccgtcgccgccacctccgcctcttcagtctcctggtcttcgtcgccgctctctctctgcaacactcttatgagggggggacataggggcgtcgcggggccccggcgaatgcgccccccgccgcctctcgggctgcgccgcctcgcggggatgaagcaccggccgtgaagcgactcggaccgatg

SEQ ID NO: 13715 - DNA, 203 bp, Homo sapiens
ggcgcgccagtcctcttagttttcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcgttattacacctaatcgactcggaccgatg

SEQ ID NO: 13716 - DNA, 203 bp, Homo sapiens
ggcgcgccagtcctgggttgcgtcgcgcttcccctccctccggggctgggcctgccccggccgtcgcggagcctcccctcccaccgtccgtgagtgtacgcgcccggccgccgcctccaggcagcccggagccgtatccgtatgatccccgctgggcgcagcactccgtcggcggcggcggcggcgcgcgactcggaccgatg

SEQ ID NO: 13717 - DNA, 203 bp, Homo sapiens
ggcgcgccagtcctgctagtattcggattaatactggaaacttctcctcccattcctgtgagggctacctgtgctactcaggctactcccgtggtggctcctcgtaccccagcaacctggtctacagcactgaacctttgatctcccagcacctgccagctgggttcctctctctgcaagggctttcacgactcggaccgatg

SEQ ID NO: 13718 - DNA, 203 bp, Homo sapiens
ggcgcgccagtcctgagacgaatcgtcacatcgtggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgcgactcggaccgatg

SEQ ID NO: 13719 - DNA, 203 bp, Homo sapiens
ggcgcgccagtcctggacttgatcgtccgcctaaacggttcgagagttaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccgactcggaccgatg

SEQ ID NO: 13720 - DNA, 203 bp, Homo sapiens
ggcgcgccagtcctaagcctcgtcgtccgcctaataccgcgcctgcgcaccgcgtctcttccggctgttcaagattcctaggtcgcggcgacatggccaaacgtaccaagaaagtcgggatcgtcggtaaatacgggacccgctatggggcctccctccggaaaatggtgaagaaaattgaaatcagccgactcggaccgatg

SEQ ID NO: 13721 - DNA, 203 bp, Homo sapiens
ggcgcgccagtcctcgtagggctcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccgaccgggatattgtgaaattgaaatcagccgactcggaccgatg

SEQ ID NO: 13722 - DNA, 203 bp, Homo sapiens
ggcgcgccagtcctgttggcattcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagagtgaaatgtggcttcgactcggaccgatg

SEQ ID NO: 13723 - DNA, 203 bp, Homo sapiens
ggcgcgccagtcctagtgaatttcgtccgcctaataccgcgcctgcgcaccgcgtctcttcctttctgggctcggacctaggtcgcggcgacatggccaaacgtaccaagaaagtcgggatcgtcggtaaatcgtcacgagcgagcggggcctccctccggaaaatggtgaagaaaattgaaatcagccgactcggaccgatg

SEQ ID NO: 13724 - DNA, 203 bp, Homo sapiens
ggcgcgccagtccttccgcgaatcgtccgcctaataccgcgcctgcgcaccgcgtctcttcctttctgggctcggagtccaacgagacttacatggccaaacgtaccaagaaagtcgggatcgtcggtaaatacgggacccgctatggggcctccctccggaaaatggtgaagaaaattgaaatcagccgactcggaccgatg

SEQ ID NO: 13725 - DNA, 203 bp, Homo sapiens
ggcgcgccagtcctacagccaatcgtccgcctaataccgcgcctgcgccataacctcgcctatttctgggctcggacctaggtcgcggcgacatggccaaacgtaccaagaaagtcgggatcgtcggtaaatacgggacccgctatggggcctccctccggaaaatggtgaagaaaattgaaatcagccgactcggaccgatg

SEQ ID NO: 13726 - DNA, 203 bp, Homo sapiens
ggcgcgccagtccttgagtgattcgttagtcagagtgggcggagccgcccgcgggcacctgctatagctcttccatccgcgtcgctgaggggtagcgatgcgggctccggggatgaggtcgcggccggcgggtcccgcgctgttgctgctgctgctcttcctcggagcggccgagtcggtgcgtcgggcgactcggaccgatg

SEQ ID NO: 13727 - DNA, 203 bp, Homo sapiens
ggcgcgccagtccttaaacaattcgttgaactacatgttgtaaggctttagagaaataagggagtgtcctatttaggatgaggtgctccggtggcagccccaccaaaacctctagcgactaggaacagctatatcgggttgctatagcagtcaggatgtcgcgtaaatcggtgtaaatacccaaacctcgactcggaccgatg

SEQ ID NO: 13728 - DNA, 203 bp, Homo sapiens
ggcgcgccagtcctaagaaatttcgttgaactacatgttgtaaggctttagagaaataagggagtgtcctatttaggatgaggtgctccggtggcagccccaccaaaacctctagcgactaggaacagctatgagcctggctgcgtgcagtcaggatgtcattctggcgttccgaaatacccaaacctcgactcggaccgatg

SEQ ID NO: 13729 - DNA, 203 bp, Homo sapiens
ggcgcgccagtcctggagtagttcgttgaactactatcgaacgcctgctagagaaataagggagtgtcctatttaggatgaggtgctccggtggcagccccaccaaaacctctagcgactaggaacagctatatcgggttgctatagcagtcaggatgtcattctggcgttccgaaatacccaaacctcgactcggaccgatg

SEQ ID NO: 13730 - DNA, 203 bp, Homo sapiens
ggcgcgccagtcctctgtgaagtctaatgcttagcgccgttcgcgctctgaccagcccgcagagccagcccccgaccccgggccacctgggcccccgggttccgccggcactctcgccaccaccgcgtgggtctgacaagatgtaccaggtcccactaccactggatcgggatgggaccctggtacggcgactcggaccgatg

SEQ ID NO: 13731 - DNA, 203 bp, Homo sapiens
ggcgcgccagtcctaggtattgtctcacaaggactgggtgaagagttctgcagccttacagagactggaaaagaagcccaaaccaaggcccccagagaggtcccccaggcccctttggaaagggaccgtgaggctggagatccggcgcaggagaccaacgcctgccatgctgttccggctctcagagccgactcggaccgatg

SEQ ID NO: 13732 - DNA, 203 bp, Homo sapiens
ggcgcgccagtcctttgcgctctctcacaaggactgggtgaagagttctgcagccttacagagactggaaaagaagcccaaaccaaggcccccagagaggtcccccaggcccctttgggtccctgagcctcagctggagatccggcattactctggcgaccctgccatgctgttccggctctcagagccgactcggaccgatg

SEQ ID NO: 13733 - DNA, 203 bp, Homo sapiens
ggcgcgccagtcctaagtgctctctcacaaggactgggtgaagagttctgcagccttacagagactggaaaagaagtattttgtctacggcccagagaggtcccccaggcccctttgggtccctgagcctcagctggagatccggcgcaggagaccaacgcctgccatgctgttccggctctcagagccgactcggaccgatg

SEQ ID NO: 13734 - DNA, 203 bp, Homo sapiens
ggcgcgccagtcctagatcacctctgacatggtgctgttcatggcggtagctagctggtagtcctccggcccctgaatgcggctaatcctaactgcggagcacatgctcacaaaccagtgggtggtgtgtcgtaacgggcaactctgcagcggaaccgactactttgggtgtccgtgtttccttttatcgactcggaccgatg

SEQ ID NO: 13735 - DNA, 203 bp, Homo sapiens
ggcgcgccagtccttcccaccttctgacatggtgtgaagagcctattgagctagctggtagtcctccggcccctgaatgcggctaatcctaactgcggagcacatgctcacaaaccagtgggtggtgtgtcgacgatccaggaaaagcagcggaaccgactactttgggtgtccgtgtttccttttatcgactcggaccgatg

SEQ ID NO: 13736 - DNA, 203 bp, Homo sapiens
ggcgcgccagtcctcggcgtgatctgacatggtgtgaagagcctattgagctagctggtagtcctccggcccctgaatgcggctaatcctgttaaaacttttgttgctcacaaaccagtgggtggtgtgtcgtaacgggcaactctgcagcggaaccgactactttgggtgtccgtgtttccttttatcgactcggaccgatg

SEQ ID NO: 13737 - DNA, 203 bp, Homo sapiens
ggcgcgccagtcctaacagagctctgctgccgccaccgcccactcttacccccgccgcttctcgactctgttgttagccgaagactcgcctctcagccgcccgccgcacagacgcacgagtaaaaagtgcagctccatcggctgatagaatagtcaacttgactctgggcggcaccgggcgtcccacgcgactcggaccgatg

SEQ ID NO: 13738 - DNA, 203 bp, Homo sapiens
ggcgcgccagtcctttgtatcgtctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 13739 - DNA, 203 bp, Homo sapiens
ggcgcgccagtcctactatgactctgctgccgccaccgcccactcttacccccgccgcttctcgactctgttgttagccgaagactcgcctctcagccgcccgccgcacagacgcacgagtaaaaagtgcagctccatcggctgatcctcgctaagctcctgagggttctaagtccgggcgtcccacgcgactcggaccgatg

SEQ ID NO: 13740 - DNA, 203 bp, Homo sapiens
ggcgcgccagtcctcttgcgtttctgctgccgccaccgcccactcttacccccgccgcttctcgactctgttgttagccgaagactcgcctctcagccgcccgcgctggttggtataaagtaaaaagtgcagctccatcggctgatcctcgctaagctccgactctgggcggcaccgggcgtcccacgcgactcggaccgatg

SEQ ID NO: 13741 - DNA, 203 bp, Homo sapiens
ggcgcgccagtcctttagttcatctgctgccgccaccgcccactcttacccccgccgcttctgctaatcaaaacatgccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 13742 - DNA, 203 bp, Homo sapiens
ggcgcgccagtcctaatgagaatctgctgccgcctggataacacagatcccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 13743 - DNA, 203 bp, Homo sapiens
ggcgcgccagtcctagttaagatcttgctttcgtaataaaattctgtacataaaagtcgaaagtattgctatagttttcagcaaaaacaactatttaggcatacttctcaggatggcgcgttgcagtccaacaagatccagggactgtacagaattttcctatacctcgagtcgggtttggaatctaacgactcggaccgatg

SEQ ID NO: 13744 - DNA, 203 bp, Homo sapiens
ggcgcgccagtcctgggtttgctctttcagatttggaactgtatctgtatggaaacaacagagttttcttgaagtacaactaaggacaggtcaccactaggcactaacatcgctgactcagcacccgccactgatggtctatctgatgctgaaaatgtctctagttttttgacaacggctaaataacccgactcggaccgatg

SEQ ID NO: 13745 - DNA, 203 bp, Homo sapiens
ggcgcgccagtcctttgcgtgttctttcagatttggaactgtatctgtatggaaacaacagagttttcttgaagtacaactaaggacaggtcaccactaggcactaacatcgctgacttgcatgattatggagatggtctatctgatgctgaaaatgtctggcccaccccaggtacggctaaataacccgactcggaccgatg

SEQ ID NO: 13746 - DNA, 203 bp, Homo sapiens
ggcgcgccagtccttcggcgtctctttcagatttggaactgtatctgtatggaaacaacagatcacaggattcagccaactaaggacaggtcaccactaggcactaacatcgctgacttgcatgattatggagatggtctatctgatgctgaaaatgtctctagttttttgacaacggctaaataacccgactcggaccgatg

SEQ ID NO: 13747 - DNA, 203 bp, Homo sapiens
ggcgcgccagtcctggatgctttctttcagatttggaactgtatctgttcatgcgaggttatgttttcttgaagtacaactaaggacaggtcaccactaggcactaacatcgctgacttgcatgattatggagatggtctatctgatgctgaaaatgtctctagttttttgacaacggctaaataacccgactcggaccgatg

SEQ ID NO: 13748 - DNA, 203 bp, Homo sapiens
ggcgcgccagtcctccttcctatgaaaatgccgtcggtttcgaaagcgaaatataacaatacgagcgggtcccccccgcagactgagaagccgacccactacaggtacctgaaggagttcaggacggagcagtgccccctgttttcacagcacaagtgcgcgcagcaccggccgttcacctgcttccacgactcggaccgatg

SEQ ID NO: 13749 - DNA, 203 bp, Homo sapiens
ggcgcgccagtcctgcgaaccctgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgacatgaccagatttcgactcggaccgatg

SEQ ID NO: 13750 - DNA, 203 bp, Homo sapiens
ggcgcgccagtcctgccgtccttgaaaatgccgtcggtttcgaaagcggcggcagcggcgctgagcgggtcccccccgcagactgagaagccgacccactacagtagaggttttcgcatcaggacggagcagtgccccctgttttcacagcacaagtgcgcgcagcaccggccgttcacctgcttccacgactcggaccgatg

SEQ ID NO: 13751 - DNA, 203 bp, Homo sapiens
ggcgcgccagtcctcaagcgattgaaaatgccgtcggtttcgaaagcggcggcagcggcgctgagcgggtcccccccgcagactgagaagggcgttgcaatgccgtacctgaaggagttcaggacggagcagtgccccctgttttcacagcacaagtgcgcgcagcaccggccgttcacctgcttccacgactcggaccgatg

SEQ ID NO: 13752 - DNA, 203 bp, Homo sapiens
ggcgcgccagtcctgcttgaggtgaaaatgccgtgttccgtctgccatgcggcagcggcgctgagcgggtcccccccgcagactgagaagccgacccactacaggtacctgaaggagttcaggacggagcagtgccccctgttttcacagcacaagtgcgcgcagcaccggccgttcacctgcttccacgactcggaccgatg

SEQ ID NO: 13753 - DNA, 203 bp, Homo sapiens
ggcgcgccagtcctcacatgtatgaaaccggaaactgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 13754 - DNA, 203 bp, Homo sapiens
ggcgcgccagtcctcccttcgttgaagtagacttgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggcgactcggaccgatg

SEQ ID NO: 13755 - DNA, 203 bp, Homo sapiens
ggcgcgccagtcctgcctaagctgaattcattttaagtctaacgagacattctcaggaactccagaccttcctatttatgttgttttttgtattctatggaggaatcgtgtttggaaaccttcttattgtcataacagtggtatctgactcccaccttcactctcccatgtacttcctgctagccaaccgactcggaccgatg

SEQ ID NO: 13756 - DNA, 203 bp, Homo sapiens
ggcgcgccagtccttgctcaaatgaattcatttttctgggtctctctgattctcaggaactccagaccttcctattccgaagtagaaacctattctatggaggaatcgtgtttggaaaccttcttattgtcataacagtggtatctgactcccaccttcactctcccatgtacttcctgctagccaaccgactcggaccgatg

SEQ ID NO: 13757 - DNA, 203 bp, Homo sapiens
ggcgcgccagtccttgaatacgtgaattcatttttctgggtctctctgattctcaggaactccagaccttcctatttatgttgttttttggcccgacgcatcttatcgtgtttggaaaccttcttattgtcataacagtggtatctgactcccaccttcactctcccatgtacttcctgctagccaaccgactcggaccgatg

SEQ ID NO: 13758 - DNA, 203 bp, Homo sapiens
ggcgcgccagtccttcaactggtgaattcatttttctgggtctctctgattctcaggaactccagaccttcctatttatgttgttttttgtattctatggaggaatcgtgtttggaaaccttcttattgtcacggatagtcatagcgactcccaccttcactctcccatgtacttcctgctagccaaccgactcggaccgatg

SEQ ID NO: 13759 - DNA, 203 bp, Homo sapiens
ggcgcgccagtcctcaagtccctgaattcatttttctgggtctctctgattctcaggaactccagaccttcctatttatgttgttttttgtattctatggaggaatcgtgtttggaaaccttcttattgtcataacagtggtatctacgaaaaaccttcactctcccatgacagatttgctagccaaccgactcggaccgatg

SEQ ID NO: 13760 - DNA, 203 bp, Homo sapiens
ggcgcgccagtcctataaatcctgaattcatttttctgggtctctctgattctcaggaactccagaccttcctatttatgttgttttttgtattctatggaggaatcgtgtttggaaaccttcttattgtcataacagtggtatctttggtttctaactcctctcccatgtacttcctgctagccaaccgactcggaccgatg

SEQ ID NO: 13761 - DNA, 203 bp, Homo sapiens
ggcgcgccagtcctgcgttctgtgaattcatttttctgggtctctctgattctcaggaactcgcttttagagccggtatgttgttttttgtattctatggaggaatcgtgtttggaaaccttcttattgtcataacagtggtatctgactcccaccttcactctcccatgtacttcctgctagccaaccgactcggaccgatg

SEQ ID NO: 13762 - DNA, 203 bp, Homo sapiens
ggcgcgccagtcctgtcgatcctgaattcatttttctgggtctctctgattctcagggactccagaccttcctatttatgttgttttttgatcagagccattttatcgtgtttggaaaccttcttattgtcataacagtggtatctgactcccaccttcactctcccatgtacttcctgctagccaaccgactcggaccgatg

SEQ ID NO: 13763 - DNA, 203 bp, Homo sapiens
ggcgcgccagtcctgtctactttgaattcatttttctgggtctctctgattctcagggactccagaccttcctatttatgttgttttttgtattctatggaggaatcgtgtttggaaaaacgagcggatcagtaacagtggtatctgactcccaccttcactctcccatgtacttcctgctagccaaccgactcggaccgatg

SEQ ID NO: 13764 - DNA, 203 bp, Homo sapiens
ggcgcgccagtcctccaggctatgaattcatttttctgggtctctctgtgcgcacacggactcagaccttcctatttatgttgttttttgtattctatggaggaatcgtgtttggaaaccttcttattgtcataacagtggtatctgactcccaccttcactctcccatgtacttcctgctagccaaccgactcggaccgatg

SEQ ID NO: 13765 - DNA, 203 bp, Homo sapiens
ggcgcgccagtcctacgtcaggtgacatcgctaggaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctccgactcggaccgatg

SEQ ID NO: 13766 - DNA, 203 bp, Homo sapiens
ggcgcgccagtcctcgtggaagtgacgcccaggtctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagcccgactcggaccgatg

SEQ ID NO: 13767 - DNA, 203 bp, Homo sapiens
ggcgcgccagtcctggcggctctgacggaggcgccgctgccagggggcgtgcggcagcgcgggaataagccttaaagcggcggcggcggaggcggcggcggcggcggcggcggcggcggctgggcctcgagcgcccgcagcccacctctcgggggcgggctcccggcgctagcagggctgaagagaagcgactcggaccgatg

SEQ ID NO: 13768 - DNA, 203 bp, Homo sapiens
ggcgcgccagtcctattcgtagtgacttctcagggatgtaaccggacctggttcagtatccgggttgtcctgtattgttacggtgtatccgtcttggcacactgaaagggtatttttgggtaatcctttcctactgcctgatagggtggcgtgcccggccacgagagattaagggtagcaatttaaaccgactcggaccgatg

SEQ ID NO: 13769 - DNA, 203 bp, Homo sapiens
ggcgcgccagtcctgtaccgtttgaggaacactaatggtggcgacgcccgaggcaagctctggaaagcaacgccgagtctctgagaagagggagcataggctgtgctgatttaaaaacagaaaatgcaaagttggactgaaaatatcccacgtcttctaagcaatctgcttaaggcttccaaacttaccgactcggaccgatg

SEQ ID NO: 13770 - DNA, 203 bp, Homo sapiens
ggcgcgccagtcctcaacctaatgaggaacactaggctgttgtctagacgaggcaagctctggaaagcaacgccgagtctctgagaagagcagttcagtaactagctgatttaaaaacagaaaatgcaaagttggactgaaaatatcccacgtcttctaagcaatctgcttaaggcttccaaacttaccgactcggaccgatg

SEQ ID NO: 13771 - DNA, 203 bp, Homo sapiens
ggcgcgccagtccttcgtagcctgaggaacactaggctgttgtctagacgaggcaagctctggaaagcaacgccgagtctctgagaagagggagcataggctgtgctgatttaaaaacagaaaatgcaaagttggactgaaaatatatgcatgtcagccggcaatctgcttaaggcttccaaacttaccgactcggaccgatg

SEQ ID NO: 13772 - DNA, 203 bp, Homo sapiens
ggcgcgccagtcctctgccgggtgaggctcagctaattgacctcaagaaagcaatcatccgcagtgcaatttgatcaagaaacacccaattacactacactggtatgacactgtactaaccctgagggttttagaaaaaacgattaacgataaataagccgtggggtcttgtgttacctgaggcagcccgactcggaccgatg

SEQ ID NO: 13773 - DNA, 203 bp, Homo sapiens
ggcgcgccagtccttatccatgtgaggctcagctaattgacctcaagaaagcaatcatccgcagtgcaatttgatcgtcttggttgtccgtacactacactggtatgacactgtactaaccctgagggttttagaaaaaacgattaacgataaataagcccgaacactacacactacctgaggcagcccgactcggaccgatg

SEQ ID NO: 13774 - DNA, 203 bp, Homo sapiens
ggcgcgccagtccttaacacgttgaggtcctctccagcaagctacacaaagtatagatatttgtgcctaatgcaaaaagctatatttacacatttcaagagagggtgcacttgctggggggaggacatgggccgggaaggattggaagaccaaggacctccccctcctccccctccaggtctagtctacgactcggaccgatg

SEQ ID NO: 13775 - DNA, 203 bp, Homo sapiens
ggcgcgccagtcctagcgtgtttgagtaggttggattcgttaaactcacggacagaagcgctggtcggcgtctggcggttattgttcaaaactacaactccattttgacactttctcacttgtaccgatcttcagacgccctccttcttcatgagaatgatgccatccataagatctgtgcaaaactgcgactcggaccgatg

SEQ ID NO: 13776 - DNA, 203 bp, Homo sapiens
ggcgcgccagtccttacaggcatgagtaggttggtccgaagtttgaaccggacagaagcgctggtcggcgtctggcggttattgttcaaaactacaactccattttgacactttctcacttgtaccgatcttagtttctatgttgccttcatgagaatgatgccatccataagatctgtgcaaaactgcgactcggaccgatg

SEQ ID NO: 13777 - DNA, 203 bp, Homo sapiens
ggcgcgccagtcctcacgcctctgagtaggttggtccgaagtttgaaccggacagaagcgctggtcggcgtctggcggttattgttcaaaactacaactccattttgacactttctcacttgtaccgatcttcagacgccctccttcttcatgagaatgatgccatccataagaatccaaggccgggccgactcggaccgatg

SEQ ID NO: 13778 - DNA, 203 bp, Homo sapiens
ggcgcgccagtcctcataacgctgagtaggttggtccgaagtttgaaccggacagaagcgctggtcggcgtctggctaccgggtcaacccactacaactccattttgacactttctcacttgtaccgatcttcagacgccctccttcttcatgagaatgatgccatccataagatctgtgcaaaactgcgactcggaccgatg

SEQ ID NO: 13779 - DNA, 203 bp, Homo sapiens
ggcgcgccagtcctaccttacgtgagtaggttggtccgaagtttgaacgcacggctccttggggtcggcgtctggcggttattgttcaaaactacaactccattttgacactttctcacttgtaccgatcttcagacgccctccttcttcatgagaatgatgccatccataagatctgtgcaaaactgcgactcggaccgatg

SEQ ID NO: 13780 - DNA, 203 bp, Homo sapiens
ggcgcgccagtcctgcacaggatgatcccccagccaggggtccgcaacaacgtggtacgtgtcgaaactttgcccatagcagcgggcgggcactttgcactggaacttacaacacccgagcaaggacgcgactctcccgacgcggggaggctattctgcccatttggggacacttccccgccgctgcccgactcggaccgatg

SEQ ID NO: 13781 - DNA, 203 bp, Homo sapiens
ggcgcgccagtcctggcgggcatgatcccccagccaggggtccgcaacccttgccgcatccacgaaactttgcccatagcagcgggcgggcactttgcactggaacttacaacacccgagcaaggacgcgactctcccgacgcggggaggctattctgcccatttggggacactcgatgtggaacaaacgactcggaccgatg

SEQ ID NO: 13782 - DNA, 203 bp, Homo sapiens
ggcgcgccagtcctgttgggtatgatcccccagccaggggtccgcaacccttgccgcatccacgaaactttgcccatagcagcgggcgggcactttgcactggataggcactggggtcagcaaggacgcgactctcccgacgcggggaggctattctgcccatttggggacacttccccgccgctgcccgactcggaccgatg

SEQ ID NO: 13783 - DNA, 203 bp, Homo sapiens
ggcgcgccagtcctgcttaacatgatcccccagcggttatcgttggcgccttgccgcatccacgaaactttgcccatagcagcgggcgggcactttgcactggaacttacaacacccgagcaaggacgcgactctcccgacgcggggaggctattctgcccatttggggacacttccccgccgctgcccgactcggaccgatg

SEQ ID NO: 13784 - DNA, 203 bp, Homo sapiens
ggcgcgccagtcctctcgtgactgatcgttgagctaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtcgactcggaccgatg

SEQ ID NO: 13785 - DNA, 203 bp, Homo sapiens
ggcgcgccagtcctcaatcatttgatggcgtcaaaagacgtcgttcctactgctgctagcagtgaaaatgctaacaacaatagtagtattaagtctcgtctattccaattggctttatgttcaggtggggctacgtccccacccaactcgataaagataaccaaccaagatatggctctggggctgatcgactcggaccgatg

SEQ ID NO: 13786 - DNA, 203 bp, Homo sapiens
ggcgcgccagtcctccacaccatgatggcgtcaaaagacgtcgttcctactgctgctagcagtgaaaatgctaacaacaatagtagtattaagtctcgtctattggcgagactcaagggttcaggtggggctacgtccccacccaactcgataaagataaccaaccaagatatggctctggggctgatcgactcggaccgatg

SEQ ID NO: 13787 - DNA, 203 bp, Homo sapiens
ggcgcgccagtcctctttattgtgatggcgtcaaaagacgtcgttcctactgctgctagcagtgaaaatgctaacaacaatagtagtattaagtctcgtctattggcgagactcaagggttcaggtggggctttcagtatgaattgctcgataaagataaccaaccaagatatggctctggggctgatcgactcggaccgatg

SEQ ID NO: 13788 - DNA, 203 bp, Homo sapiens
ggcgcgccagtcctgggaagcttgatggcgtcaaaagacgtcgttcctactgctgctagcagtgaaaatgctaacaacaatagtagtattaagtctcgtctattggcgagactcaaggtgaacatcacattaacgtccccacccaactcgataaagataaccaaccaagatatggctctggggctgatcgactcggaccgatg

SEQ ID NO: 13789 - DNA, 203 bp, Homo sapiens
ggcgcgccagtccttttcgtcctgcaaattagactccttgcggagctcgccgcctgattctaggctggtcacacgataaagcctgtgacgtttgcggcagccaggccgtcgacgatgcccagtgaaactctctgggaaattgcaaaagctgaagtggaaaaaaggggaattaatggaagtgaaggtgacgactcggaccgatg

SEQ ID NO: 13790 - DNA, 203 bp, Homo sapiens
ggcgcgccagtcctacgtaccgtgcaaggagacgccgccgccttcatgctgccggcgggctgacgcataaacacattggccgagctgcagggcgccctggacgcctgcgcacagcgacaattgcaattggagcagagcctgcgcgtttgccgtcggctgctgcatgcctgggaaccaactgggacccgcgactcggaccgatg

SEQ ID NO: 13791 - DNA, 203 bp, Homo sapiens
ggcgcgccagtcctctcaattatgcaaggagacgccgccgccttcatgctgccggcgggctgctcgcgccggctggtggccgagctgcagggcgccctggacgcaacgttgttcgttaaattgcaattggagcagagcctgcgcgtttgccgtcggctgctgcatgcctgggaaccaactgggacccgcgactcggaccgatg

SEQ ID NO: 13792 - DNA, 203 bp, Homo sapiens
ggcgcgccagtcctggccaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgcgactcggaccgatg

SEQ ID NO: 13793 - DNA, 203 bp, Homo sapiens
ggcgcgccagtcctttctgttgtgcaaggagacgccgccgccttcatgctgccggcgggctgctcgcgccggctggtggccgagctgcagggcgccctggacgcctgcgcacagcgacttggaatgcaaacccagagcctgcgcgtttgccgtcggctgctgcatgcctgggaaccaactgggacccgcgactcggaccgatg

SEQ ID NO: 13794 - DNA, 203 bp, Homo sapiens
ggcgcgccagtcctgtgtcgtctgcaaggagacgccgccgccttcatgctgtgcatctagtgctcgcgccggctggtggccgagctgcagggcgccctggacgcctgcgcacagcgacaattgcaattggagcagagcctgcgcgtttgccgtcggctgctgcatgcctgggaaccaactgggacccgcgactcggaccgatg

SEQ ID NO: 13795 - DNA, 203 bp, Homo sapiens
ggcgcgccagtcctgagatggctgcaattgaagtaggcacatgtcgaattgctactgttgaaggcctaacaacctctgaggcaattgctgctataggcctcactccacaggcctatgctgtgatatctggggctcctgctgctatagctggatttgcagctttactgcaaactgtgactggtgtgagccgactcggaccgatg

SEQ ID NO: 13796 - DNA, 203 bp, Homo sapiens
ggcgcgccagtcctgaggagtttgcaattgaagtgcaacttgcatctgagtgacgctcgcttggcctaacaacctctgaggcaattgctgctataggcctcactccacaggcctatgctgtgatatctggggctcctgctgctatagctggatttgcagctttactgcaaactgtgactggtgtgagccgactcggaccgatg

SEQ ID NO: 13797 - DNA, 203 bp, Homo sapiens
ggcgcgccagtccttgaagagttgcaattgaagtgcaacttgcatctgttgctactgttgaacagaatcagggaggtgaggcaattgctgctataggcctcactccacaggcctatgctgtgatatctggggctcctgctgctatagctggatttgcagctttactgcaaactgtgactggtgtgagccgactcggaccgatg

SEQ ID NO: 13798 - DNA, 203 bp, Homo sapiens
ggcgcgccagtccttacgcccttgcaattgaagtgcaacttgcatctgttgctactgttgaaggcctaacaacctctgaggcaattgctgctataggcctcactccacaggcctatgctgtgatatctggggctcctgctgctataatatccccgttttgtttactgcaaactgtgactggtgtgagccgactcggaccgatg

SEQ ID NO: 13799 - DNA, 203 bp, Homo sapiens
ggcgcgccagtcctagcacttgtgcaattgaagtgcaacttgcatctgttgctactgttgaaggcctaacaacctctgaggcaattgctgctataggcctcactccacaggcctatgctgtgatatctggggctcctgctgctatagctggatttgcagctttactgcaaactgtgactggtgtgagccgactcggaccgatg

SEQ ID NO: 13800 - DNA, 203 bp, Homo sapiens
ggcgcgccagtcctgcgcaacgtgcaattgaagtgcaacttgcatctgttgctactgttgaaggcctaacaacctctgaggcaattgctgctataggcctcactccacaggcctatgctgtgatatctgggggatggaagcggggggctggatttgcagctttactgcaaactgtgactggtgtgagccgactcggaccgatg

SEQ ID NO: 13801 - DNA, 203 bp, Homo sapiens
ggcgcgccagtcctaaggcatgtgcacactcggactgggtataaagcagctgaaatgtggagtttcctcccaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 13802 - DNA, 203 bp, Homo sapiens
ggcgcgccagtcctctaaggtatgcacagctaagacgtcgcgcttgcgcaggcgctcggcgctacccaacctacagagccaagatggcgcataggggttctccaggctgcagttggcgccttatcagtatctaagcggagtgttttggaaggagttaaggggctgtggcaaacgccctctccgccgtccgactcggaccgatg

SEQ ID NO: 13803 - DNA, 203 bp, Homo sapiens
ggcgcgccagtcctaacactactgcacagctaagacgtcgcgcttgcggtattagcaatgtgagaggcctgcgggaagccaagatggcgcataggggttctccaggctgcagttggcgccttatcagtatctaagcggagtgttttggaaggagttaaggggctgtggcaaacgccctctccgccgtccgactcggaccgatg

SEQ ID NO: 13804 - DNA, 203 bp, Homo sapiens
ggcgcgccagtcctccatacggtgcacagctaagtgcctcgaagccgacaggcgctcggcgcagaggcctgcgggaagccaagatggcgcataggggttctccaggctgcagttggcgccttatcagtatctaagcggagtgttttggaaggagttaaggggctgtggcaaacgccctctccgccgtccgactcggaccgatg

SEQ ID NO: 13805 - DNA, 203 bp, Homo sapiens
ggcgcgccagtcctcaattgtgtgcacttcagagcgggatgtaaccgccacgtggcattgccaacaaggagaagaactccttgcccagctgcaccgacccctagagccatgcactaacaaatgctattgtaagcgatgcagtttccattgccagctgtgtttctcgaaaaaggggctcggaatatcatcgactcggaccgatg

SEQ ID NO: 13806 - DNA, 203 bp, Homo sapiens
ggcgcgccagtcctatacatgatgcacttcagagcgggatgtaaccgctcaagaattggctaaacaaggagaagaaactaacagaatatagcaccgacccctagagccatgcactaacaaatgctattgtaagcgatgcagtttccattgccagctgtgtttctcgaaaaaggggctcggaatatcatcgactcggaccgatg

SEQ ID NO: 13807 - DNA, 203 bp, Homo sapiens
ggcgcgccagtcctcgtgcagttgcacttcagagcgggatgtaaccgctcaagaattggctaaacaaggagaagaactccttgcccagctgcaccgacccctagagccatgcactaacaaatgctattgtaagcgatgcagtttccattgccagctgtgtgaacaaccgcgctagctcggaatatcatcgactcggaccgatg

SEQ ID NO: 13808 - DNA, 203 bp, Homo sapiens
ggcgcgccagtccttagggcaatgcacttcagagcgggatgtaaccgctcaagaattggctaaacaaggagaagaactccttgcccagctttcgatcgtaaccaagccatgcactaacaaatgctattgtaagcgatgcagtttccattgccagctgtgtttctcgaaaaaggggctcggaatatcatcgactcggaccgatg

SEQ ID NO: 13809 - DNA, 203 bp, Homo sapiens
ggcgcgccagtcctatcacgcttgcacttcagaggccaggcaggtgaatcaagaattggctaaacaaggagaagaactccttgcccagctgcaccgacccctagagccatgcactaacaaatgctattgtaagcgatgcagtttccattgccagctgtgtttctcgaaaaaggggctcggaatatcatcgactcggaccgatg

SEQ ID NO: 13810 - DNA, 203 bp, Homo sapiens
ggcgcgccagtcctgtagaacttgcagcagcagctcttctggcctctcacgccatccaggggaccttgtcctaccctcttgtgtccgtcgtcagtgaatctctgactcgaaaaggtacagccgaagatagcatacttgctgttgccgttgtcattatcctgtttattatcttgctgggagttatcatgcgactcggaccgatg

SEQ ID NO: 13811 - DNA, 203 bp, Homo sapiens
ggcgcgccagtcctctaatgattgcagcagcagctcttctggcctctcacgccatccaggggaccttgtcctaccctcttgtgtccgtcgtcagtgaatctctgactcgaaaaggtactcagcttctctatcgtgcgatgcaacgtgttgtcattatcctgtttattatcttgctgggagttatcatgcgactcggaccgatg

SEQ ID NO: 13812 - DNA, 203 bp, Homo sapiens
ggcgcgccagtccttatctcgctgcagcagcagctcttctggcctctcacgccatccaggggaccttgtcctaccctcttgtgtccgtcgtcagtgaatctctgactcgaaaaggtactcagcttctctatctacttgctgttgccgttgtcattatcctgtttattatcttgccacactcatggtgacgactcggaccgatg

SEQ ID NO: 13813 - DNA, 203 bp, Homo sapiens
ggcgcgccagtccttttagctatgcagcagcagctcttctggcctctcacgccatccaggggaccttgtcctaccctcttgtgtccgtcgtcagtgaatctctgcagaagttgacacatcagcttctctatctacttgctgttgccgttgtcattatcctgtttattatcttgctgggagttatcatgcgactcggaccgatg

SEQ ID NO: 13814 - DNA, 203 bp, Homo sapiens
ggcgcgccagtccttgcctccatgcagcagcagctcttctggcctctcttttagatacttacaccttgtcctaccctcttgtgtccgtcgtcagtgaatctctgactcgaaaaggtactcagcttctctatctacttgctgttgccgttgtcattatcctgtttattatcttgctgggagttatcatgcgactcggaccgatg

SEQ ID NO: 13815 - DNA, 203 bp, Homo sapiens
ggcgcgccagtcctgaacgagctgcagtcaagttgaccaagaagcgggactcagttcgagagcctctgtcggatgccagcctggacctgcagacggttatccgcacctcacccagctccctcgtagctttcatcaactcgcgatgcacatctccaggaggctcctacggtcatctctccattggcacccgactcggaccgatg

SEQ ID NO: 13816 - DNA, 203 bp, Homo sapiens
ggcgcgccagtcctgaacctggtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatcaggaagacttaggtcgactcggaccgatg

SEQ ID NO: 13817 - DNA, 203 bp, Homo sapiens
ggcgcgccagtccttgaaaccatgcagtcaagttgaccaagaagcgggcactgtccatctcacctctgtcggatgccagcctggacctgcagacggttatccgcacctcacccagctccctcgtagctttcatcaactcgcgatgcgaccgcagtatcccctcctacggtcatctctccattggcacccgactcggaccgatg

SEQ ID NO: 13818 - DNA, 203 bp, Homo sapiens
ggcgcgccagtcctgcagcctgtgcagtcaagttgaccaagaagcgggcactgtccatctcacctctgtcggatgccagcctggacctgcagacggttatccgcacctcacccagctcgtgatgccaccatttcaactcgcgatgcacatctccaggaggctcctacggtcatctctccattggcacccgactcggaccgatg

SEQ ID NO: 13819 - DNA, 203 bp, Homo sapiens
ggcgcgccagtccttgttatggtgcagtcaagttgaccaagaagcgggcactgtccatctcacctctgtcggatgccagcctggacctgcagacggttatccgcgatagcagtttgctcctcgtagctttcatcaactcgcgatgcacatctccaggaggctcctacggtcatctctccattggcacccgactcggaccgatg

SEQ ID NO: 13820 - DNA, 203 bp, Homo sapiens
ggcgcgccagtcctgtgatctctgcagtcaagttgaccaagaagcgggcactgtccatctcacctctgtcggatgccagcctggacctgcgcttctagtaatagacctcacccagctccctcgtagctttcatcaactcgcgatgcacatctccaggaggctcctacggtcatctctccattggcacccgactcggaccgatg

SEQ ID NO: 13821 - DNA, 203 bp, Homo sapiens
ggcgcgccagtcctgcccgtgatgcagtcaagttgaccaagaagcgggcactgtccatctcacctctgtcggatgcgccagcttgaggtaagacggttatccgcacctcacccagctccctcgtagctttcatcaactcgcgatgcacatctccaggaggctcctacggtcatctctccattggcacccgactcggaccgatg

SEQ ID NO: 13822 - DNA, 203 bp, Homo sapiens
ggcgcgccagtccttgccgacctgcagtctcctcaggccttattaggacacatagttagccctaggtgtgaatatcaagcaggacataacaaggtaggatctctacaatacttggcactagcagcattaataacaccaaaaaagataaagccacctttgcctagtgttacgaaactgacagaggatagcgactcggaccgatg

SEQ ID NO: 13823 - DNA, 203 bp, Homo sapiens
ggcgcgccagtccttttagacgtgcagtgcggagccatgtcagcaagaaggccccgcactcgatccacgctggctccctacggaggcccacctactcgaggcccaccgactcctactgcaatcagtactatgcgatcgtcctagagagtccattcagctgcacttccgcctcagtatggcatcacagccgactcggaccgatg

SEQ ID NO: 13824 - DNA, 203 bp, Homo sapiens
ggcgcgccagtcctaaacatactgcagtgcggagggggcgggaagtccaggccccgcactcgatccacgctggctcaacctctgttagtccctactcgaggcccaccgactcctactgcaatcagtactatgcgatcgtcctagagagtccattcagctgcacttccgcctcagtatggcatcacagccgactcggaccgatg

SEQ ID NO: 13825 - DNA, 203 bp, Homo sapiens
ggcgcgccagtcctgctctatatgcatactttttagagaaaccaaataattttttattgcatacccgtttttaataaaatacattgcataccctcttttaataaaaaatattgcatactttgacgaaacaaattttcgttgcatacccaataaaagattattatattgcatacctcgagactggccgccgactcggaccgatg

SEQ ID NO: 13826 - DNA, 203 bp, Homo sapiens
ggcgcgccagtcctccatgttttgccaggtaacgccaagccagccacccagggcgagtcatcgacccaaaaggtcagaccgtctcacacaaacaatcccaagtaaaggctctgacgtctccccctttttttaggaactgaaaccacggccctgacgtccctcccccctaggaacaggaacagctctcccgactcggaccgatg

SEQ ID NO: 13827 - DNA, 203 bp, Homo sapiens
ggcgcgccagtcctctcagagatgcccctgctctgcactctcaggacaaagttgctcttactccaaaaagatggacccaggtccgaaggggcactgccactgtggggggcatggccatcctccaggtcactgcgggccaccccctggccatggcccagggccctgcgggccacccccccaccatggtccgactcggaccgatg

SEQ ID NO: 13828 - DNA, 203 bp, Homo sapiens
ggcgcgccagtcctagtctacatgcccctgctctgcactctcaggtatcgagattctggctcccaaaaagatggacccaggtccgaaggggcactgccactgtggggggcatggccatcctccaggtcactgcgggccaccccctggccatggcccagggccctgcgggccacccccccaccatggtccgactcggaccgatg

SEQ ID NO: 13829 - DNA, 203 bp, Homo sapiens
ggcgcgccagtcctactgcccttgcccctgctctgcactctcaggtattccctgctctcctgaacaaaagatggacccaggtccgaaggggcactgccactgtggggggcatggccatcctccaggtcactgcgggccaccccctggccatggcccagggccctgcgggccacccccccaccatggtccgactcggaccgatg

SEQ ID NO: 13830 - DNA, 203 bp, Homo sapiens
ggcgcgccagtcctagcagctttgcccctgctctgcactctcaggtattccctgctcttactccaaaaagatggacccaggtccgaaggggcactgccactgtgatacctcgcctagacctccaggtcactgcgggccaccccctggccatggcccagggccctgcgggccacccccccaccatggtccgactcggaccgatg

SEQ ID NO: 13831 - DNA, 203 bp, Homo sapiens
ggcgcgccagtcctataaagtttgcccctgctctgcactctcaggtattccctgctcttactccaaaaagatggacccaggtccgaaggggcactgccactgtggggggcatggccatagaagtatctttgccgggccaccccctggccatggcccagggccctgcgggccacccccccaccatggtccgactcggaccgatg

SEQ ID NO: 13832 - DNA, 203 bp, Homo sapiens
ggcgcgccagtcctggacccattgcccctgctctgcactctcaggtattccctgctcttactccaaaaagatggacccaggtccgaaggggcactgccactgtggggggcatggccatcctccaggtcactgcgggccaccccctggccatggcccagggaaagctcctaggtgcccccaccatggtccgactcggaccgatg

SEQ ID NO: 13833 - DNA, 203 bp, Homo sapiens
ggcgcgccagtcctacttcgaatgccgccatgcaagggctgttctcacacggctactcactgcacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 13834 - DNA, 203 bp, Homo sapiens
ggcgcgccagtcctcaatgggttgccgccatgcagcactacggggtgaacggcacgattgtgcacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 13835 - DNA, 203 bp, Homo sapiens
ggcgcgccagtcctggatgggatgccgccatgcagcactacggggtgaacggctactcactgcacgccatgaactcactcagcgccatgtacaacctgcaccagcaggcagcccagcacttagtttcctaagccgactaccggccttcagtgcatgcgcttacattggctgagcgcctggctgacatccgactcggaccgatg

SEQ ID NO: 13836 - DNA, 203 bp, Homo sapiens
ggcgcgccagtcctacgctttctgccgccatgcagcactacggggtgaacggctactcactgcacgccatgaactcactcagcgccatgtacaacctgcaccagcaggcagcccagcaggcccagcatgcccccgactaccggccttcagtgcatgcgctgggtgcattgcgtagcctggctgacatccgactcggaccgatg

SEQ ID NO: 13837 - DNA, 203 bp, Homo sapiens
ggcgcgccagtcctagccagcatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcagaaattctgggctcgactcggaccgatg

SEQ ID NO: 13838 - DNA, 203 bp, Homo sapiens
ggcgcgccagtcctaggtaacttgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcagtcacggtcagaccgactcggaccgatg

SEQ ID NO: 13839 - DNA, 203 bp, Homo sapiens
ggcgcgccagtccttaacgatatgccgccatgcagcactacggggtgaacggctactcactgcacgccatgaactcactcagcgccatgtacaacctgcaccagcaggcagcccagcaggcccagcatgccctatttgcagatttatcagtgcatgcgcttacattggctgagcgcctggctgacatccgactcggaccgatg

SEQ ID NO: 13840 - DNA, 203 bp, Homo sapiens
ggcgcgccagtcctacaagcgctgccgccatgcagcactacggggtgaacggctactcactgcacgccatgaactcactcagcgccatgtacaacctgcaccaggcaaattagtcagtggcccagcatgcccccgactaccggccttcagtgcatgcgcttacattggctgagcgcctggctggctgtcgactcggaccgatg

SEQ ID NO: 13841 - DNA, 203 bp, Homo sapiens
ggcgcgccagtccttctctgagtgccgccatgcagcactacggggtgaacggctactcactgcacgccatgaactccacagagaaggaaaacaacctgcaccagcaggcagcccagcaggcccagcatgcccccgactaccggccttcagtgcatgcgcttacattggctgagcgcctggctgacatccgactcggaccgatg

SEQ ID NO: 13842 - DNA, 203 bp, Homo sapiens
ggcgcgccagtccttagccgcctgccgccatgcagcactacggggtgaacggctactcactgcacgccatgaactcgagaccaaatcctcacaacctgcaccagcaggcagcccagcaggcccagcatgcccccgactaccggccttcagtgcatgcgcttacattggctgagcgcctggctggctgtcgactcggaccgatg

SEQ ID NO: 13843 - DNA, 203 bp, Homo sapiens
ggcgcgccagtcctcttactagtgccgccatgcagcactacggggtgaacggctactcactggtaaaggctccgcaactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 13844 - DNA, 203 bp, Homo sapiens
ggcgcgccagtcctcctggacatgccgccatgcagcactacggggtgatgcaactggtggcacacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 13845 - DNA, 203 bp, Homo sapiens
ggcgcgccagtcctagattcgttgccggttttgcgacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaacgactcggaccgatg

SEQ ID NO: 13846 - DNA, 203 bp, Homo sapiens
ggcgcgccagtcctcaggtacatgcctgcacaccctatgggtgtgaagccaaacaatggacaaggtgtgaagagccccgtgtgctcgctttgagtcctccggcccctgaatgtggctaaccttaaccctgcagctagagcacgtaaatgtgcagcgcggcagtcgtaatgagcaattgcgggatgggacgactcggaccgatg

SEQ ID NO: 13847 - DNA, 203 bp, Homo sapiens
ggcgcgccagtcctggcacacgtgcctgcacaccctatgggtgtgaagccaaacaatggacaaggtgtgaagagccccgtgtgctcgctttgagtcctccggcccctgaatgtggctaaccttaaccctgcagctagagcacgtaacccaatgtgtatctgccacccgaccatcattgcgggatgggacgactcggaccgatg

SEQ ID NO: 13848 - DNA, 203 bp, Homo sapiens
ggcgcgccagtcctaacgcggctgcctgcacaccctatgggtgtgaagccaaacaatggacaaggtgtgaagagccccgtgtgctcgctttgagtcctccggcccctgaatgtggctagttcacgagtgtgtgctagagcacgtaacccaatgtgtatctagtcgtaatgagcaattgcgggatgggacgactcggaccgatg

SEQ ID NO: 13849 - DNA, 203 bp, Homo sapiens
ggcgcgccagtccttcgatcgttgcctgcacaccctatgggtgtgaagccaaacaatggacaaggtgtgaagagccccgtgtgctcgctttgagtcctccggccgacttggtgactggaccttaaccctgcagctagagcacgtaacccaatgtgtatctagtcgtaatgagcaattgcgggatgggacgactcggaccgatg

SEQ ID NO: 13850 - DNA, 203 bp, Homo sapiens
ggcgcgccagtccttctatgcttgcctgcacaccctatgggtgtgaagccaaacaatggacacaccaaatgtctagccgtgtgctcgctttgagtcctccggcccctgaatgtggctaaccttaaccctgcagctagagcacgtaacccaatgtgtatctagtcgtaatgagcaattgcgggatgggacgactcggaccgatg

SEQ ID NO: 13851 - DNA, 203 bp, Homo sapiens
ggcgcgccagtcctcccatttgtgcctgcacaccgccgtcaatgctgcccaaacaatggacaaggtgtgaagagccccgtgtgctcgctttgagtcctccggcccctgaatgtggctaaccttaaccctgcagctagagcacgtaacccaatgtgtatctagtcgtaatgagcaattgcgggatgggacgactcggaccgatg

SEQ ID NO: 13852 - DNA, 203 bp, Homo sapiens
ggcgcgccagtcctaatctttatgcctgccacttccggctcctgcgtcgctccggaagcctgactagattctctcacttggtaatccagattcggctaggaaaagacaagctttccagagaatgtttcagagaaagttacgtggagcgtgggcgtttcgcagactcctaagagaccttcagagaagaccgactcggaccgatg

SEQ ID NO: 13853 - DNA, 203 bp, Homo sapiens
ggcgcgccagtccttcagtgcctgcctgggcagagggaggtgacgcgcggtgtggggaaagcctttaacttggcctctggcagccgatttaacccgagcgagcaggtctttgctattttcatcatctgtagaaacgggagttgcgaggcggatgagtgactgcaggtcgtccttctgcatctattgagcgactcggaccgatg

SEQ ID NO: 13854 - DNA, 203 bp, Homo sapiens
ggcgcgccagtcctccgccatgtgcctgggcagagggaggtgacgcgcggtgtggggaaagcctttaacttggcctctggcagccgatttaacccgagcgagcaggtctttgctattttcatcatctgtagatggatatcacctccggcggatgagtgactgcaggtcgtccttggtggaaggaaccacgactcggaccgatg

SEQ ID NO: 13855 - DNA, 203 bp, Homo sapiens
ggcgcgccagtcctatacgtcttgcctgggcagagggaggtgacgcgcttcaccacagcctgctttaacttggcctctggcagccgatttaacccgagcgagcaggtctttgctattttcatcatctgtagaaacgggagttgcgaggcggatgagtgactgcaggtcgtccttggtggaaggaaccacgactcggaccgatg

SEQ ID NO: 13856 - DNA, 203 bp, Homo sapiens
ggcgcgccagtcctatggctcctgcctgggcagatatcccactgttttggtgtggggaaagcctttaacttggcctctggcagccgatttaacccgagcgagcaggtctttgctattttcatcatctgtagaaacgggagttgcgaggcggatgagtgactgcaggtcgtccttggtggaaggaaccacgactcggaccgatg

SEQ ID NO: 13857 - DNA, 203 bp, Homo sapiens
ggcgcgccagtccttgggcaactgcgcaccagaaatgcatcctgccttcctcacccaggactggtctgagagggattcatgatggaagcatgttcattctgtgacctggttctcgcctaaatgtggtcaacagtgtcagcagttcagaggacatcaagcccttaccagggcttcccgggattggaaaccgactcggaccgatg

SEQ ID NO: 13858 - DNA, 203 bp, Homo sapiens
ggcgcgccagtcctcaccacaatgcgcaccttccctgtaagagagcttgccagcagagagtgctctgagcactgaaactcagaggagagaatctgtctcccaggtctgctgatagacgtgggtgtgtattgaagaagaacaatctctaaacagagtcaactataactactaactccagagattaccagcgactcggaccgatg

SEQ ID NO: 13859 - DNA, 203 bp, Homo sapiens
ggcgcgccagtccttggcattctgcgcaccttccctgtaagagagcttgccagcagagagtgctctgagcactgaactgattctctagagatctgtctcccaggtctgctgatagacggtaacagaatcaccagaagaacaatctctaaacagagtcaactataactactaactccagagattaccagcgactcggaccgatg

SEQ ID NO: 13860 - DNA, 203 bp, Homo sapiens
ggcgcgccagtcctctcttctatgcgcaccttccgccgtcattcctaagccagcagagagtgctctgagcactgaaactcagaggagagaatctgtctcccaggtctgctgatagacggtaacagaatcaccagaagaacaatctctaaacagagtcaactataactactaactccagagattaccagcgactcggaccgatg

SEQ ID NO: 13861 - DNA, 203 bp, Homo sapiens
ggcgcgccagtcctccacttggtgcgccggagggagggtgggaatgtctgcacgtgggtctgggtgtgagctgtctgagagtctggatgtatggctgtggaagtccaggagcagtggccttgtttgccagcagccggatgcccgggcccactgggcgggcggcccaggaaaaaggggatgagcagactcgactcggaccgatg

SEQ ID NO: 13862 - DNA, 203 bp, Homo sapiens
ggcgcgccagtcctacgtcgcttgcgccggagggttaaaacagtctggtgcacgtgggtctgggtgtgagctgtctgagagtctggatgtatggctgtggaagtccaggagcagtggccttgtttgccagcagccggatgcccgggcccactgggcgggccagtggccgcctgcgggatgagcagactcgactcggaccgatg

SEQ ID NO: 13863 - DNA, 203 bp, Homo sapiens
ggcgcgccagtccttgtaagagtgcgcctgcccccaggctagcgtttggactgttttgttttccagtatgtacgaaggcaggaagattgcacaagtcagggggcgtttccaatcgggtgtcaattttggatctccccccccccacccccctttggatcttgtcgggctttccacgtttcacttaaaaacgactcggaccgatg

SEQ ID NO: 13864 - DNA, 203 bp, Homo sapiens
ggcgcgccagtcctagcgaaactgcgcctgcccccaggctagcgtttggactgttttgtttttggcggaactaccgggcaggaagattgcacaagtcagggggcgtttccaatcgggtgtcaattttggatcgggtaaaatggtggcccctttggatcttgtcgggctttccacgtttcacttaaaaacgactcggaccgatg

SEQ ID NO: 13865 - DNA, 203 bp, Homo sapiens
ggcgcgccagtcctcctagtgatgcgcctgcccccaggctagcgtttggactgttttgtttttggcggaactaccgggcaggaagattgcacaagtcagggggcgtttccaatcgggtgtcaattttggatctccccccccccacccccctttggatcttgtcgggctttccacaggattggagcggccgactcggaccgatg

SEQ ID NO: 13866 - DNA, 203 bp, Homo sapiens
ggcgcgccagtcctccaccctttgcgcctgcccccaggctagcgtttggactgttttgtttttggcggaactaccgggcaggaagattgcacaagtcagggggcgtttccaatcgggtgtcaattttggatctccccccccccacccccctttggatcttgtcgggctttccacgtttcacttaaaaacgactcggaccgatg

SEQ ID NO: 13867 - DNA, 203 bp, Homo sapiens
ggcgcgccagtcctaacaacgttgcgcctgcccccaggctagcgtttggactgttttgtttttggcggaactaccgggcaggaagattgcacaagtcagggggcgtttccaatcgggttaagtgaaatagcttccccccccccacccccctttggatcttgtcgggctttccacgtttcacttaaaaacgactcggaccgatg

SEQ ID NO: 13868 - DNA, 203 bp, Homo sapiens
ggcgcgccagtcctgcatcgattgcggtgcggagactccatgaggcccctcggcgagcttgtctgagtggaggcggcgggcgcaggactcgggtggaagggggccagcttgggggcgaggagtggacccgccacgggagctttgtcaataagcccacgcggggctggctgcatcccaacgacaaagtccgactcggaccgatg

SEQ ID NO: 13869 - DNA, 203 bp, Homo sapiens
ggcgcgccagtccttccactcctgcggtgcggagactccatgaggccctggacatgaacaagctgagtggaggcggcgggcgcaggactcgggtggaagggggccagcttgggggcgaacgtgcttagttatacgggagctttgtcaataagcccacgcggggctggctgcatcccaacgacaaagtccgactcggaccgatg

SEQ ID NO: 13870 - DNA, 203 bp, Homo sapiens
ggcgcgccagtccttaacagcatgcggtgcggagactccatgaggccctggacatgaacaagctgagtggaggcggcgggcgcaggactcgggtggaagggggccagcttgggggcgaggagtggacccgccacgggagctttgtcaataagcccacgcgacttcctgcttcagccaacgacaaagtccgactcggaccgatg

SEQ ID NO: 13871 - DNA, 203 bp, Homo sapiens
ggcgcgccagtcctttccctggtgcggtgcggagactccatgaggccctggacatgaacaagctgagtggaggcggcgggcgcaggactcgggtggaagggggcttatccaatcctagggagtggacccgccacgggagctttgtcaataagcccacgcggggctggctgcatcccaacgacaaagtccgactcggaccgatg

SEQ ID NO: 13872 - DNA, 203 bp, Homo sapiens
ggcgcgccagtcctgtaagcgttgcggtgcggagactccatgaggccctggacatgaacaagggacaatctaagttcgggcgcaggactcgggtggaagggggccagcttgggggcgaggagtggacccgccacgggagctttgtcaataagcccacgcggggctggctgcatcccaacgacaaagtccgactcggaccgatg

SEQ ID NO: 13873 - DNA, 203 bp, Homo sapiens
ggcgcgccagtcctggccacggtgcgtcgccctcggatccgaaacgcaggccaactcgaccacagatgctctgaacgttcttctcatcatcgtggatgacctgcagggtcgagatccttgttatggggataagctggtgaggtccccaaatattgaccaactggcatcccacagcctcctcttccagacgactcggaccgatg

SEQ ID NO: 13874 - DNA, 203 bp, Homo sapiens
ggcgcgccagtcctccggtgtatgcgtcgccctcggatccgaaacgcaggccaactcgaccacagatgctctgaacgttcttctcatcatcgtggatgacctgcgcccctccctgggcgtaacattaatattgctggtgaggtccccaaatattgaccaactggcatcccacagcctcctcttccagacgactcggaccgatg

SEQ ID NO: 13875 - DNA, 203 bp, Homo sapiens
ggcgcgccagtcctgggcatcatgcgtcgccctcggatccgaaacgcaggccaactcgaccacagatgctctgaacgttcttctcatcatcgtggatgacctgcgcccctccctgggctgttatggggataacacacctctcgtatcaaatattgaccaactggcatcccacagcctcctcttccagacgactcggaccgatg

SEQ ID NO: 13876 - DNA, 203 bp, Homo sapiens
ggcgcgccagtccttaccgcagtgcgtcgccctcggatccgaaacgcaggccaactcgaccacagatgctctgaacgttcttctcatcatcgtggatgacctgcgcccctccctgggctgttatggggataagctggtgaggtccccaaatattgaccaaaacctgagtacttacctcctcttccagacgactcggaccgatg

SEQ ID NO: 13877 - DNA, 203 bp, Homo sapiens
ggcgcgccagtcctttgacgcatgcgtcgccctcggatccgaaacgcattgtcgtggtttagcagatgctctgaacgttcttctcatcatcgtggatgacctgcgcccctccctgggctgttatggggataagctggtgaggtccccaaatattgaccaactggcatcccacagcctcctcttccagacgactcggaccgatg

SEQ ID NO: 13878 - DNA, 203 bp, Homo sapiens
ggcgcgccagtccttgcaccggtgctaatatctggagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgcgactcggaccgatg

SEQ ID NO: 13879 - DNA, 203 bp, Homo sapiens
ggcgcgccagtcctacttgggttgctactcctgtcgcgatgaaccacgagtttcattgtggtataaatggaatagcaggtgttgtcaggtacaaggtttgtagcttgccaatatgttcattaccaacactgcagattcccattgagttggtgggggttttgttacctttgttttttttctcagcaaaacgactcggaccgatg

SEQ ID NO: 13880 - DNA, 203 bp, Homo sapiens
ggcgcgccagtcctcgacacagtgctactcctgtgataggtttatcttagtttcattgtggtataaatggaatagcaggtgttgtcaggtacaaggtttgtagccctgtggataccggattaccaacactgcagattcccattgagttggtgggggttttgttacctttgttttttttctcagcaaaacgactcggaccgatg

SEQ ID NO: 13881 - DNA, 203 bp, Homo sapiens
ggcgcgccagtcctgcgcccagtgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttcacctcagctcgggcgactcggaccgatg

SEQ ID NO: 13882 - DNA, 203 bp, Homo sapiens
ggcgcgccagtcctcgcgtggatgctactcctgtgataggtttatcttcccacggccacataataaatggaatagcaggtgttgtcaggtacaaggtttgtagcttgccaatatgttcattaccaacactgcagattcccattgagttggtgggggttttgttacctttgttttttttctcagcaaaacgactcggaccgatg

SEQ ID NO: 13883 - DNA, 203 bp, Homo sapiens
ggcgcgccagtcctgatgccagtgctactgcccccggtggcgaaaaacgggaacagcggggcaaacagtgagtggggttcagcgtagactctggaccaggagaggcccgcggtgaccgaggcctgggccccggaaaccaatagagccatggcgactccctctgctgccttcgaggcccttatgaatggcgactcggaccgatg

SEQ ID NO: 13884 - DNA, 203 bp, Homo sapiens
ggcgcgccagtcctcaccctcttgctactgccccgaacccgcgctgcaaaagggttaccctaaaacagtgagtggggttcagcgtagactctggaccaggagaggcccgcggtgaccgaggcctgggccccggaaaccaatagagccatggcgactccctctgctgccttcgaggcccttatgaatggcgactcggaccgatg

SEQ ID NO: 13885 - DNA, 203 bp, Homo sapiens
ggcgcgccagtcctcccgagcttgcttcaacacccaggccaggtctctgcctcggaagaagaaggtgtcaaccaattccagaacaagcacctctgccaccggatgtcctctgcgctggaatcagtcactgtcagcgacagacccctcggggtgtccatcacaaaagccgaggtagcccctgaagaagacgactcggaccgatg

SEQ ID NO: 13886 - DNA, 203 bp, Homo sapiens
ggcgcgccagtcctctatgccttgcttcaacacccaggccaggtctctgcctcggaagaagagctgaggtttgccatccagaacaagcacctctgccaccggatgtcctctgcgctggaatcagtcactgtcagcgacagaccccttctaaacgttcattcaaaagccgaggtagcccctgaagaagacgactcggaccgatg

SEQ ID NO: 13887 - DNA, 203 bp, Homo sapiens
ggcgcgccagtcctatgtgagatgcttcaacaccgccaaatacgaatagcctcggaagaagagctgaggtttgccatccagaacaagcacctctgccaccggatgtcctctgcgctggaatcagtcactgtcagcgacagacccctcggggtgtccatcacaaaagccgaggtagcccctgaagaagacgactcggaccgatg

SEQ ID NO: 13888 - DNA, 203 bp, Homo sapiens
ggcgcgccagtcctctttggcgtggagtcaggaactaaagaatagtgctgttagcttgctcaatgccacagccatagcagtagctgagggcgggatcttccacttagaagtagtacaaggagcttgtagagctattcgccacatacctagaagaataagacagggcttggaaaggattttgctataagcgactcggaccgatg

SEQ ID NO: 13889 - DNA, 203 bp, Homo sapiens
ggcgcgccagtcctaattcgtttggagtcaggaagatgcttccctatgtgttagcttgctcaatgccacagccatagcagtagctgaggggacagatagggttatagaagtagtacaaggagcttgtagagctattcgccacatacctagaagaataagacagggcttggaaaggattttgctataagcgactcggaccgatg

SEQ ID NO: 13890 - DNA, 203 bp, Homo sapiens
ggcgcgccagtcctctatagcctggataattttccgtgaaactggatgatctttgaatattaaatgaaaggagactagaataacagtctcttgactattcatgagtactaaagtctgagagcattctttcttggtgtgcaaatcacgcctggcagcccctgcccacagtacccgaagatggcaggcctcgactcggaccgatg

SEQ ID NO: 13891 - DNA, 203 bp, Homo sapiens
ggcgcgccagtcctatagtgcttggatcctaggcgattttggttacgcccggcgccgtgggcttttctgtttggacaacatcaaaaacatccattgcacaatggggcagttcattagcttcatgcaagaaataccaacctttttgcaggaggctctgaacattgctcttgttgcagtcagtctcattgcgactcggaccgatg

SEQ ID NO: 13892 - DNA, 203 bp, Homo sapiens
ggcgcgccagtcctatcgggtctggatcctaggcgattttggttacgctataattgtaactgttttctgtttggacaacatcaaaaacatccattgcacaatggggcagttcattagcccatctaggttgggaccaacctttttgcaggaggctctgaacattgctcttgttgcagtcagtctcattgcgactcggaccgatg

SEQ ID NO: 13893 - DNA, 203 bp, Homo sapiens
ggcgcgccagtcctcctggcgttggatcctaggcgattttggttacgctataattgtaactgttttctgtttggacaacatcaaaaacatccattgcacaatggggcagttcattagcttcatgcaagaaataccaacctttttgctaacccaaagtggtattgctcttgttgcagtcagtctcattgcgactcggaccgatg

SEQ ID NO: 13894 - DNA, 203 bp, Homo sapiens
ggcgcgccagtcctaccggtgctggatcctaggcgtaactagatcaagttttgctgagtaaaattttaaacacattgagtatccgtgcaagacagcgcagagctccccacaatgggcaactgcaataagcctcccaagaggcctcccaacacacaaacatataggtgaagcgagtcagcagagttcagcgactcggaccgatg

SEQ ID NO: 13895 - DNA, 203 bp, Homo sapiens
ggcgcgccagtcctgttgtaactggatcctaggcgtaactagatcaagttttgctgagtaaaattttaaacacattgagtatccgtgcaagacagcgcagagctccccacaatgggcaactgcaataagcctcccaagaggcctcccaacacacaaacatcatccaaccaaccctcagcagagttcagcgactcggaccgatg

SEQ ID NO: 13896 - DNA, 203 bp, Homo sapiens
ggcgcgccagtcctatggtgagtggatcctaggcgtaactagatcaagttttgctgagtaaaattttaaacacattgagtatccgtgcaagacagcgcagagctccccacaatgggcacgcagtcatccgtacccaagaggcctcccaacacacaaacatcatccaaccaaccctcagcagagttcagcgactcggaccgatg

SEQ ID NO: 13897 - DNA, 203 bp, Homo sapiens
ggcgcgccagtcctgggctccctggatcctaggcgtaactagatcaagttttgctgagtaaaattttaaacacattgagtatccgtgcaagacagcgcagagctttgactgtgatcatactgcaataagcctcccaagaggcctcccaacacacaaacatcatccaaccaaccctcagcagagttcagcgactcggaccgatg

SEQ ID NO: 13898 - DNA, 203 bp, Homo sapiens
ggcgcgccagtcctgcccgctttggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacatcaacaaagccaaacgactcggaccgatg

SEQ ID NO: 13899 - DNA, 203 bp, Homo sapiens
ggcgcgccagtccttgaccgaatggcacaaagggactgttttcttactcttagtctgagtgactgccaaggaaggcaaaggtagagcaactggatctctggctctccacatagcttctgatctcagaccttactaaaatgctttctgggcccaaggacaacatcgtagacggacaatgattttgagtccgactcggaccgatg

SEQ ID NO: 13900 - DNA, 203 bp, Homo sapiens
ggcgcgccagtcctaggcgtactggcaccctgaccatggaaccctgaagtggcagtgacttctagagctcagtggcagaccccacgaccctcttcgagccttcctccccctcccaccaccagctttcaagctcccagagggaggggtggggaggggatcctgatctcacagggcagggggcttccatccgactcggaccgatg

SEQ ID NO: 13901 - DNA, 203 bp, Homo sapiens
ggcgcgccagtcctgacggcggtggcaccctgaccatggaaccctgaagtggcagtgacttctagagctcagtggcagaccccacgacccttcctcccccttcctccccctcccaccaccagctttcaagctttattttaagcacctggggaggggatcctgatctcacagggcagggggcttccatccgactcggaccgatg

SEQ ID NO: 13902 - DNA, 203 bp, Homo sapiens
ggcgcgccagtccttccgacggtggcaccctgacggctattgagattcgtggcagtgacttctagagctcagtggcagaccccacgacccttcctcccccttcctccccctcccaccaccagctttcaagctcccagagggaggggtggggaggggatcctgatctcacagggcagggggcttccatccgactcggaccgatg

SEQ ID NO: 13903 - DNA, 203 bp, Homo sapiens
ggcgcgccagtcctgcccttagtggcggcgaacgcacttccggcgtgtgtccttacgggtgcgtccgggcggctgcttgcaggtgccacccagcgggttccagcttgtttgctgcataacaacgtttctaactggcgggcaaggggtccggctggagccgggcggctctcctccagctccttctcggccgactcggaccgatg

SEQ ID NO: 13904 - DNA, 203 bp, Homo sapiens
ggcgcgccagtcctaactcctatggcggcgaacgcacttccggcgtgtgtccttacgggtgcgtccgggcggctgcttgcaggtgccacccagcgggttccagcttgtttgctgcatagattacaacggtgatggcgggcaagcgggtttctgcccaaacggcggctctcctccagctccttctcggccgactcggaccgatg

SEQ ID NO: 13905 - DNA, 203 bp, Homo sapiens
ggcgcgccagtcctgccgccactggcggcgaacgcacttccggcgtgtgtccttacgggtgctgggacaatcggctttgcaggtgccacccagcgggttccagcttgtttgctgcatagattacaacggtgatggcgggcaaggggtccggctggagccgggcggctctcctccagctccttctcggccgactcggaccgatg

SEQ ID NO: 13906 - DNA, 203 bp, Homo sapiens
ggcgcgccagtcctccaacggctggctaacgccaatcacgtgggagcctgaacaaggtgtgaagagcctattgagctacataagaatcctccggcccctgaatgcggctaatcccaacctcggagcaggtggtcacaaaccagtgattggcctgtcgtaacgcgcaagtccgtggcggaaccgactaccgactcggaccgatg

SEQ ID NO: 13907 - DNA, 203 bp, Homo sapiens
ggcgcgccagtcctggtttcggtggctaacgccatgggacgctagttgtgaacaaggtgtgaagagcctattgagctacataagaatcctccggcccctgaatgaaaggtgattgtctctcggagcaggtggtcacaaaccagtgattggcctgtcgtaacgcgcaagtccgtggcggaaccgactaccgactcggaccgatg

SEQ ID NO: 13908 - DNA, 203 bp, Homo sapiens
ggcgcgccagtcctttattcggtggctaacgccatgggacgctagttgtgaacaaggtgtgaagagcctattgagctacataagaatcctccggcccctgaatgcggctaatcccaacctcggagcaggtggcatttctttgaaccttggcctgtcgtaacgcgcaagtccgtggcggaaccgactaccgactcggaccgatg

SEQ ID NO: 13909 - DNA, 203 bp, Homo sapiens
ggcgcgccagtccttagtaatgtggctaacgccatgggacgctagttgtgaacaaggtgtgaccccaggtcgactatacataagaatcctccggcccctgaatgcggctaatcccaacctcggagcaggtggtcacaaaccagtgattggcctgtcgtaacgcgcaagtccgtggcggaaccgactaccgactcggaccgatg

SEQ ID NO: 13910 - DNA, 203 bp, Homo sapiens
ggcgcgccagtcctcagcgctatggctgcttatgagttgtccttatagttgttatcataaagcgaattggattggccatccggtgaaagtgagactcattatctatctgtttgctggatccgctccattgagtgtgtttactctaagtacaatttcaacagttatttcaatcagacaattgtatcatacgactcggaccgatg

SEQ ID NO: 13911 - DNA, 203 bp, Homo sapiens
ggcgcgccagtccttctcagtctggctgcttatggtgacaatcaaaaagttgttaccatatagctattggattggccatccggtgtgcaacagggcaattgtttacctatttattggttttgtaccattatcgaaattacggtacctcactctcaaattcattttgaccctcaacacaatcaaacatgcgactcggaccgatg

SEQ ID NO: 13912 - DNA, 203 bp, Homo sapiens
ggcgcgccagtccttctagcactggctgcttatggtgacaatcaaaaagttgttaccatatagctattggattggccatccggtgtgcaagtatcattaacaaaacctatttattggttttgtaccattatcactgaagtctgtgatcactctcaaattcattttgaccctcaacacaatcaaacatgcgactcggaccgatg

SEQ ID NO: 13913 - DNA, 203 bp, Homo sapiens
ggcgcgccagtcctgagcggcatggctgcttatggtgacaatcacagattgttatcataaagcgaattggattggccatccggtgaaagtatattcagacccagatctgtttgctggatccgctccattgagtgtgtttactctaagtacaatttcaacagttatttcaatcagacaattgtatcatacgactcggaccgatg

SEQ ID NO: 13914 - DNA, 203 bp, Homo sapiens
ggcgcgccagtcctggagccgctggctgcttatggtgacaatcacagattgttatcataaagcgaattggattggccatccggtgaaagtgagactcattatctatctgtttgctggatccgctccattgagtgtgtttactctaatactgcggagtttcgttatttcaatcagacaattgtatcatacgactcggaccgatg

SEQ ID NO: 13915 - DNA, 203 bp, Homo sapiens
ggcgcgccagtcctggcccttatggctgcttatgtctgtgcggcgggggttgttaccatatagctattggattggccatccggtgtgcaacagggcaattgtttacctatttattggttttgtaccattatcactgaagtctgtgatcactctcaaattcattttgaccctcaacacaatcaaacatgcgactcggaccgatg

SEQ ID NO: 13916 - DNA, 203 bp, Homo sapiens
ggcgcgccagtcctgctaagtatggctgtggcacacccaccggtggcacacccctccctcgggtccagttcagcccacagactcctgggacagtgaaggcactaccagcctctcctttgaggagtgttgcagcctttctgtgtgccagatgcctagtgaagaaaagctgaaaccctggagctttgtgccgactcggaccgatg

SEQ ID NO: 13917 - DNA, 203 bp, Homo sapiens
ggcgcgccagtccttctctagttggctgtggcacacccaccggtggcacacccctccctcgggtccagttcagccctacagtgggcttttggagagccagggccccagcctctcctttgaggagtgttgcagcctttctgtgtgccagatgcctagtgaagaaaagctgaaaccctggagctttgtgccgactcggaccgatg

SEQ ID NO: 13918 - DNA, 203 bp, Homo sapiens
ggcgcgccagtcctgttctaggtggctgtggcacacccaccggtggcacacccctccctcggtcgagtcatcatatacagactcctgggaggagagccagggccccagcctctcctttgaggagtgttgcagcctttctgtgtgccagatgcctagtgaagaaaagctgaaaccctggagctttgtgccgactcggaccgatg

SEQ ID NO: 13919 - DNA, 203 bp, Homo sapiens
ggcgcgccagtcctatgcattttggctgtggcaccagacagaagcagccacccctccctcgggtccagttcagcccacagactcctgggaggagagccagggccccagcctctcctttgaggagtgttgcagcctttctgtgtgccagatgcctagtgaagaaaagctgaaaccctggagctttgtgccgactcggaccgatg

SEQ ID NO: 13920 - DNA, 203 bp, Homo sapiens
ggcgcgccagtcctcattctcatgggacgccatcaataacaattggctctgtctctctcaccattgcaacagtatgcttcctcatgcagattgccatcctggtaactactgtgacattgcattttaagcaacatgagtgcgactcccccgcgagcaaccaagtaatgccgtgtgaaccaataataatacgactcggaccgatg

SEQ ID NO: 13921 - DNA, 203 bp, Homo sapiens
ggcgcgccagtccttgtaattatgggcgacagggccagcagtctcctcacagtgatcggatataagagtactgaggaccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 13922 - DNA, 203 bp, Homo sapiens
ggcgcgccagtcctcacagttctgggcgacagggccagcagtctcctctttacagaaaagagggcctcagacagataccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 13923 - DNA, 203 bp, Homo sapiens
ggcgcgccagtcctaagaatgctgggcgacagggccagcagtctcctctttacagaaaagagtaagagtactgaggaccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 13924 - DNA, 203 bp, Homo sapiens
ggcgcgccagtcctgctgttaatgggcgacaggggggaggtatgatgttttacagaaaagagtaagagtactgaggaccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 13925 - DNA, 203 bp, Homo sapiens
ggcgcgccagtcctaaatcgactggggagggggactgttttgtaacatccacgcagtacaccccaatctcccagttcatttcctaatccttaaactccggtttcaaactccctcgctttgctcttcagttgcaggttccgatctttgggtactccaggagctgttctatagcccctgcttctggacctcgactcggaccgatg

SEQ ID NO: 13926 - DNA, 203 bp, Homo sapiens
ggcgcgccagtcctgcgggtggtggggagggggagaacaagtattatcccacgcagtacaccccaatctcccagttcatttcctaatccttaaactccggtttcaaactccctcgctttgctcttcagttgcaggttccgatctttgggtactccaggagctgttctatagcccctgcttctggacctcgactcggaccgatg

SEQ ID NO: 13927 - DNA, 203 bp, Homo sapiens
ggcgcgccagtcctgcagtgagtggggagggggagaacaagtattatcccacgcagtacaccccaatctcccagttcatttcctaatccttaaactccggtttcaaactccctcgctttgctcttcagttgcaggttccgatctttgggtactccaggagctgttctatagcccgactgggacagtgacgactcggaccgatg

SEQ ID NO: 13928 - DNA, 203 bp, Homo sapiens
ggcgcgccagtcctcagcgtattggggagggggagaacaagtattatcccacgcagtacaccgagcggcatggaggcatttcctaatccttaaactccggtttcaaactccctcgctttgctcttcagttgcaggttccgatctttgggtactccaggagctgttctatagcccctgcttctggacctcgactcggaccgatg

SEQ ID NO: 13929 - DNA, 203 bp, Homo sapiens
ggcgcgccagtcctcaccaaggtggggcgatcctaccctgttcctccgcttcttcgttgggcgcatctcctggaactgggccgcgtccccgccgcctttccgtcatttcttcagatagctccccagctgtggaaaatgagcatcctcaagagaccccagaatccaacaatagcgtgtatacttccttccgactcggaccgatg

SEQ ID NO: 13930 - DNA, 203 bp, Homo sapiens
ggcgcgccagtcctttgtcacctggggtttcggtggtgaaaaaagtttttccccggggtctgggggtgacattgcaccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 13931 - DNA, 203 bp, Homo sapiens
ggcgcgccagtcctaacggccctggggtttcggttcccccccttccccgcttatccacgtacggggtgacattgcaccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 13932 - DNA, 203 bp, Homo sapiens
ggcgcgccagtcctgaggtcattggggtttcggttcccccccttccccttccccggggtctgattcgacgtcattgccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 13933 - DNA, 203 bp, Homo sapiens
ggcgcgccagtccttcctttgctggggtttcggttcccccccttccccttccccggggtctgggggtgacattgcaccgcgcccctcgtggggtcgcgttgccaccccacgcggactccccagctcgcgcgcccctcccatttgccacaaaactgttataccccaccccccttcccacctgaccagcccgactcggaccgatg

SEQ ID NO: 13934 - DNA, 203 bp, Homo sapiens
ggcgcgccagtcctaattacggtggggtttcggttcccccccttccccttccccggggtctgggggtgacattgcaccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 13935 - DNA, 203 bp, Homo sapiens
ggcgcgccagtcctggttcccttggggtttcggttcccccccttccccttccccggggtctgggggtgacattgcaccgcgcccctcgtggggtcgcgttgccattgatacgttctcgcccagctcgcgcgcccctcccatttgcctgtcctggtcaggcccccaccccccttcccacctgaccagcccgactcggaccgatg

SEQ ID NO: 13936 - DNA, 203 bp, Homo sapiens
ggcgcgccagtcctgagagttttggggtttcggttcccccccttccccttccccggggtctgggggtgacattgcagacgtgggggatcagggtcgcgttgccaccccacgcggactccccagctcgcgcgcccctcccatttgcctgtcctggtcaggcccccaccccccttcccacctgaccagcccgactcggaccgatg

SEQ ID NO: 13937 - DNA, 203 bp, Homo sapiens
ggcgcgccagtccttgctatcttgggtctagacaacttgatcattataaggctggtttgcatggatccaagaccataaatctaggatcctttacaatctcagaccctggtgcaaggttatatatagagcccaattctcctaattaaacagtgtctcaggttgacaaatggacaagttggatctagtcacgactcggaccgatg

SEQ ID NO: 13938 - DNA, 203 bp, Homo sapiens
ggcgcgccagtcctttcaaagttggtaacaggttaatactagcatacagagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 13939 - DNA, 203 bp, Homo sapiens
ggcgcgccagtcctggtaacactggtaacaggttccagggtaacagagacattcatcatcaactgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 13940 - DNA, 203 bp, Homo sapiens
ggcgcgccagtcctcgaacttatggtaacaggttccagggtaacagaggagggagctgggtcctgtttactcccagtcctgccgatgaggattctgaccgtagacactgaattgtcccgtacctatccgtgcagacatccacaatccaccagggctgagctcgaactgccacctctgccagcaggacccgactcggaccgatg

SEQ ID NO: 13941 - DNA, 203 bp, Homo sapiens
ggcgcgccagtcctccggcacttggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctaacaatctgccgtgcgactcggaccgatg

SEQ ID NO: 13942 - DNA, 203 bp, Homo sapiens
ggcgcgccagtcctggtcggaatggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 13943 - DNA, 203 bp, Homo sapiens
ggcgcgccagtcctgaggctgttggtaacaggttccagggtaacagaggagggagctgggtcctgtttactcccagtcctgccgatgaggattctgaccgtagattggtcgcgtataggtacctatccgtgctctttctgtgttctcaccagggctgagctcgaactgccacctctgccagcaggacccgactcggaccgatg

SEQ ID NO: 13944 - DNA, 203 bp, Homo sapiens
ggcgcgccagtcctgacatcgatggtattttttgggcctcgtgcttcgtggtgggagacccaggtcgaggtccgggtggggccggtgaggccgaataaaagcaaaggtgttggctcgggcctcttcgcgtggccggtgacgccttggctcccccgcaggtccggccgtagcacctccgcgccgtcgcccgactcggaccgatg

SEQ ID NO: 13945 - DNA, 203 bp, Homo sapiens
ggcgcgccagtcctcctctccgtggtattttttgggcctcgtgcttcgtggtgggagacccaggtcgaggtccgggtggggccggtgaggggttgggcgtcgggaggtgttggctcgggcctcttcgcgtggccggtgacgccttggctcccccgcaggttttatacatatcaatccgcgccgtcgcccgactcggaccgatg

SEQ ID NO: 13946 - DNA, 203 bp, Homo sapiens
ggcgcgccagtcctcctacgcatggtattttttgggcctcgtgcttcgtggtgggagacccaggtcgaggtccgggtggggccggtgaggggttgggcgtcgggaggtgttggctcggtaggacgtcttcatccggtgacgccttggctcccccgcaggtccggccgtagcacctccgcgccgtcgcccgactcggaccgatg

SEQ ID NO: 13947 - DNA, 203 bp, Homo sapiens
ggcgcgccagtcctattagaaatggtggggcgtcgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 13948 - DNA, 203 bp, Homo sapiens
ggcgcgccagtcctagaattgctggttcattagcaagcccagtgtttacagcacctctcacatccaggacgaccccatcctggcgctcactcttagtagtatggcttagtacgcattaggtggtaagccgagctctccctcggccttgttctgaatgcacacatgtctaggggctaaggatgtcctaccgactcggaccgatg

SEQ ID NO: 13949 - DNA, 203 bp, Homo sapiens
ggcgcgccagtcctccctcaagtggttttaacaggggtcctttcttggataaacccgctcaatgcccggagatttgggcgtgcccccgcgagactgctagccgagtagtgttgggtcgcgaaaggccttgtggtactgcctgatagggtgcttgcgagtgccccgggaggtctcgtagaccgtgcacccgactcggaccgatg

SEQ ID NO: 13950 - DNA, 203 bp, Homo sapiens
ggcgcgccagtccttacttctttgtaaggcccacctcatggtaaatcgaggtacccgcaggtaacaagagacactgtggatctgatctggggccacctacctctatcctggtgaggtggttaaaaaacgtctagtgggccaaacccaggggggatccctggtttccttattttagtgtaaatgtcattcgactcggaccgatg

SEQ ID NO: 13951 - DNA, 203 bp, Homo sapiens
ggcgcgccagtccttcccgaggtgtaaggcccacgaaggatgcccagaaggtacccgcaggtaacaagagacactgattcgtgaccagctggccacctacctctatcctggtgaggtggttaaaaaacgtctagtgggccaaacccaggggggatccctggtttccttattttagtgtaaatgtcattcgactcggaccgatg

SEQ ID NO: 13952 - DNA, 203 bp, Homo sapiens
ggcgcgccagtccttctgcatttgtaaggcccacgaaggatgcccagaaggtacccgcaggtaacaagagacactgtggatctgatctggggccacctacctctatcctggtgaggtggttaaaaaacgtctagtgggccaaacccaggggggatccctggtttccttattttaccagcgcacgttcccgactcggaccgatg

SEQ ID NO: 13953 - DNA, 203 bp, Homo sapiens
ggcgcgccagtcctgttcatactgtaaggcccacgaaggatgcccagaaggtacccgcaggttgtgtagagtcgattggatctgatctggggccacctacctctatcctggtgaggtggttaaaaaacgtctagtgggccaaacccaggggggatccctggtttccttattttagtgtaaatgtcattcgactcggaccgatg

SEQ ID NO: 13954 - DNA, 203 bp, Homo sapiens
ggcgcgccagtcctggacgttctgtaggcgcttatacagattttattatcttttccatcagattcatcatcaacagcatggaagcgagaaaccaaacagctatttcaaaattccttctcctgggactgatagaggatccggaactgcagcccgtccttttcagcctgttcctgtccatgtacttggtccgactcggaccgatg

SEQ ID NO: 13955 - DNA, 203 bp, Homo sapiens
ggcgcgccagtcctagtggccatgtcagagtgtctgggaagctcaaagccaaagtcctaatgtgcagtcaggtgaatttattgaaaaatttgaggctcctggtggtgcaaatcaaagaactgctcctcagtggatgttgcctttacttctaggcctgtacggaagtgttacttctgctctaaaagcttcgactcggaccgatg

SEQ ID NO: 13956 - DNA, 203 bp, Homo sapiens
ggcgcgccagtccttcgtatgttgtccatcgttaaaacgggatggggagctggaccaggtgacagcggcatggacatatgccccaggctttcctgctggggtccatccatgagcctgcaggtgccctcatggagccccagccctgccctggaagcttggctgagagcttcctggaggaggagcttcggcgactcggaccgatg

SEQ ID NO: 13957 - DNA, 203 bp, Homo sapiens
ggcgcgccagtcctagaaagactgtcccatttatccgtcaggtgacactatcctaaaggcagaagccttcaggtctgacccagccaatcaaagcattataccagaccatggaatgcataccaaacattattgacactaatgacacaagcccccttaaggcagaaaaaccaagagaacaataggccagacgactcggaccgatg

SEQ ID NO: 13958 - DNA, 203 bp, Homo sapiens
ggcgcgccagtcctactaacattgtcccatttatccgtcaggtgacactatcctaaaggcagaagccttcaggtctgacccagccaatcaaagcattataccagaccatggaatgcataccaaacattattgacactaatgacacacaaaattggttttaagaaaaaccaagagtgggtcgtttatctcgactcggaccgatg

SEQ ID NO: 13959 - DNA, 203 bp, Homo sapiens
ggcgcgccagtcctgacccaactgtcccatttatccgtcaggtgacactatcctaaaggcagaagccttcaggtctgacccagccaatcaaagcattataccagaccatggaatgcataccaaacattattgacactaatgacacacaaaattggttttatacgcctgtgcccaaacaataggccagacgactcggaccgatg

SEQ ID NO: 13960 - DNA, 203 bp, Homo sapiens
ggcgcgccagtcctcactttcctgtctgtggtaagtaggcagcctccagacagtttcttccgcttcctgtaccacccggctcaagtagcggaaggcctcagacctcctatcagcccgtcggcctccgggccctgcattctctagccatggaccgggaccttttgcggcagtcgctaaattgccacgggcgactcggaccgatg

SEQ ID NO: 13961 - DNA, 203 bp, Homo sapiens
ggcgcgccagtcctgagtgacgtgtctgtggtaagtaggcagcctccagacagtttcttccgcttcctgtaccacccggctcaagtagcggacacggaacagggaactatcagcccgtcggcctccgggccctgcattctctagccatggaccgggaccttttgcggcagtcgctaaattgccacgggcgactcggaccgatg

SEQ ID NO: 13962 - DNA, 203 bp, Homo sapiens
ggcgcgccagtccttggccctatgtctgtgtactgtgattgattataggacagtttcttccgcttcctgtaccacccggctcaagtagcggacacggaacagggaactatcagcccgtcggcctccgggccctgcattctctagccatggaccgggaccttttgcggcagtcgctaaattgccacgggcgactcggaccgatg

SEQ ID NO: 13963 - DNA, 203 bp, Homo sapiens
ggcgcgccagtccttttgagtgtgtctgtgtacttccggcagcctccagacagtttcttccgcttcctgtaccacccggctcaagtagcggacacggaacagggaactatcagcccgtcggcctccgggccctgcattctctagccatggaccgggaccttttgcggcagtcgcgcccagaatggtcacgactcggaccgatg

SEQ ID NO: 13964 - DNA, 203 bp, Homo sapiens
ggcgcgccagtccttcgggctttgtctgtgtacttccggcagcctccagacagtttcttccgcttcctgtaccacccggctcaagtagcggacacggaacagggaactatcagcccgtcggcctccgggccctgcattctctagccatggaccgggaccttttgcggcagtcgctaaattgccacgggcgactcggaccgatg

SEQ ID NO: 13965 - DNA, 203 bp, Homo sapiens
ggcgcgccagtccttgccacactgtctgtgtacttccggcagcctccagacagtttcttccgcttcctgtaccacccggctcaagtagcggacacggaacagggcctagggcagggtacggcctccgggccctgcattctctagccatggaccgggaccttttgcggcagtcgctaaattgccacgggcgactcggaccgatg

SEQ ID NO: 13966 - DNA, 203 bp, Homo sapiens
ggcgcgccagtcctaggatgcctgtctgtgtacttccggcagcctccagacagtttcttccgcttcctgtaccaccgccgggtttgtattgacacggaacagggaactatcagcccgtcggcctccgggccctgcattctctagccatggaccgggaccttttgcggcagtcgctaaattgccacgggcgactcggaccgatg

SEQ ID NO: 13967 - DNA, 203 bp, Homo sapiens
ggcgcgccagtccttgtattcctgtgagcatgagaccagtcttcaatgttagatcttgtttatttgtagtttccttttcaagtcagtggatctcagcgatgtacgctcaatgattccaatttttctgttcttgccttcaggttgtctattacactttcatgtcctctggacttaactctgtttcccatcgactcggaccgatg

SEQ ID NO: 13968 - DNA, 203 bp, Homo sapiens
ggcgcgccagtcctggagatcgtgtgagcatgaggtaccctgctctacttagatcttgtttatttgtagtttccttggttgtgacaatagtctcagcgatgtacgctcaatgattccaatttttctgttcttgccttcaggttgtctattacactttcatgtcctctggacttaactctgtttcccatcgactcggaccgatg

SEQ ID NO: 13969 - DNA, 203 bp, Homo sapiens
ggcgcgccagtccttgtccggttgtgagcatgaggtaccctgctctacttagatcttgtttatttgtagtttccttttcaagtcagtggatctcagcgatgtacgctcaatgattccaatttttctgttcttgccttcaggttgtcagcacgtagcagcagtcctctggacttaactctgtttcccatcgactcggaccgatg

SEQ ID NO: 13970 - DNA, 203 bp, Homo sapiens
ggcgcgccagtcctagaggtcctgtgagcatgaggtaccctgctctacttagatcttgtttatttgtagtttccttttcaagtcagtggatctcagcgatgtacgctcaatgattccaatttttctgttcttgccttcaggttgtctattacactttcatgtcctctggacttaactctgtttcccatcgactcggaccgatg

SEQ ID NO: 13971 - DNA, 203 bp, Homo sapiens
ggcgcgccagtcctcgttgtgttgtgagcatgaggtaccctgctctacttagatcttgtttatttgtagtttccttttcaagtcagtggatctcagcgatgtacgctcaatgattccacgcccctccacgccgccttcaggttgtctattacactttcatgtcctctggacttaactctgtttcccatcgactcggaccgatg

SEQ ID NO: 13972 - DNA, 203 bp, Homo sapiens
ggcgcgccagtcctccctgccgtgtgatcttattaaaattaggttaaatttcgaggttaaaaatagttttaatattatacgttagaatctggtcttgtatatttatacttaccacacaagatggaccggagcagccctccaatatctagtgtaccctcgtgctcgctcaaacattaagtggtgttgtgcgactcggaccgatg

SEQ ID NO: 13973 - DNA, 203 bp, Homo sapiens
ggcgcgccagtcctcgacggcatgtgatcttattaaaattaggttaaatttcgaggttaaaaatagttttaatattgctatagtcttagaggtcttgtatattttgctaactgcttacagatggaccggagcagccctccaatatctagtgtaccctcgtgctcgctcaaacattaagtggtgttgtgcgactcggaccgatg

SEQ ID NO: 13974 - DNA, 203 bp, Homo sapiens
ggcgcgccagtcctataccggctgtgcagacatcctaatacatagcacttatttctcttgctttacggcaggtgaagtaagaagagccatcagaggggaaaagttattgtcctgctgcaactatccccaagctcataaagcacaggtaccatcacttcaatacctagccctagttcgttattgtttgccgactcggaccgatg

SEQ ID NO: 13975 - DNA, 203 bp, Homo sapiens
ggcgcgccagtcctgagacgaatgtggattccatgcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagcccgactcggaccgatg

SEQ ID NO: 13976 - DNA, 203 bp, Homo sapiens
ggcgcgccagtcctccaatctctgtgtattgtgtcgcgcgataaaggttagcatcgaatatcgttggagaattccaaattctacctgtgctaaccagattgaccatcacttgagtcatagtgcatgtagcgggagaccctatgggcgtgtctcaatttttatcgattattaagaaaaaacaggccagacgactcggaccgatg

SEQ ID NO: 13977 - DNA, 203 bp, Homo sapiens
ggcgcgccagtcctgttggcattgtgtattgtgtttatattatggaactagcatcgaatatcgttggagaattccaaattctacctgtgcgtggactcaaacgaatcacttgagtcatagtgcatgtagcgggagaccctatgggcgtgtctcaatttttatcgattattaagaaaaaacaggccagacgactcggaccgatg

SEQ ID NO: 13978 - DNA, 203 bp, Homo sapiens
ggcgcgccagtcctgtaagacatgtgtattgtgtttatattatggaactagcatcgaatatcgttggagaattccaaattctacctgtgctaaccagattgaccatcacttgagtcatagtgcatgtagcgggagaccctatgggcgtgtctcaatttttatcgattattaagagtggcagcaaagtccgactcggaccgatg

SEQ ID NO: 13979 - DNA, 203 bp, Homo sapiens
ggcgcgccagtcctcccttgcatgtgtattgtgtttatattatggaactagcatcgaatatcgttggagaattccatggcaccgactacgtaaccagattgaccatcacttgagtcatagtgcatgtagcgggagaccctatgggcgtgtctcaatttttatcgattattaagaaaaaacaggccagacgactcggaccgatg

SEQ ID NO: 13980 - DNA, 203 bp, Homo sapiens
ggcgcgccagtccttagaactatgttatctcggagttcggtgtcttttgacctgctgttgactgctcccagggggccctgacgccctggggcacttttgctctgcacaggaccacgctggggtttgccatggtgacataaaggggtgtagaggaaggaaggagcaagaccagcctgtagactgtgccccgactcggaccgatg

SEQ ID NO: 13981 - DNA, 203 bp, Homo sapiens
ggcgcgccagtcctgaatcctctgtttcatttcaggaagatatatgcgtcaggaaaatttctatcttcttttgtattatcaaggagatatttggagcagagtcatttgctaagaagggataaaataaaaaatggcatattcttggcaaacggatccaaatcctaatgaatcacacgaaaagcagtatgcgactcggaccgatg

SEQ ID NO: 13982 - DNA, 203 bp, Homo sapiens
ggcgcgccagtcctcttatgtgtgtttctggaaacatgatttgtttgatgtgttcaagattcagaccagtgtttcaagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 13983 - DNA, 203 bp, Homo sapiens
ggcgcgccagtcctaatcgtgttgtttctggaaattgacaaccgccagaccccgaggtcccgagaccagtgtttcaagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 13984 - DNA, 203 bp, Homo sapiens
ggcgcgccagtcctagcccagatgtttctggaaattgacaaccgccagtgtgttcaagattcagaccagtgtttcaagaacacggatgcagcagcagctcttctggcctctcacgccaaggccttatggcaatcctaccctcttgtgtccgtcgtcagtgaatctctgactcgaaaaggtactcagctcgactcggaccgatg

SEQ ID NO: 13985 - DNA, 203 bp, Homo sapiens
ggcgcgccagtcctggagtagttgtttctggaaattgacaaccgccagtgtgttcaagattcagaccagtgtttcaagaacacggatgcagcagcagctcttctggcctctcacgccactgtaaacgttagttcctaccctcttgtgtccgtcgtcagtgaatctctgactcgaaaaggtactcagctcgactcggaccgatg

SEQ ID NO: 13986 - DNA, 203 bp, Homo sapiens
ggcgcgccagtccttatcggattgtttctggaaattgacaaccgccagtgtgttcaagattcagaccagtgtttcaagaacacggatgcagcagcagctcttctggcctctcacgccatccaggggaccttgtcctaccctcttgtccaaacacctgcaaaatctctgactcgaaaaggtactcagctcgactcggaccgatg

SEQ ID NO: 13987 - DNA, 203 bp, Homo sapiens
ggcgcgccagtcctgcagtcgatgtttctggaaattgacaaccgccagtgtgttcaagattcagaccagtgtttcaagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 13988 - DNA, 203 bp, Homo sapiens
ggcgcgccagtcctagtgctgctgtttctggaaattgacaaccgccagtgtgttcaagattcagaccagtgtttcaagaacacggatgcagcagcagctcttctggcctctcacgccatccaggggaccttgtcctaccctcttgtgtccgtcgtcagtgaatctctgactcgactttagcgattatacgactcggaccgatg

SEQ ID NO: 13989 - DNA, 203 bp, Homo sapiens
ggcgcgccagtcctaacttgtctgtttctggaaattgacaaccgccagtgtgttcaagattcagaccagtgtttcaagaacacggatgcagcagcagctcttctggcctctcacgccatccaggggaccttgtcctaccctcttgtgtccgtcgtcagtgctatgtgttgaacgaaaggtactcagctcgactcggaccgatg

SEQ ID NO: 13990 - DNA, 203 bp, Homo sapiens
ggcgcgccagtcctcttccacttgtttctggaaattgacaaccgccagtgtgttcaagattcagaccagtgtttcaagaacacggatgcagcagcagctcttctggcctctcacgccatccaggggaccttgtcctaccctcttgttatgtcgcggcaataatctctgactcgaaaaggtactcagctcgactcggaccgatg

SEQ ID NO: 13991 - DNA, 203 bp, Homo sapiens
ggcgcgccagtcctaggtattgtgtttctggaaattgacaaccgccagtgtgttcaagattcagaccagtgtttcaagaacacggatgcagcagcagctcttcttattgtgagacgactccaggggaccttgtcctaccctcttgtgtccgtcgtcagtgaatctctgactcgaaaaggtactcagctcgactcggaccgatg

SEQ ID NO: 13992 - DNA, 203 bp, Homo sapiens
ggcgcgccagtcctgtcctacatgtttctggaaattgacaaccgccagtgtgttcaagattcagaccagtgtttcacttggttccgacaggcagcagctcttctggcctctcacgccatccaggggaccttgtcctaccctcttgtgtccgtcgtcagtgaatctctgactcgaaaaggtactcagctcgactcggaccgatg

SEQ ID NO: 13993 - DNA, 203 bp, Homo sapiens
ggcgcgccagtcctctctctcgtgtttctggaaattgacaaccgccagtgtgttcaagattcgagttgtgaacgagagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 13994 - DNA, 203 bp, Homo sapiens
ggcgcgccagtcctggtgctcatgttttggcttgcgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagccgactcggaccgatg

SEQ ID NO: 13995 - DNA, 203 bp, Homo sapiens
ggcgcgccagtcctgacgcgtattaacgtggagccaagtaaacctgaattctggatatctcagggagctggcgatcataaattcaagttagcaaaagaaaaaaaaattgaaatgcttctctagataatgcttaaaggaccctgcagcagttcttggtattggacatagcatctcagctgttgcctcctcgactcggaccgatg

SEQ ID NO: 13996 - DNA, 203 bp, Homo sapiens
ggcgcgccagtcctggcttggtttaacgtggagccaagtaaacctgaattctggatatctcattttctaacttcggataaattcaagttagcaaaagaaaaaaaaattgaaatgcttctctagataatgcttgttctctgtaaatacagttcttggtattggacatagcatctcagctgttgcctcctcgactcggaccgatg

SEQ ID NO: 13997 - DNA, 203 bp, Homo sapiens
ggcgcgccagtcctctactagattaagaaaaactagtactaataccatttgattatgccaattttctcgagaaatcattcaattgaccatagactgaaagcgttgttacctagttcttcagaagagatcttattagaattaatttatatgatctaattcccttaaaaactgaataccaaaaaacaaaacgactcggaccgatg

SEQ ID NO: 13998 - DNA, 203 bp, Homo sapiens
ggcgcgccagtcctgactagggttaagaaaaacttaggacccaagtcctttaaacgtgcatgattgagatagtcagtggaacacagccggttgaatactagtgagtaaattaggagtagtagtattgaaccacctcatatcttatttcttctgaactgcattaaaatttgtacccaggatataacaaccgactcggaccgatg

SEQ ID NO: 13999 - DNA, 203 bp, Homo sapiens
ggcgcgccagtcctcttgcgttttaagaaaaacttaggacccaggtccttgattatgccaattttctcgagaaatctcgggtcctcgttaagactgaaagcgttgttacctagttcttcagaagagatcttattagaattaatttatatgatctaattcccttaaaaactgaataccaaaaaacaaaacgactcggaccgatg

SEQ ID NO: 14000 - DNA, 203 bp, Homo sapiens
ggcgcgccagtcctcgggtttgttaaggtgtcgtaacgtctcgtgacaccgggttcagttcagtcgagtggtggcgacccaatttaacacccattcttatataagaacacagtataatttaatcacaaaagacctcaaaaactgacacagcttgatccactcaacatataattgtaagattaataatacgactcggaccgatg

SEQ ID NO: 14001 - DNA, 203 bp, Homo sapiens
ggcgcgccagtcctcatcccacttaaggtgtcgtccttagcgcaacacccgggttcagttcaaatatcgacctctaacccaatttaacacccattcttatataagaacacagtataatttaatcacaaaagacctcaaaaactgacacagcttgatccactcaacatataattgtaagattaataatacgactcggaccgatg

SEQ ID NO: 14002 - DNA, 203 bp, Homo sapiens
ggcgcgccagtcctctcgaattttaatattcatttgtttaaatcttattttatttttaagctcaaactgcttaagacacttaggtggtaataaagtgaaataattttttgcaaaggggtttcctcgatttggagctttttttttcttccaccgtcatttctaactcttaaaaccaactcagttccatccgactcggaccgatg

SEQ ID NO: 14003 - DNA, 203 bp, Homo sapiens
ggcgcgccagtcctggatgcttttacatgctgcgttcccctgcctcagcttcctgagtagctgggattacaggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 14004 - DNA, 203 bp, Homo sapiens
ggcgcgccagtcctccttcctattacattgtacggctcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctccccgactcggaccgatg

SEQ ID NO: 14005 - DNA, 203 bp, Homo sapiens
ggcgcgccagtcctatatgaacttacgaagaaagtgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 14006 - DNA, 203 bp, Homo sapiens
ggcgcgccagtcctgcctaagcttagttcccaggaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgcgactcggaccgatg

SEQ ID NO: 14007 - DNA, 203 bp, Homo sapiens
ggcgcgccagtccttgaatacgttatagcaaagttccatgggtccagccagccgcttccctgtgctgtgagtgtttccaccactccaggagacagcattcagagttgaccttgtgagagctggccataatttaattccatctctaggttttctgtcttattgtttcagaggcacatcgagaaccaacccgactcggaccgatg

SEQ ID NO: 14008 - DNA, 203 bp, Homo sapiens
ggcgcgccagtccttcaactggttatgaatacagggaccgcctaagagggcgtgcgctcccgacatgccccgccgcgcgccattaaccgccagatttgaatcgcgggacccgttggcagaggtggcggcggcggcatgggtgccccgacgttgccccctgcctggcagccctttctcaaggaccaccgcgactcggaccgatg

SEQ ID NO: 14009 - DNA, 203 bp, Homo sapiens
ggcgcgccagtcctataaatccttattgcatacccgtttttaataaaatacattgcataccctcttttaataaaaaatattgcatactttactcgttgcttgcgtcgttgcatacccaataaaagattattatattgcatacccgtttttaataaaatacattgcataccctcttttaataaaaaatacgactcggaccgatg

SEQ ID NO: 14010 - DNA, 203 bp, Homo sapiens
ggcgcgccagtcctacgtcaggttatttctgttgtttttgttgtattgttgagtcttcttgtgttttgttgtctttctacaggttgttgtggttgttgcaattgtttaacttcatcaatgcgaggctgttgtgattgtggttcaactaaacttccttattgtattagcagggtcgtccacgttcaatacgactcggaccgatg

SEQ ID NO: 14011 - DNA, 203 bp, Homo sapiens
ggcgcgccagtcctgctgggcgttatttctgttgtttttgttgtattgttgagtcttcttgtgttttgttgtcttttgtagaaaatggtaggttgttgcaattgtttaacttcatcaatgcgaggctgttgtgattgtggttcaactaaacttccttattacgaatttgaaaaggtccacgttcaatacgactcggaccgatg

SEQ ID NO: 14012 - DNA, 203 bp, Homo sapiens
ggcgcgccagtcctacctatgattcagtacgccaactattgtttgcgggaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 14013 - DNA, 203 bp, Homo sapiens
ggcgcgccagtcctcacatacgttcagtacgccacaagcgacacaaatgaacacgccttctcagccccgccagcacgagcggggcgttacggcccagcccccgagcagtgcagcctcccgagtgcagagtgcagcccctgcccgccctggcccagctgcccatgtctaccctgctggatcccaagtaacgactcggaccgatg

SEQ ID NO: 14014 - DNA, 203 bp, Homo sapiens
ggcgcgccagtcctagcttcccttcagtacgccacaagcgacacaaatgaacacgccttctcagccccgccagcacttctaccctagccgggcccagcccccgagcagtgcagcctcccgagtgcagagtgcagcccctgcccgccaccttgtttactttcatgtctaccctgctggatcccaagtaacgactcggaccgatg

SEQ ID NO: 14015 - DNA, 203 bp, Homo sapiens
ggcgcgccagtcctcagattagttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgcccacgtgtgctgcccgactcggaccgatg

SEQ ID NO: 14016 - DNA, 203 bp, Homo sapiens
ggcgcgccagtcctctcagctgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 14017 - DNA, 203 bp, Homo sapiens
ggcgcgccagtccttgacttctttcagtacgccacaagcgacacaaatgaacacgccttctcagccccgccagcacttctaccctagccgggcccagcccccgagcagtgcagcctccgagagaaccccgagagcccctgcccgccctggcccagctgcccatgtctaccctgctggatcccaagtaacgactcggaccgatg

SEQ ID NO: 14018 - DNA, 203 bp, Homo sapiens
ggcgcgccagtcctgagaccggttcagtacgccacaagcgacacaaatgaacacgccttctcagccccgccagcacttctaccctagccgggcccagcccccgatgcaatacagtcgtcgagtgcagagtgcagcccctgcccgccctggcccagctgcccatgtctaccctgctggatcccaagtaacgactcggaccgatg

SEQ ID NO: 14019 - DNA, 203 bp, Homo sapiens
ggcgcgccagtcctggcggctcttcagtacgccacaagcgacacaaatgaacacgccttctcctataaattctagattctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 14020 - DNA, 203 bp, Homo sapiens
ggcgcgccagtcctttcacatattcagtacgccacaagcgacacaaattcgtcttaaagaggagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 14021 - DNA, 203 bp, Homo sapiens
ggcgcgccagtcctattcgtagttcatcattctcaaattcttaggacgcggcctgttctttgggaacgctctcggaattggccgcggaaaccgatctgcccgttgtgtttgtgaaacagagaaagataggcggccatggtccaaccttgaaggcttatcaggagggcagacttcaaaagctactaaaacgactcggaccgatg

SEQ ID NO: 14022 - DNA, 203 bp, Homo sapiens
ggcgcgccagtcctcagctatcttcatcattctcaaattcttaggacggtcgggccctggaaggaacgctctcggaattggccgcggaaaccgatctgcccgttgtgtttgtgaaacagagaaagataggcggccatggtccaaccggatgcatacccttggagggcagacttcaaaagctactaaaacgactcggaccgatg

SEQ ID NO: 14023 - DNA, 203 bp, Homo sapiens
ggcgcgccagtccttatccatgttcattggacactggtgcgagccggtgatgccactcaacaatttctccaacatcttaacatccctgaagatatatatacaatatatatattagtgtcataatgcttggccataacgattctatatcatccaaccataaaactatcttaataaggttatgggacaaacgactcggaccgatg

SEQ ID NO: 14024 - DNA, 203 bp, Homo sapiens
ggcgcgccagtcctagcgtgttttcctcccaaggctaaactttctaataggacagccctacgtcgggggctcccggagcagggcgagagctcgcgtcgccggaaaggaagacgggaagaaagggcaggcggctcggcgggcgtcttctccactcctctgccgcgtccccgtggctgcagggagccggccgactcggaccgatg

SEQ ID NO: 14025 - DNA, 203 bp, Homo sapiens
ggcgcgccagtcctcataacgcttcctcccaaggctaaactttctaattcccttctttgggctcgggggctcccgggatcaccgtctgcgtcgcgtcgccggaaaggaagacgggaagaaagggcaggcggctcggcgggcgtcttctccactcctctgccgcgtccccgtggctgcagggagccggccgactcggaccgatg

SEQ ID NO: 14026 - DNA, 203 bp, Homo sapiens
ggcgcgccagtcctgcacaggattccttagtgactctaaataaagtaacagcagacatcgggctggggagtgactccgtgtgtgcccggccctcgtctcaccgcataaagtcttttgactcccttggatcacagtctttgcacactcggacttcaaaactagatgctcttagcaatcggagtttggaccgactcggaccgatg

SEQ ID NO: 14027 - DNA, 203 bp, Homo sapiens
ggcgcgccagtcctgggtccgattccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagttatatctccacatacgactcggaccgatg

SEQ ID NO: 14028 - DNA, 203 bp, Homo sapiens
ggcgcgccagtcctgtccgtcgttccttagtgactctaaataaagtaacagcagacatcgggctggggagtgactccgtgtgtgcccggccctcgtctcaccgcataaagtcttttgactcccttggatcacgagaacgattgtgacggacttcaaaactgttccagggccagtatcggagtttggaccgactcggaccgatg

SEQ ID NO: 14029 - DNA, 203 bp, Homo sapiens
ggcgcgccagtcctgttgggtattccttagtgactctaaataaagtaagttttctggcacaactggggagtgactccgtgtgtgcccggccctcgtctcaccgcataaagtcttttgactcccttggatcacagtctttgcacactcggacttcaaaactgttccagggccagtatcggagtttggaccgactcggaccgatg

SEQ ID NO: 14030 - DNA, 203 bp, Homo sapiens
ggcgcgccagtcctgcctcactttcgacgcaggaggcggggctgctcagtcctccaggcgtcggtactcagcggtgaaatccagcatagccttgcttgcctgtgcgcgcgtgcgcggacatggcctcaaacgattatacccaacaagcaacccaaagctatggggcctaccccacccagcccgggcagcgactcggaccgatg

SEQ ID NO: 14031 - DNA, 203 bp, Homo sapiens
ggcgcgccagtccttgagcgtgttcgacgcaggaggcggggctgctcagtcctccaggcgtcggtactcagcggtgttggaacttcgttgcttgcttgcctgtgcgcgcgtgcgcggacatggcctcaaacgattatacccaacaacttctggtccctattggggcctaccccacccagcccgggcagcgactcggaccgatg

SEQ ID NO: 14032 - DNA, 203 bp, Homo sapiens
ggcgcgccagtcctactcgctcttcgacgcaggaggcggggctgctcagtcctccaggcgtcggtactcagcggtgttggaacttcgttgcttgcttgcctgtgcgcgcgtgcgcggacatggcctcaaacgattatacccaacaagcaacccaaagctatggggcctaccccatttttaaattatgtcgactcggaccgatg

SEQ ID NO: 14033 - DNA, 203 bp, Homo sapiens
ggcgcgccagtcctctttattgttcgacgcaggaggcggggctgctcagtcctccaggcgtcggtactcagcggtgttggaacttcgttgcttgcttgcctgtgtctcttacgctattcatggcctcaaacgattatacccaacaagcaacccaaagctatggggcctaccccacccagcccgggcagcgactcggaccgatg

SEQ ID NO: 14034 - DNA, 203 bp, Homo sapiens
ggcgcgccagtcctgggaagctttcgacgcaggaggcggggctgctcatgaaaggtctgcagggtactcagcggtgttggaacttcgttgcttgcttgcctgtgcgcgcgtgcgcggacatggcctcaaacgattatacccaacaagcaacccaaagctatggggcctaccccacccagcccgggcagcgactcggaccgatg

SEQ ID NO: 14035 - DNA, 203 bp, Homo sapiens
ggcgcgccagtcctgatcttatttcgcagctgttgtggtgtgtcgtaacgggcaactctgcagcggaaccgactactttgggtgtccgtgtttccttttattcctatattggctgcttatggtgacaatcaaaaagttgttaccatatagctattggattggccatccggtgtgcaacagggcaattgcgactcggaccgatg

SEQ ID NO: 14036 - DNA, 203 bp, Homo sapiens
ggcgcgccagtccttttcgtccttcgggctgggagcgtgctttccacgacggtgacacgcttccctggattggcagccagactgccttccgggtcactgccatggaggagccgcagtcagatcctagcgtcgagccccctctgagtatatgccaggacggagacctatggaaactacttcctgaaaaccgactcggaccgatg

SEQ ID NO: 14037 - DNA, 203 bp, Homo sapiens
ggcgcgccagtcctatcctaagttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaacactgcttattcccgcgactcggaccgatg

SEQ ID NO: 14038 - DNA, 203 bp, Homo sapiens
ggcgcgccagtcctacgccgacttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaaccgactcggaccgatg

SEQ ID NO: 14039 - DNA, 203 bp, Homo sapiens
ggcgcgccagtcctacgtaccgttcgggctgggagcgtgctttccacgacggtgacacgcttccctggattggcagccagactgccttccgggtcactgccatggaggagccgcagtcagatcctagcgtcgagccccctctgagtcaggaaacattttcgcgtggcaccgccatacttcctgaaaaccgactcggaccgatg

SEQ ID NO: 14040 - DNA, 203 bp, Homo sapiens
ggcgcgccagtccttagtttctttcgggctgggagcgtgctttccacgacggtgacacgctttagctcgcgtttctccagactgccttccgggtcactgccatggaggagccgcagtcagatcctagcgtcgagccccctctgagtcaggaaacattttcagacctatggaaactacttcctgaaaaccgactcggaccgatg

SEQ ID NO: 14041 - DNA, 203 bp, Homo sapiens
ggcgcgccagtcctggccaaatttcgggctgggagcgtgctttccacgcgtaaactctatgcccctggattggcagccagactgccttccgggtcactgccatggaggagccgcagtcagatcctagcgtcgagccccctctgagtcaggaaacattttcagacctatggaaactacttcctgaaaaccgactcggaccgatg

SEQ ID NO: 14042 - DNA, 203 bp, Homo sapiens
ggcgcgccagtccttgtgtgggttctacatgtagaattaagttacaaaaaaacatgggacaagtgaaaatgtctcttcaagggattcacctgagtgatctatcatacaagcatgctatattaaaagagtctcagtatacaataaagagagatgtaggcacaacaacagcagtgacaccctcatcattgcgactcggaccgatg

SEQ ID NO: 14043 - DNA, 203 bp, Homo sapiens
ggcgcgccagtcctttctgttgttctcatgctatagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagcgactcggaccgatg

SEQ ID NO: 14044 - DNA, 203 bp, Homo sapiens
ggcgcgccagtcctgtgtcgtcttctctagtgcagtgcctggagatgaccaccaaacggaaaatcatcggccgtctggtgccatgccgataaaatttgatatccgaagaaatcatctcagttttagattactcccactgcagtcttcagcaggtgccaaaggaggtctttaacttcgaacgaacattacgactcggaccgatg

SEQ ID NO: 14045 - DNA, 203 bp, Homo sapiens
ggcgcgccagtcctgacctgaattctctagtgcagtgcctggagatgaccaccaaacggaaaatcccgttgtaactggtgccatgccgatgtttccgaggtgaagaagaaatcatctcagttttagatccacataactgcagtcttcagcaggtgccaaaggaggtctttaacttcgaacgaacattacgactcggaccgatg

SEQ ID NO: 14046 - DNA, 203 bp, Homo sapiens
ggcgcgccagtcctcccggaacttctctagtgcagtgcctggagatgaccaccaaacggaaaatcccgttgtaactggtgccatgccgatgtttccgaggtgaagaagaaatcatctcagttttagattactcccactgcagtcttcagcaggtgccaaaggaggtctttaacttcgaacgaacattacgactcggaccgatg

SEQ ID NO: 14047 - DNA, 203 bp, Homo sapiens
ggcgcgccagtcctgcgcaacgttctctagtgcagtgcctggagatgagttgatggacctggatcatcggccgtctggtgccatgccgatgtttccgaggtgaagaagaaatcatctcagttttagattactcccactgcagtcttcagcaggtgccaaaggaggtctttaacttcgaacgaacattacgactcggaccgatg

SEQ ID NO: 14048 - DNA, 203 bp, Homo sapiens
ggcgcgccagtcctctacgcggttctgctacagaacaactcccttggtacaataaaaaagacgagtatttacttttcattgaaagaatggagcttgcttgatatttcactagataaagaatttaaggcgagtatctatctttgttccttcgttactaacggagtctgcccttggaaacatcaggcacccgactcggaccgatg

SEQ ID NO: 14049 - DNA, 203 bp, Homo sapiens
ggcgcgccagtcctgtggcttattctgctacagaacaactcccttggtacaataaaaaagacgagtatttacttttcattgaaagaatggagcttgcttgatatttcactagataaagaatttaaggcgagtatctatctttgttctccttggcaactgagagtctgcccttggaaacatcaggcacccgactcggaccgatg

SEQ ID NO: 14050 - DNA, 203 bp, Homo sapiens
ggcgcgccagtcctgtgcagagttctgctacagaacaactcccttggtacaataaaaaagacgagtatttacttttcattgaaagaatggagcttgcttgatatttcactagataaaggtgagcttagttacatctatctttgttctccttggcaactgagagtctgcccttggaaacatcaggcacccgactcggaccgatg

SEQ ID NO: 14051 - DNA, 203 bp, Homo sapiens
ggcgcgccagtcctaacactacttctgctacagaactgggtatttggtacaataaaaaagacgagtatttacttttcattgaaagaatggagcttgcttgatatttcactagataaagaatttaaggcgagtatctatctttgttccatagccgcgatgagagtctgcccttggaaacatcaggcacccgactcggaccgatg

SEQ ID NO: 14052 - DNA, 203 bp, Homo sapiens
ggcgcgccagtcctccatacggttctgctacagaactgggtatttggtacaataaaaaagacgagtatttacttttcattgaaagaatggagcttgcttgatatttcactagataaagaatttaaggcgagtatctatctttgttctccttggcaactgagagtctgcccttggaaacatcaggcacccgactcggaccgatg

SEQ ID NO: 14053 - DNA, 203 bp, Homo sapiens
ggcgcgccagtcctcaattgtgttctggcacctacctacctgcttcccctacctttccccttagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 14054 - DNA, 203 bp, Homo sapiens
ggcgcgccagtccttcgtgcggttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 14055 - DNA, 203 bp, Homo sapiens
ggcgcgccagtccttattgtgcttctggcacctacctacctgcttcccgctggggggtggggagttggcccagagtcttaagattggggcagggtggagaggtgggctcttcctgcttcccactcatcttatcctcggtggattgtagatccgaattcgagatccaaaccaaggaggaaaggatatcacgactcggaccgatg

SEQ ID NO: 14056 - DNA, 203 bp, Homo sapiens
ggcgcgccagtcctcctcaaacttctggcacctacctacctgcttcccgctggggggtggggtccctcaagttgcacttaagattggggcagggtggagaggtgggctcttcctgcttcccactcatcttatagctttctttccccagatccgaattcgagatccaaaccaaggaggaaaggatatcacgactcggaccgatg

SEQ ID NO: 14057 - DNA, 203 bp, Homo sapiens
ggcgcgccagtcctgtagaactttctgtccctccacccgtccccttccccaccctctggcccccaccttcttggaggcgacaacccccggcctagtgctcccaagatttttcccgcaggttgcgaagggaagcaaacttggtggcaacttgcctcccggtgcgggcgtctctcccccaccgtctcaaccgactcggaccgatg

SEQ ID NO: 14058 - DNA, 203 bp, Homo sapiens
ggcgcgccagtccttctcctgattctgtccctccacccgtccccttccccaccctctggcccccaccttcttggaggcgacaacccccgggaggcattagaagggatttttcccgcagacattcgcaaacgacaaacttggtggcaacttgcctcccggtgcgggcgtctctcccccaccgtctcaaccgactcggaccgatg

SEQ ID NO: 14059 - DNA, 203 bp, Homo sapiens
ggcgcgccagtcctagcgacctttctgtccctccacccgtccccttccccaccctctggcccccaccttcttggaggcgacaacccccgggaggcattagaagggatttttcccgcaggttgcgaagggaagcaaacttggtggcaacttgcctcccggtatctcgtatcgcaacccaccgtctcaaccgactcggaccgatg

SEQ ID NO: 14060 - DNA, 203 bp, Homo sapiens
ggcgcgccagtccttgaggcctttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctccaaactatagcatgacgactcggaccgatg

SEQ ID NO: 14061 - DNA, 203 bp, Homo sapiens
ggcgcgccagtccttgcctccattctgtccctcccgatcaggtacaagccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaaccgactcggaccgatg

SEQ ID NO: 14062 - DNA, 203 bp, Homo sapiens
ggcgcgccagtcctcgcattacttcttcttccagaacacctctgaaagcttggtcaagggtacattttttttcattttcactgccaggtaactgactgaaggcagtcaacaacggcttgatatttttgttattcaaggcttctctgacgacgagaacgggtcgcgtccgcgcctccggcaaactgaaacgactcggaccgatg

SEQ ID NO: 14063 - DNA, 203 bp, Homo sapiens
ggcgcgccagtcctgagctagtttcttcttccagaacacctctgaaagcttggtcaagggtacattttttttcattttcactgccaggtatacccgacctccaggtcaacaacggcttgatatttttgttattcaaggcttctctggtagatttcgtaaatcgcgtccgcgcctccggcaaactgaaacgactcggaccgatg

SEQ ID NO: 14064 - DNA, 203 bp, Homo sapiens
ggcgcgccagtcctagaagccgttcttcttccagttgcttagctcgcccttggtcaagggtacattttttttcattttcactgccaggtaactgactgaaggcagtcaacaacggcttgatatttttgttattcaaggcttctctggtagatttcgtaaatcgcgtccgcgcctccggcaaactgaaacgactcggaccgatg

SEQ ID NO: 14065 - DNA, 203 bp, Homo sapiens
ggcgcgccagtcctgtactttgttctttaataccgaagggggatcttgggtgaaggtcagggcttgggcgctagctctccgaggcctgttctgaatcggtctccagaaatgctttgggttcatctttcattgctgcaaggaacttccatgcctctaacactcatcttcaaaagactgggactgctgagcgactcggaccgatg

SEQ ID NO: 14066 - DNA, 203 bp, Homo sapiens
ggcgcgccagtcctagtccgccttgaaaaggttacccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgcccgactcggaccgatg

SEQ ID NO: 14067 - DNA, 203 bp, Homo sapiens
ggcgcgccagtccttgaaaccattgaaattggctggcactgctgttgttaatttaagaccagatcaattaaatgatttagtttattctctgcccactttcctataattattagttcgcgatacgcgtaaagagatttttgttggtgatagtcttgtaaatacttgttagatctcattaaatctaaactcgactcggaccgatg

SEQ ID NO: 14068 - DNA, 203 bp, Homo sapiens
ggcgcgccagtcctgtttggacttgaagtgaagcattctatgaatgtgagctgaagaaatgaggacctcagttgggtgcaggtcattttacctgggacaaatacctaaaagaaacatgttcagtcccagcgcctgtccattgcttcaagcagtcctacacacctccaagcaacgagttcaagatcagtcgactcggaccgatg

SEQ ID NO: 14069 - DNA, 203 bp, Homo sapiens
ggcgcgccagtcctgcagattcttgaagtgaagcattctatgaatgtggagactttgcggcgatgaaatgaaataatgcaggtcattttacctgggacaaatacctaaaagaaacatgttcagtcccagcgcctgtccattgcttcaagcagtcctacacacctccaagcaacgagttcaagatcagtcgactcggaccgatg

SEQ ID NO: 14070 - DNA, 203 bp, Homo sapiens
ggcgcgccagtccttactaccattgcaatcaggtagctcgcggctcacgctgagagggacacgcagtgacgagcggccgaagcagctttgcggtgagagcacgctgggccgggggccgggcgggagcctggtggcgggtaacgccggactcgagggttttgtagtgcatccctgagcatgagcacagacgactcggaccgatg

SEQ ID NO: 14071 - DNA, 203 bp, Homo sapiens
ggcgcgccagtcctgattagatttgcatagaatggcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgattcgactcggaccgatg

SEQ ID NO: 14072 - DNA, 203 bp, Homo sapiens
ggcgcgccagtccttcttacttttgcctgttccactaggaatattgtttgcaaggcacaaggtgtcttttggtagtgagcgcgctctgcgcatgcgcaggtccaacattactgaggcacccagcagccgactaagttgcattccttgaatcttcgcagaaaagacaattcttttaatcagagttagtacgactcggaccgatg

SEQ ID NO: 14073 - DNA, 203 bp, Homo sapiens
ggcgcgccagtcctctcagagattgctgcatttcccacacggccataatgttactcccagccaatagaaagtgagcttcttgacaagtgccaaaatggcgatgcctaccacctagaactggattgtgcgctccatttctttcacctcaaagctggccgccaccgctgccacctgctcagagtgaaatacgactcggaccgatg

SEQ ID NO: 14074 - DNA, 203 bp, Homo sapiens
ggcgcgccagtcctagcagcttttgctgcatttctattggttggcgtttgttactcccagccaatagaaagtgagcccaccccgccatgccaaaatggcgatgcctaccacctagaactggattgtgcgctccatttctttcacctcaaagctggccgccaccgctgccacctgctcagagtgaaatacgactcggaccgatg

SEQ ID NO: 14075 - DNA, 203 bp, Homo sapiens
ggcgcgccagtcctctgcaatattgctgcatttctattggttggcgtttgttactcccagccaatagaaagtgagcttcttgacaagtgccaaaatggcgatgcctaccacctagaactggattgtgcgctctcgacagaggtgtccaaagctggccgccaccgctgccacctgctcagagtgaaatacgactcggaccgatg

SEQ ID NO: 14076 - DNA, 203 bp, Homo sapiens
ggcgcgccagtcctcggatcgcttgctgcatttctattggttggcgtttgttactcccagccaatagaaagtgagcttcttgacaagtgcttggtcaagccctgctaccacctagaactggattgtgcgctccatttctttcacctcaaagctggccgccaccgctgccacctgctcagagtgaaatacgactcggaccgatg

SEQ ID NO: 14077 - DNA, 203 bp, Homo sapiens
ggcgcgccagtcctctctgatcttgcttactctcgccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcccgactcggaccgatg

SEQ ID NO: 14078 - DNA, 203 bp, Homo sapiens
ggcgcgccagtcctgattcgccttggacaaatcaaaattataatttggttcagggcctccctccagcgacggccgaactgggctagccatgcccatagtaggactagcaaaacggagggactagccatagtggcgagctccctgggatcaaccgtggtctagtacaggacagtcgtcagtagttcgaccgactcggaccgatg

SEQ ID NO: 14079 - DNA, 203 bp, Homo sapiens
ggcgcgccagtcctcgatagatttggacaaatcaaaattataatttggttcagggcctccctccagcgacggccgaactgggctagccatgcccatagtaggactagcaaaacggagggactagccatagtggcgagctccctgggtggtctaagtcctgagtacaggacagtctggttccaactctgcgactcggaccgatg

SEQ ID NO: 14080 - DNA, 203 bp, Homo sapiens
ggcgcgccagtcctatccactattggacaaatcaaaattataatttggttcagggcctccctccagcgacggccgaactgggctagccatgcccatagtaggactagcaaaacggagggactagccatagtggcgagctccctgggtggtctaagtcctgcagtttaattgtatgtcagtagttcgaccgactcggaccgatg

SEQ ID NO: 14081 - DNA, 203 bp, Homo sapiens
ggcgcgccagtcctttcatcgcttggacaaatcaaaattataatttggttcagggcctccctccagcgacggccgaactgggctagccatgcccatagtaggactagcaaaacggaggttgagctggaccgtgcgagctccctgggtggtctaagtcctgagtacaggacagtcgtcagtagttcgaccgactcggaccgatg

SEQ ID NO: 14082 - DNA, 203 bp, Homo sapiens
ggcgcgccagtcctaggtaactttggagagttattgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcgactcggaccgatg

SEQ ID NO: 14083 - DNA, 203 bp, Homo sapiens
ggcgcgccagtcctgcattgtattggagtgaatgggaccccaggcagcagcgagtgacaggacgtctggacccgcgcgccgctagcagctctgccgggccgcggcggtgatcgatggggagcggctggagcggacccagcgagtgagggcgcacagccgggacgccgaggcggcgggcgggagacccgcgactcggaccgatg

SEQ ID NO: 14084 - DNA, 203 bp, Homo sapiens
ggcgcgccagtcctaatcacttttggatctttggcctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctccgactcggaccgatg

SEQ ID NO: 14085 - DNA, 203 bp, Homo sapiens
ggcgcgccagtcctacaagcgcttgggagcgccagttccgtctgtgtgttcgagtggacaaaatggcgaagatcgccaagactcacgaagatattgaagcacagattcgagaaattcaaggcaagaaggcagaatccatgcttcggcaaggagtgggcctcgattctacaggttattatgaccaggaacgactcggaccgatg

SEQ ID NO: 14086 - DNA, 203 bp, Homo sapiens
ggcgcgccagtccttctctgagttgggagcgccagttccgtctgtgtgttcgagtggacaaaatggcgaagatcgccaagactcacgaagatattgaagcacagattcgagaaattcaaggcaagaaggcagctcttgatgaagctgttacttatctgggcgattctacaggttattatgaccaggaacgactcggaccgatg

SEQ ID NO: 14087 - DNA, 203 bp, Homo sapiens
ggcgcgccagtcctagttcctcttgggagcgccagttccgtctgtgtgttcgagtggacaaaatggcgaagatcgccaagactcacgaagtgtgccctcacttaattcgagaaattcaaggcaagaaggcagctcttgatgaagctcaaggagtgggcctcgattctacaggttattatgaccaggaacgactcggaccgatg

SEQ ID NO: 14088 - DNA, 203 bp, Homo sapiens
ggcgcgccagtcctcctggacattgggagcgccagttccgtctgtgtgttcgagtggacaaagcctacgccggtaacaagactcacgaagatattgaagcacagattcgagaaattcaaggcaagaaggcagctcttgatgaagctcaaggagtgggcctcgattctacaggttattatgaccaggaacgactcggaccgatg

SEQ ID NO: 14089 - DNA, 203 bp, Homo sapiens
ggcgcgccagtcctttacctacttgggcagagggactcttacaatgtagattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagcccgactcggaccgatg

SEQ ID NO: 14090 - DNA, 203 bp, Homo sapiens
ggcgcgccagtcctggcacacgttgggcagagggcggggcggcggagggattgcggcggcccgcagcgggataacccaattatgtgtagggtggctccttgcacagcagctgcacgcgccgtggctccggatctcttcgtctttgcagcgtagcccgagtcggtcagcgccggaggacctcagcagcccgactcggaccgatg

SEQ ID NO: 14091 - DNA, 203 bp, Homo sapiens
ggcgcgccagtcctcccatttgttgggcagagggcggggcggcggagggattgcggcggcccgcagcgggataaccttgaggctgaggcagtggctccttgcacagcagctgcacgcgccgtggctccggatctcttcgtctttgcagcgtagcccgagtataatcctatgcagggacctcagcagcccgactcggaccgatg

SEQ ID NO: 14092 - DNA, 203 bp, Homo sapiens
ggcgcgccagtcctgggccggcttgggcagagggcggggcggcggagggattgcggcggcccgcagcgggataaccttgaggctgaggcagtggctccttgcacagcagctgcacgcgccgtggctccggatctcttcgtctttgcgtaaactgtacccgcggtcagcgccggaggacctcagcagcccgactcggaccgatg

SEQ ID NO: 14093 - DNA, 203 bp, Homo sapiens
ggcgcgccagtccttggagtagttgggcagagggcggggcggcggagggattgcggcggcccgcagcgggataaccttgaggctgaggcagtggctccttgcacagcagctgcacgcgtaaatttcatttcactcttcgtctttgcagcgtagcccgagtcggtcagcgccggaggacctcagcagcccgactcggaccgatg

SEQ ID NO: 14094 - DNA, 203 bp, Homo sapiens
ggcgcgccagtcctgtcgtcaattgggcagagggcggggcggcggagggattgcggcggcccgcagcgggataaccttgaggctgaggcatatcaattggatttagcagctgcacgcgccgtggctccggatctcttcgtctttgcagcgtagcccgagtcggtcagcgccggaggacctcagcagcccgactcggaccgatg

SEQ ID NO: 14095 - DNA, 203 bp, Homo sapiens
ggcgcgccagtcctctactgcgttggtgggggagccctgccctcctggacttaataagtgaggcactagaacgatcatgaacttctgaagggacccagctttctttgtgtgctccaagtgatttgcacaaataataatatatatatttattgaaggagagaatcagagcaagtgataatcaagttactcgactcggaccgatg

SEQ ID NO: 14096 - DNA, 203 bp, Homo sapiens
ggcgcgccagtccttgggcaacttggttttatttattcctccttcaacaaaagaaagccccagcgctctagagctcagctgacgggaaagggggtgcgcagcctcgagtttgagagctacccggagctccaagacaggggtgggttccagctgcccgcacgccccgaccttccatcgtaggccggacccgactcggaccgatg

SEQ ID NO: 14097 - DNA, 203 bp, Homo sapiens
ggcgcgccagtccttggtgtccttggttttatttcaagaagtcgatcaaaaagaaagccccagcgctctagagctcagctgacgggaaagggggtgcgcagcctcgagtttgagagctacccggagctccaaaggtaactgttccaccagctgcccgcacgccccgaccttccatcgtaggccggacccgactcggaccgatg

SEQ ID NO: 14098 - DNA, 203 bp, Homo sapiens
ggcgcgccagtcctactccagcttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccacacatccaaatggtcgactcggaccgatg

SEQ ID NO: 14099 - DNA, 203 bp, Homo sapiens
ggcgcgccagtccttggcattcttgtattgctcttttttatatgttgttgtactggttgtggttctgcatgttttagtaaatgtcataattgttgtgatgagtatggtggtcatcatgattttgttatcaaaacatctcatgatgattagaatctcttgtcagatctcattaaacgcggttaccgggccgactcggaccgatg

SEQ ID NO: 14100 - DNA, 203 bp, Homo sapiens
ggcgcgccagtccttttgaaatttgtggggtagttcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgcgactcggaccgatg

SEQ ID NO: 14101 - DNA, 203 bp, Homo sapiens
ggcgcgccagtcctccggctgattgtgttggcaaatcaggcagcgcgtctgattcaattgtgttttacttgtcattatttttttagtaggacattatatcaaccagtttataaaatttttcttgcttaccaagattatatgcaaatagcacctgttccagctgaagtactaaatgtctaaactaaacgcgactcggaccgatg

SEQ ID NO: 14102 - DNA, 203 bp, Homo sapiens
ggcgcgccagtcctccaattaattgtgttggcaatgacctttattaaactgattcaattgtggggccaaaccacaaatttttttagtaggacattatatcaaccagtttataaaatttttcttgcttaccaagattatatgcaaatagcacctgttccagctgaagtactaaatgtctaaactaaacgcgactcggaccgatg

SEQ ID NO: 14103 - DNA, 203 bp, Homo sapiens
ggcgcgccagtcctccacttggttgtgttggcaatgacctttattaaactgattcaattgtgttttacttgtcattatttttttagtaggacattatatcaaccagtttataaaatttttcttgcttaccaagattatatgcaaatagcacctgttccagagatccctgactgggtctaaactaaacgcgactcggaccgatg

SEQ ID NO: 14104 - DNA, 203 bp, Homo sapiens
ggcgcgccagtcctgattgcgtttgttaagagaggcaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactcggaccgatg

SEQ ID NO: 14105 - DNA, 203 bp, Homo sapiens
ggcgcgccagtcctagcgaaacttgttagatcttaggccgcatcgctatttataaaaacatccactccctgtaatctatgcttgtgggcgtagatttttcatagtggtgtttatattcatttctgctgttaacagctttcagccagggacgtgttgtatcctaggcagtggcccgcccataggtcacacgactcggaccgatg

SEQ ID NO: 14106 - DNA, 203 bp, Homo sapiens
ggcgcgccagtccttccggtcattgttagatctttttgtaatctaaacccatcgtccggtcacactccctgtaatctatgcttgtgggcgtagatttttcatagtggtgtttatattcatttctgctgttaacagctttcagccagggacgtgttgtatcctaggcagtggcccgcccataggtcacacgactcggaccgatg

SEQ ID NO: 14107 - DNA, 203 bp, Homo sapiens
ggcgcgccagtccttaaacgcgttgttagatctttttgtaatctaaactttataaaaacatccactccctgtaatctatgcttgtgggcgtagatttttcatagtggtgtttatattcatttctgctgttaacagctttcagccagtattagccaagcagctaggcagtggcccgcccataggtcacacgactcggaccgatg

SEQ ID NO: 14108 - DNA, 203 bp, Homo sapiens
ggcgcgccagtcctggaagaacttgtttttcccgcgaaactcggcggctgagcgtggaggttcttgtctcccctggtttgtgaagtgcggaaaaccagaggcgcttgtcgtgatttcatcgacgatcctggcattttctacagcgacagcttcgggggcgacgcccaggccgacgaggggcaggcccgcgactcggaccgatg

SEQ ID NO: 14109 - DNA, 203 bp, Homo sapiens
ggcgcgccagtcctaggtccatttgtttttcccgtcgccggtaagacttgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcgactcggaccgatg

SEQ ID NO: 14110 - DNA, 203 bp, Homo sapiens
ggcgcgccagtcctttccctggtttaaaaacagaaaatgcaaagttggactgaaaatatccccacaagctgtttttatctgcttaaggcttccaaacttaccttaatttggtaagaaaataagctgccctatttttctttcttcttctcttacaactggaagcagccatttccccaaaccaccaccatcgactcggaccgatg

SEQ ID NO: 14111 - DNA, 203 bp, Homo sapiens
ggcgcgccagtcctggccacggtttacttctgtccgacagcgtgacgacgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgaccccccgactcggaccgatg

SEQ ID NO: 14112 - DNA, 203 bp, Homo sapiens
ggcgcgccagtcctccggtgtatttacttctgtctcgtctgccccaacattcgtggcacaaatgggtaaggcgaggcggaattaaaccccgctccgagagcggcagcttcgcgcgcggtgcgctcggcctatgcctgccccgaggggcgtctggtaggcaccccgccctctcccgcagctcgaccccccgactcggaccgatg

SEQ ID NO: 14113 - DNA, 203 bp, Homo sapiens
ggcgcgccagtcctgggcatcatttacttctgtctcgtctgccccaaccgctagcctcggctgcccgttccacgctcggaattaaaccccgctccgagagcggcagcttcgcgcgcggtgcgctcggcctatgcctgccccgaggggcgtctggtaggcaccccgccctctcccgcagctcgaccccccgactcggaccgatg

SEQ ID NO: 14114 - DNA, 203 bp, Homo sapiens
ggcgcgccagtccttaccgcagtttacttctgtctcgtctgccccaaccgctagcctcggcttgggtaaggcgaggaatttaacccgggagctccgagagcggcagcttcgcgcgcggtgcgctcggcctatgcctgccccgaggggcgtctggtaggcaccccgccctctcccgcagctcgaccccccgactcggaccgatg

SEQ ID NO: 14115 - DNA, 203 bp, Homo sapiens
ggcgcgccagtccttaagtctatttacttctgtctcgtctgccccaaccgctagcctcggcttgggtaaggcgaggcggaattaaaccccgctccgagagcggcagcttcgcgcgcggcaattcttagtccggcctgccccgaggggcgtctggtaggcaccccgccctctcccgcagctcgaccccccgactcggaccgatg

SEQ ID NO: 14116 - DNA, 203 bp, Homo sapiens
ggcgcgccagtcctcacggatgtttacttctgtctcgtctgccccaaccgctagcctcggcttgggtaaggcgaggcggaattaaaccccgctccgagagcggcagcttcgcgcgcggtgcgctcggcctataaggcttagtccttgcgtctggtaggcaccccgccctctcccgcagctcgaccccccgactcggaccgatg

SEQ ID NO: 14117 - DNA, 203 bp, Homo sapiens
ggcgcgccagtccttaaagtaatttacttctgtctcgtctgccccaaccgctagcctcggcttgggtaaggcgaggcggaattaaaccccgctccgagagcggcagcttcgcgcgcggtgcgctcggcctatgcctgccccgagggaaagtaaaggcaacccccgccctctcccgcagctcgaccccccgactcggaccgatg

SEQ ID NO: 14118 - DNA, 203 bp, Homo sapiens
ggcgcgccagtccttgcaccggtttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgaccccccgactcggaccgatg

SEQ ID NO: 14119 - DNA, 203 bp, Homo sapiens
ggcgcgccagtcctacttgggttttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcagatatgttcggggtgcagctcgaccccccgactcggaccgatg

SEQ ID NO: 14120 - DNA, 203 bp, Homo sapiens
ggcgcgccagtcctcgacacagtttacttctgtctcgtctgccccaaccgctagcctcggcttgggtaaggcgaggcggaattaaaccccgctccgagagcggcgatactcaaacatatgcgctcggcctatgcctgccccgaggggcgtctggtaggcaccccgccctctcccgcagctcgaccccccgactcggaccgatg

SEQ ID NO: 14121 - DNA, 203 bp, Homo sapiens
ggcgcgccagtcctgcgcccagtttagaagaggataaaagaatcagagctggaatgaaacacacaagaggaccaagtgcctttattccagagaaggaagttgtccaagcaaacacagtggatgaacgtactaactttcttgtggaagaatactctacatccggtcgtctggacaacatcacacaggtccgactcggaccgatg

SEQ ID NO: 14122 - DNA, 203 bp, Homo sapiens
ggcgcgccagtcctctgggtcgtttagaattagaatgtttcttagcgggaacccccactcaattatgtcataagtggataatttgttagctcctataacaaaagtctgttgcttgtgtttcacattttggatttcctaatataatgttctctttttagaaaaggtggacaagtcctattttcaagagacgactcggaccgatg

SEQ ID NO: 14123 - DNA, 203 bp, Homo sapiens
ggcgcgccagtccttcaggacgtttagaattagaatgtttcttagcggtcgtgtagttatttttatgtcataagtgccctgccgcgcctatcctataacaaaagtctgttgcttgtgtttcacattttggatttcctaatataatgttctctttttagaaaaggtggacaagtcctattttcaagagacgactcggaccgatg

SEQ ID NO: 14124 - DNA, 203 bp, Homo sapiens
ggcgcgccagtcctttctcggctttataacggtcgctaaggatgcccttcaggtaccccgaggtaacacgcgacactcgggatctgagaaggggactggggcttctataaaagcgctcggtttaaaaagcttctatgcctgaataggtgaccggaggtcggcacctttcctttacaattaatgaccctcgactcggaccgatg

SEQ ID NO: 14125 - DNA, 203 bp, Homo sapiens
ggcgcgccagtcctctccaacctttatcgaaggaggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggcgactcggaccgatg

SEQ ID NO: 14126 - DNA, 203 bp, Homo sapiens
ggcgcgccagtcctgtgcgaattttcaacaccagcgaacggcgacagatcattttggtgggattctcagattggccgcaactggagcccatcctgtttgtctttatttttattttctactccctaactctctttggcaacaccatcatcatcgctctctcctggctagaccttcggctgcacacacctcgactcggaccgatg

SEQ ID NO: 14127 - DNA, 203 bp, Homo sapiens
ggcgcgccagtcctagcgcgagtttcaacaccagttttgaagatggcttcattttggtgggattctcagattggccgcaactggagcccaagactagctataggatttttattttctactccctaactctctttggcaacaccatcatcatcgctctctcctggctagaccttcggctgcacacacctcgactcggaccgatg

SEQ ID NO: 14128 - DNA, 203 bp, Homo sapiens
ggcgcgccagtcctttatgtgatttcaacaccagttttgaagatggcttcattttggtgggattctcagattggccgcaactggagcccatcctgtttgtctttatttttattttctactccctaactctctaaacttgataatcaatcatcgctctctcctggctagaccttcggctgcacacacctcgactcggaccgatg

SEQ ID NO: 14129 - DNA, 203 bp, Homo sapiens
ggcgcgccagtcctatgtgagatttcaacaccagttttgaagatggcttcattttggtgggattctcagattggccgcaactggagcccatcctgtttgtctttatttttattttctactccctaactctctttggcaacaccatcatcatcgctctctcctggctagaccttccctacaggtattgccgactcggaccgatg

SEQ ID NO: 14130 - DNA, 203 bp, Homo sapiens
ggcgcgccagtcctctttggcgtttcaacaccagttttgaagatggcttcattttggtgggattctcagattggccgcaactggagcccatcctgtttgtctttatttttattttctactccctaactctctttggcaacaccatcccttattggggtcactggctagaccttcggctgcacacacctcgactcggaccgatg

SEQ ID NO: 14131 - DNA, 203 bp, Homo sapiens
ggcgcgccagtcctaattcgtttttcaagggataagaaaccctgcgacaaaacctcctccttttccaagcggctgccgaagatggcggaggtgcaggtcctggtgcttgatggtcgaggccatctcctgggccgcctggcggccatttgacaccttataggaagtacctggctttcctccgcaagcggcgactcggaccgatg

SEQ ID NO: 14132 - DNA, 203 bp, Homo sapiens
ggcgcgccagtcctagtattaatttcaagggatagctgggtggtatgtaaaacctcctccttttccaagcggctgccgaagatggcggaggtgcaggtcctggtgcttgatggtcgaggccatctcctgggccgcctggcggccatcgtggctaaacagtgaagtacctggctttcctccgcaagcggcgactcggaccgatg

SEQ ID NO: 14133 - DNA, 203 bp, Homo sapiens
ggcgcgccagtcctggtgtttctttcagcagcagaaagctatgccaagagtttgaaagaaagcaataaaattaacttttcttcattaggactcacagatgaagaaaaagaggctgcagaacactttctaaatgtgagtgacgacagtcaaaatgattatgagtaattaaaaaaggcattaggccacgtcgactcggaccgatg

SEQ ID NO: 14134 - DNA, 203 bp, Homo sapiens
ggcgcgccagtcctaggaacggtttcagcagcagaaagctatgccaagagtttgaaagaaagcaataaaattaacttttcttcattaggactcacagatgaagaaaaagaggctgcagtggtaaaatagttagtgagtgacgacagtcaaaatgattatgagtaattaaaaaagtgggacaagtcaaacgactcggaccgatg

SEQ ID NO: 14135 - DNA, 203 bp, Homo sapiens
ggcgcgccagtcctcacaagactttcatttgcaagttggagaacgagtatggccggctgacctgctttgccttgctggaccctagatatcacactctgaacaaggtcttgaagcatgaaaaaacaccgctgttccgtaaccaggtcatcattcctctggtgttgtctccagaccgagatgaagatctccgactcggaccgatg

SEQ ID NO: 14136 - DNA, 203 bp, Homo sapiens
ggcgcgccagtccttgtcgttttttcatttgcaagttggagaacgagtatggccggctgacctgctttgccttgctttctggacagctgaacactctgaacaaggtcttgaagcatgaaaaaacaccgctgttccgtaaccaggtcggaggcgtcggtaagttgtctccagaccgagatgaagatctccgactcggaccgatg

SEQ ID NO: 14137 - DNA, 203 bp, Homo sapiens
ggcgcgccagtcctttagccgatttccacacctggttgctgactaattatccgaagacacaagcatacttctgcctgctggggagcctggggactttccacaccctaactgacacacattccacagctggttctttccgcctcagaaggtacctaaccaagttcctctttcagaggttatttcaggcccgactcggaccgatg

SEQ ID NO: 14138 - DNA, 203 bp, Homo sapiens
ggcgcgccagtcctctcccaaatttccacacctggttgctgactaattgagatgcatgctttgcatacttctgcctgctggggagcctggggactttccacacctccctaaggtggggttccacagctggttctttccgcctcagaaggtacctaaccaagttcctctttcagaggttatttcaggcccgactcggaccgatg

SEQ ID NO: 14139 - DNA, 203 bp, Homo sapiens
ggcgcgccagtcctgtgtttagtttccacacctgtacatgattactgggagatgcatgctttgcatacttctgcctgctggggagcctggggactttccacaccctaactgacacacattccacagctggttctttccgcctcagaaggtacctaaccaagttcctctttcagaggttatttcaggcccgactcggaccgatg

SEQ ID NO: 14140 - DNA, 203 bp, Homo sapiens
ggcgcgccagtcctatgggctgtttctgatcagttaccaatctgtacatcaacacacaacaccaacagaagaccaacaaacaaaccaactcacccatccaaccaaacatctatacgccaatcagccaatccaaaactagccacccggaaaaaatagatactatagttacaaaaactatgcttatccgacgactcggaccgatg

SEQ ID NO: 14141 - DNA, 203 bp, Homo sapiens
ggcgcgccagtcctggaggcagtttgcaattttaagccagtgtttgggtttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggcgactcggaccgatg

SEQ ID NO: 14142 - DNA, 203 bp, Homo sapiens
ggcgcgccagtcctctttaagctttgcaattttatattttgcaaatattttgagagacattgatttttctccccgtgctcccccgttcttccctgcggagtgcgctgcgccgcccagctaacaacaaaaatcgaggtgatccctccctcctgcctgcccgccagcctgacctgtgcccggctcgcgggcgactcggaccgatg

SEQ ID NO: 14143 - DNA, 203 bp, Homo sapiens
ggcgcgccagtcctaggcgtactttgcaattttatattttgcaaatattttgagagacattgatttttctccccgtgctcccccgttcttccctgcggagtgcggaaacttagtggttcctgtcgccccccggaggtgatccctccctcctgcctgcccgccagcctgacctgtgcccggctcgcgggcgactcggaccgatg

SEQ ID NO: 14144 - DNA, 203 bp, Homo sapiens
ggcgcgccagtcctccgggccctttgcctgctgccttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatcgactcggaccgatg

SEQ ID NO: 14145 - DNA, 203 bp, Homo sapiens
ggcgcgccagtcctttcgtctgtttgccttggttaagccccatagaaacgaggcgtcacgtgccgaaaatccctttgcgtttcacagaaccatcctaaccatgggtgtagtatgggaactacaagccccttagattaggatctctcgtagagggataggtgtgccattcaaatccagggagtactctgcgactcggaccgatg

SEQ ID NO: 14146 - DNA, 203 bp, Homo sapiens
ggcgcgccagtcctgacggcggtttgccttggttaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctgcgactcggaccgatg

SEQ ID NO: 14147 - DNA, 203 bp, Homo sapiens
ggcgcgccagtcctcaggaaattttgccttggttaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatctcacatactggacccgactcggaccgatg

SEQ ID NO: 14148 - DNA, 203 bp, Homo sapiens
ggcgcgccagtccttatgcttctttgccttggttaagccccatagaaacgaggcgtcacgtggattcttcagggccgcgtttcacagaaccatcctaaccatgggtgtagtatgggaatcgtgtatggggatgattaggatctctcgtagagggataggtgtgccattcaaatccagggagtactctgcgactcggaccgatg

SEQ ID NO: 14149 - DNA, 203 bp, Homo sapiens
ggcgcgccagtcctgtgtgctatttgccttggttttagtatggtatctcgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctgcgactcggaccgatg

SEQ ID NO: 14150 - DNA, 203 bp, Homo sapiens
ggcgcgccagtcctcaagttgatttgcttctcactttacattacgtaggtcatcggagcatgatagtaataattttggtgttgtaactagttttactacttatggtaatactgtttctgaggctgtgtctagattagttgaatcagcttctgaatttattgtttggcgtgcagaggcacttaataagtcgactcggaccgatg

SEQ ID NO: 14151 - DNA, 203 bp, Homo sapiens
ggcgcgccagtccttgaatgtatttgcttctcactttacattacgtagtcacgatatttcccatagtaataattttggtgttgtaactagacaggactaagtgcgtaatactgtttctgaggctgtgtctagattagttgaatcagcttctgaatttattgtttggcgtgcagaggcacttaataagtcgactcggaccgatg

SEQ ID NO: 14152 - DNA, 203 bp, Homo sapiens
ggcgcgccagtcctcgataacgtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactccgactcggaccgatg

SEQ ID NO: 14153 - DNA, 203 bp, Homo sapiens
ggcgcgccagtcctgccgccactttgtctttactaggccaccgtctcgtcagcgttacggagtattttgtccgcctgccgccgccgtcccagatattaatcacggagttccagggagaaggaacttgtgaaatgggggagccggctggggttgccggcacgccacttatcgagattagcccgggactccgactcggaccgatg

SEQ ID NO: 14154 - DNA, 203 bp, Homo sapiens
ggcgcgccagtcctccaacggctttgtctttactctcagtatccaaactcagcgttacggagtattttgtccgcctgccgccgccgtcccagatattaatcacggagttccagggagaaggaacttgtgaaatgggggagccggctggggttgccggcaccatggagtcaccttttagcccgggactccgactcggaccgatg

SEQ ID NO: 14155 - DNA, 203 bp, Homo sapiens
ggcgcgccagtcctaacattggtttgtgtgtttggactagcggcaccatttgttcgtcacttgtcgacagcgccctgcgaattggtgtacccacaccgcgcggcttgcgaataatactttggagagtcttttgcctccagtgtcttccgtttgtactcgtcctcctctccctctccggccgggatgggcgactcggaccgatg

SEQ ID NO: 14156 - DNA, 203 bp, Homo sapiens
ggcgcgccagtccttgttgtaatttgtgtgtttgtttgttaccttgtgagacaattaacaaggtcgacagcgccctgcgaattggtgtacccacaccgcgcggcttgcgaataatactttggagagtcttttgcctccagtgtcttccgtttgtactcgtcctcctctccctctccggccgggatgggcgactcggaccgatg

SEQ ID NO: 14157 - DNA, 203 bp, Homo sapiens
ggcgcgccagtcctggtttcggtttgtgtgtttgtttgttaccttgtgtttgttcgtcacttcgtttgtaacaatcgcgaattggtgtacccacaccgcgcggcttgcgaataatactttggagagtcttttgcctccagtgtcttccgtttgtactcgtcctcctctccctctccggccgggatgggcgactcggaccgatg

SEQ ID NO: 14158 - DNA, 203 bp, Homo sapiens
ggcgcgccagtcctttattcggtttgtgtgtttgtttgttaccttgtgtttgttcgtcacttgtcgacagcgccctgcgaattggtgtacccacaccgcgcggcgatgtgggctcggcttggagagtcttttgcctccagtgtcttccgtttgtactcgtcctcctctccctctccggccgggatgggcgactcggaccgatg

SEQ ID NO: 14159 - DNA, 203 bp, Homo sapiens
ggcgcgccagtccttcgagagatttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtaacatgtcgaggtcccggccgggatgggcgactcggaccgatg

SEQ ID NO: 14160 - DNA, 203 bp, Homo sapiens
ggcgcgccagtcctgaaagctgtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctccctcttgtaaacaagcccacgactcggaccgatg

SEQ ID NO: 14161 - DNA, 203 bp, Homo sapiens
ggcgcgccagtcctcatttaaatttgtgtgtttgtttgttaccttgtgtttgttcgtcacttgtcgacagcgccctgcgaattggtgtacccacaccgcgcggcttgcgaataatactttggagagtcttttgcctccagtgtcttgtaaagcctacgagcctcctctccctctccggccgggatgggcgactcggaccgatg

SEQ ID NO: 14162 - DNA, 203 bp, Homo sapiens
ggcgcgccagtcctaatcgaactttgttcaccacatcagtcaccctttattctggtcccatgcgtcctctgcccaagaaacacgtagaacccatggcagtgcgacagctgcttcttggcaactccaccatgatcaggcacacttgtcccatgtctgtcccgttgagccggcaagtcaaggaagttgctcgactcggaccgatg

SEQ ID NO: 14163 - DNA, 203 bp, Homo sapiens
ggcgcgccagtccttcattccttttgttcaccaccattcctggtgcccattctggtcccatgatagagagtgaagcgaaacacgtagaacccatggcagtgcgacagctgcttcttggcaactccaccatgatcaggcacacttgtcccatgtctgtcccgttgagccggcaagtcaaggaagttgctcgactcggaccgatg

SEQ ID NO: 14164 - DNA, 203 bp, Homo sapiens
ggcgcgccagtcctgtaaaccgtttgttcaccaccattcctggtgcccattctggtcccatgcgtcctctgcccaagaaacacgtagaacccatggcagtgcgaagcacctgagactacaactccaccatgatcaggcacacttgtcccatgtctgtcccgttgagccggcaagtcaaggaagttgctcgactcggaccgatg

SEQ ID NO: 14165 - DNA, 203 bp, Homo sapiens
ggcgcgccagtccttctcagtctttgttcaccaccattcctggtgcccattctggtcccatgcgtcctctgcccaagaaacacgtagaacccatggcagtgcgacagctgcttcttggcaactccaccatgatcaggcacacttgtttgtccctgaaaaggttgagccggcaagtcaaggaagttgctcgactcggaccgatg

SEQ ID NO: 14166 - DNA, 203 bp, Homo sapiens
ggcgcgccagtcctcgaagatgtttgttcaccaccattcctggtgcccattctggtcccatgcgtcctctgcccaagaaacacgtagaacccatggcagtgcgacagctgcttcttggtggacggggacgcttcaggcacacttgtcccatgtctgtcccgttgagccggcaagtcaaggaagttgctcgactcggaccgatg

SEQ ID NO: 14167 - DNA, 203 bp, Homo sapiens
ggcgcgccagtccttcctcttatttgttcaccaccattcctggtgcccattctggtcccatgcgtcctctgcccaatttggttcctacttccatggcagtgcgacagctgcttcttggcaactccaccatgatcaggcacacttgtcccatgtctgtcccgttgagccggcaagtcaaggaagttgctcgactcggaccgatg

SEQ ID NO: 14168 - DNA, 203 bp, Homo sapiens
ggcgcgccagtccttgatggcgtttgttcaccaccattcctggtgccccggagtaagttcgccgtcctctgcccaagaaacacgtagaacccatggcagtgcgacagctgcttcttggcaactccaccatgatcaggcacacttgtcccatgtctgtcccgttgagccggcaagtcaaggaagttgctcgactcggaccgatg

SEQ ID NO: 14169 - DNA, 203 bp, Homo sapiens
ggcgcgccagtcctagtcatctttttacagatatgtctgctatgtggggacgataagtcgagttccccgggataagcctcactcgtcccctctcggggggcggaacacccacctgctagccccgctgctctctttgctttcctcctcgcttcggtctcccccaactcctagcatcccctcctatcgctcgactcggaccgatg

SEQ ID NO: 14170 - DNA, 203 bp, Homo sapiens
ggcgcgccagtccttgtaattattttacttctgaacgaaatggagaaagatcgggtagtaggcttcagacttgaacaagaaactgggtctcactatgttgcccaggttgatattgaactcctggactcaagcaaccctccctctttggcctctgaaagtactgggattacaagcataagccaccgggccgactcggaccgatg

SEQ ID NO: 14171 - DNA, 203 bp, Homo sapiens
ggcgcgccagtcctacatctgcttttagatttaagtaagtttgaatgtaaacataaagccactgttgttgttacaccagctcgcgccctcgtaaatgatatggttttgagtttgattaagagtggtaggttgttgttacgcaataatggtcgttttggtggttttagtaatcatttagtctcaactaacgactcggaccgatg

SEQ ID NO: 14172 - DNA, 203 bp, Homo sapiens
ggcgcgccagtcctaagaatgcttttagatttaagtaagtttgaatgtaaacataaagccactgttgttgttacacttaaagatagtgatgtaaatgatatggttttgagtttgattaagagtggtaggttgttgttacgcaataagctcgtgaagttccgttttagtaatcatttagtctcaactaacgactcggaccgatg

SEQ ID NO: 14173 - DNA, 203 bp, Homo sapiens
ggcgcgccagtcctcgtggttattttagatttaagtaagtttgaatgtaaacataaagccactgttgttgttacacttaaagatagtgatgtaaatgatatggttttgagtttgattattctcccaccagacttgttacgcaataatggtcgttttggtggttttagtaatcatttagtctcaactaacgactcggaccgatg

SEQ ID NO: 14174 - DNA, 203 bp, Homo sapiens
ggcgcgccagtccttcatagtgttttataataatcgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagcgactcggaccgatg

SEQ ID NO: 14175 - DNA, 203 bp, Homo sapiens
ggcgcgccagtccttaacgcccttttgaagtattatttttatgaatcaagccctggaaaaggacaagatatttgaaatgctctcgtaaagtaatggagaacttcacagttgctactcctgtgataggtttatcttagtttcattgtggtataaatggaatagcaggtgttgtcaggtacaaggtttgtcgactcggaccgatg

SEQ ID NO: 14176 - DNA, 203 bp, Homo sapiens
ggcgcgccagtcctgaggcaccttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtcgactcggaccgatg

SEQ ID NO: 14177 - DNA, 203 bp, Homo sapiens
ggcgcgccagtcctcaccaaggttttgaagtattatttttatgaatcaagccctggaaaaggcgccaggccccttctgaaatagcacccataatggagaacttcacagttgctactcctgtgataggtttatcttagtttcattgtggtataaatggaatagcaggtgttgtcaggtacaaggtttgtcgactcggaccgatg

SEQ ID NO: 14178 - DNA, 203 bp, Homo sapiens
ggcgcgccagtcctttgtcaccttttgaagtattccgcaacaagcaacagccctggaaaaggacaagatatttgaatgaaatagcacccataatggagaacttcacagttgctactcctgtgataggtttatcttagtttcattgtggtataaatggaatagcaggtgttgtcaggtacaaggtttgtcgactcggaccgatg

SEQ ID NO: 14179 - DNA, 203 bp, Homo sapiens
ggcgcgccagtcctgctcagcttttttcatctaacctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgacgactcggaccgatg

SEQ ID NO: 14180 - DNA, 203 bp, Homo sapiens
ggcgcgccagtcctaggctcttctaacaatttccggcgggtgagattttcccggcgggtattctatagccggcgggtggcaaaataccggcgggttaggaggagccggcgggtgaacaaattccggcgggttacatttagccggcgggtatgaaaattccggcgggtaatgtatatccggcgggttttcgactcggaccgatg

SEQ ID NO: 14181 - DNA, 203 bp, Homo sapiens
ggcgcgccagtcctagtaaagttgagaaaaacaccggccgtcattaagaaaccggccgtttcgtagtgaccggccgttggaaggagaccggccgtttcagcttgaccggccgtttgttacttaccggccgttttttgaaaaccggccgtacaaggtagaccggccgtatatccaaaaccggccgtgatcgactcggaccgatg

SEQ ID NO: 14182 - DNA, 203 bp, Homo sapiens
ggcgcgccagtcctagctctgtatagaaaaactatgaagaacattaagaagatctttctttcgtagtgttcttttactggaaggagtactcccatttcagcttgtactcccaattgttactttactccccctttttgaaatactcccacacaaggtagtactcccttatatccaaatactcccttgatcgactcggaccgatg

SEQ ID NO: 14183 - DNA, 203 bp, Homo sapiens
ggcgcgccagtccttgacgattctagaaaaactatgaagaacattaagaagatctttctttcgtagtgttcttttactggaaggagtattccaatttcagcttgttggattaattgttacttaaattgtcctttttgaaaccggcgggtacaaggtagccggcgggtatatccaaaccggcgggtgatcgactcggaccgatg

SEQ ID NO: 14184 - DNA, 203 bp, Homo sapiens
ggcgcgccagtcctaggcttacaaagaaaaactatgaagaacattaagaagatctttctttcgtagtgttcttttactggaaggagtattccaatttcagcttgttggattaattgttacttaaattgtcctttttgaaattaattcacacaaggtagccggcgggtatatccaaaccggcgggtgatcgactcggaccgatg

SEQ ID NO: 14185 - DNA, 203 bp, Homo sapiens
ggcgcgccagtcctacttaagcctagaaaaactatgaagaacattaagaagatctttctttcgtagtgttcttttactggaaggagtattccaatttcagcttgttggattaattgttacttaaattgtcctttttgaaattaattcacacaaggtagcgtcaattcctttacaaaataaattttgatcgactcggaccgatg

SEQ ID NO: 14186 - DNA, 203 bp, Homo sapiens
ggcgcgccagtccttggtgagccaagaaaaactatgaagaacattaagaagatctttctttcgtagtgttcttttactggaaggagtattccaatttcagcttgttggattaattgttacttaaattgtcctttttgaaattaattcacacaaggtagtactcccttatatccaaatactcccttgatcgactcggaccgatg

SEQ ID NO: 14187 - DNA, 203 bp, Homo sapiens
ggcgcgccagtccttagtttgcaaagaaaaactatgaagaacattaagaagatctttctttcgtagtgttcttttactggaaggagtattccaatttcagcttgttggattaattgttacttaaattgtcctttttgaaattaattcacacaaggtagtttaaatttatatccaaattcttggcaaatcgactcggaccgatg

SEQ ID NO: 14188 - DNA, 203 bp, Homo sapiens
ggcgcgccagtcctaacgaaagagagacagggaacctgagcaaccaggcaaagaagacacctagggatcgtcaattcctttaagaccgtcaattcctttaataccgtcaattcctttaccatcgtcaattcctttatccccgtcaattcctttacagacgtcaattcctttaagccctagataactagcgactcggaccgatg

SEQ ID NO: 14189 - DNA, 203 bp, Homo sapiens
ggcgcgccagtcctaacagacagtagacagggaacctgagcaaccaggcaaagaagacacctagggatggaagacctccactagacaaagaccagtgcgcataccacggaatcgagaaccatcacggaatcgagaatccccacggaatcgagaacagacacggaatcgagaaagccctagataactagcgactcggaccgatg

SEQ ID NO: 14190 - DNA, 203 bp, Homo sapiens
ggcgcgccagtccttgtaaaccgtagacagggaacctgagcaaccaggcaaagaagacacctagggatggaagacctccactagacaaagaccagtgcgcatactactcccagaagggccattactcccgagaatgtccctactcccaacacgtcagatactcccaggttctagcctactcccactagcgactcggaccgatg

SEQ ID NO: 14191 - DNA, 203 bp, Homo sapiens
ggcgcgccagtcctctaagattctagacagggaacctgagcaaccaggcaaagaagacacctagggatggaagacctccactagacaaagaccagtgcgcatactgtaaagagaagggccattgggcaagagaatgtcccccggcgggtcacgtcagaccggcgggtgttctagccccggcgggttagcgactcggaccgatg

SEQ ID NO: 14192 - DNA, 203 bp, Homo sapiens
ggcgcgccagtcctaccaacctttagacagggaacctgagcaaccaggcaaagaagacacctagggatggaagacctccactagacaaagaccagtgcgcatactgtaaagagaagggccattgggcaagagaatgtccccgaaaaaaacacgtcagaccggcgggtgttctagccccggcgggttagcgactcggaccgatg

SEQ ID NO: 14193 - DNA, 203 bp, Homo sapiens
ggcgcgccagtccttacaaaggttagacagggaacctgagcaaccaggcaaagaagacacctagggatggaagacctccactagacaaagaccagtgcgcatactgtaaagagaagggccattgggcaagagaatgtccccgaaaaaaacacgtcagagaagccaaggttctagccctagataactagcgactcggaccgatg

SEQ ID NO: 14194 - DNA, 203 bp, Homo sapiens
ggcgcgccagtccttagtcagactagacagggaacctgagcaaccaggcaaagaagacacctagggatggaagacctccactagacaaagaccagtgcgcatactgtaaagagaagggccattgggcaagagaatgtccctactcccaacacgtcagatactcccaggttctagcctactcccactagcgactcggaccgatg

SEQ ID NO: 14195 - DNA, 203 bp, Homo sapiens
ggcgcgccagtcctcagctgaggtagacagggaacctgagcaaccaggcaaagaagacacctagggatggaagacctccactagacaaagaccagtgcgcatactgtaaagagaagggccattgggcaagagaatgtcccttcttggcaaacgtcagattcttggcaaatctagccttcttggcaaagcgactcggaccgatg

SEQ ID NO: 14196 - DNA, 203 bp, Homo sapiens
ggcgcgccagtccttgcttaagcaagacagggaacctgagcaaccaggcaaagaagacacctagggatggaagacctccactagacaccggccgttgcgcatacaccggccgtaagggccataccggccgtgaatgtcccaccggccgtcacgtcagaaccggccgtgttctagccaccggccgttagcgactcggaccgatg

SEQ ID NO: 14197 - DNA, 203 bp, Homo sapiens
ggcgcgccagtcctaaccttcttgagacagggaacctgagcaaccaggcaaagaagacacctagggatggaagacctccactagacccggcgggttgcgcatacccggcgggtaagggccatccggcgggtgaatgtcccccggcgggtcacgtcagaccggcgggtgttctagccccggcgggttagcgactcggaccgatg

SEQ ID NO: 14198 - DNA, 203 bp, Homo sapiens
ggcgcgccagtcctaatggtagttagacagggaacctgagcaaccaggcaaagaagacacctagggatggaagacctccactagaccgtcaattcctttaataccgtcaattcctttaccatcgtcaattcctttatccccgtcaattcctttacagacgtcaattcctttaagccctagataactagcgactcggaccgatg

SEQ ID NO: 14199 - DNA, 203 bp, Homo sapiens
ggcgcgccagtccttaacagagttagacagggaacctgagcaaccaggcaaagaagacacctagggatggaagacctccactagacttcttggcaaacgcatacttcttggcaaagggccatttcttggcaaaatgtcccttcttggcaaacgtcagattcttggcaaatctagccttcttggcaaagcgactcggaccgatg

SEQ ID NO: 14200 - DNA, 203 bp, Homo sapiens
ggcgcgccagtcctcactagcttaagacagggaacctgagcaaccaggcatactccccacctagggattactcccctccactagactactcccagtgcgcatactactcccagaagggccattactcccgagaatgtccctactcccaacacgtcagatactcccaggttctagcctactcccactagcgactcggaccgatg

SEQ ID NO: 14201 - DNA, 203 bp, Homo sapiens
ggcgcgccagtccttagcttgctgagacagggaacctgagcaaccaggcattcttggcaaatagggatttcttggcaaaactagacttcttggcaaacgcatacttcttggcaaagggccatttcttggcaaaatgtcccttcttggcaaacgtcagattcttggcaaatctagccttcttggcaaagcgactcggaccgatg

SEQ ID NO: 14202 - DNA, 203 bp, Homo sapiens
ggcgcgccagtcctcaggactcgtagacagggccggcgggtaaccaggcaccggcgggtcctagggatccggcgggtccactagacccggcgggttgcgcatacccggcgggtaagggccatccggcgggtgaatgtcccccggcgggtcacgtcagaccggcgggtgttctagccccggcgggttagcgactcggaccgatg

SEQ ID NO: 14203 - DNA, 203 bp, Homo sapiens
ggcgcgccagtcctcagactgctgagacagggcgtcaattcctttaggcacgtcaattcctttaggatcgtcaattcctttaagaccgtcaattcctttaataccgtcaattcctttaccatcgtcaattcctttatccccgtcaattcctttacagacgtcaattcctttaagccctagataactagcgactcggaccgatg

SEQ ID NO: 14204 - DNA, 203 bp, Homo sapiens
ggcgcgccagtccttgcagtagctagacagggtactcccgcaaccaggcatactccccacctagggattactcccctccactagactactcccagtgcgcatactactcccagaagggccattactcccgagaatgtccctactcccaacacgtcagatactcccaggttctagcctactcccactagcgactcggaccgatg

SEQ ID NO: 14205 - DNA, 203 bp, Homo sapiens
ggcgcgccagtcctagactgtgctagacagggttcttggcaaaccaggcattcttggcaaatagggatttcttggcaaaactagacttcttggcaaacgcatacttcttggcaaagggccatttcttggcaaaatgtcccttcttggcaaacgtcagattcttggcaaatctagccttcttggcaaagcgactcggaccgatg

SEQ ID NO: 14206 - DNA, 203 bp, Homo sapiens
ggcgcgccagtcctaaaactctcaagcagccgcacggaatcgagaacacacacggaatcgagaaaagccacggaatcgagaatgtgcacggaatcgagaattcccacggaatcgagaatgcgcacggaatcgagaaaaagcacggaatcgagaaacaccacggaatcgagaatgcagcatgtcttcaacgactcggaccgatg

SEQ ID NO: 14207 - DNA, 203 bp, Homo sapiens
ggcgcgccagtcctagtagctaaaagcagccgcgtcaattcctttacacacgtcaattcctttaaagccgtcaattcctttatgtgcgtcaattcctttattcccgtcaattcctttatgcgcgtcaattcctttaaaagcgtcaattcctttaacaccgtcaattcctttatgcagcatgtcttcaacgactcggaccgatg

SEQ ID NO: 14208 - DNA, 203 bp, Homo sapiens
ggcgcgccagtcctcaactgctaaagcagccgggaacagctctgaccacacacggaatcgagaaaagccacggaatcgagaatgtgcacggaatcgagaattcccacggaatcgagaatgcgcacggaatcgagaaaaagcacggaatcgagaaacaccacggaatcgagaatgcagcatgtcttcaacgactcggaccgatg

SEQ ID NO: 14209 - DNA, 203 bp, Homo sapiens
ggcgcgccagtcctaatggactggagcagccgggaacagctctgaccacacgtcaattcctttaaagccgtcaattcctttatgtgcgtcaattcctttattcccgtcaattcctttatgcgcgtcaattcctttaaaagcgtcaattcctttaacaccgtcaattcctttatgcagcatgtcttcaacgactcggaccgatg

SEQ ID NO: 14210 - DNA, 203 bp, Homo sapiens
ggcgcgccagtcctatgaggactgagcagccgggaacagctctgaccacagtggttccggggagaagccacggaatcgagaatgtgcacggaatcgagaattcccacggaatcgagaatgcgcacggaatcgagaaaaagcacggaatcgagaaacaccacggaatcgagaatgcagcatgtcttcaacgactcggaccgatg

SEQ ID NO: 14211 - DNA, 203 bp, Homo sapiens
ggcgcgccagtccttaactggactagcagccgggaacagctctgaccacagtggttccggggagaagccgtcaattcctttatgtgcgtcaattcctttattcccgtcaattcctttatgcgcgtcaattcctttaaaagcgtcaattcctttaacaccgtcaattcctttatgcagcatgtcttcaacgactcggaccgatg

SEQ ID NO: 14212 - DNA, 203 bp, Homo sapiens
ggcgcgccagtccttcgctacgttagcagccgggaacagctctgaccacagtggttccggggagaagcctttccaggacccatgtgtaggcacaactgttttccctgatcaggatacttgcggcactcaacagaggaaagaaattcctaagggaacacccggcgggtagtactgcaccggcgggtcaacgactcggaccgatg

SEQ ID NO: 14213 - DNA, 203 bp, Homo sapiens
ggcgcgccagtcctttaaagtgtaagcagccgggaacagctctgaccacagtggttccggggagaagcctttccaggacccatgtgtaggcacaactgttttccctgatcaggatacttgcggcactcaacagaggaaagaaattcctaagggaacacttcttggcaaatactgcattcttggcaaaacgactcggaccgatg

SEQ ID NO: 14214 - DNA, 203 bp, Homo sapiens
ggcgcgccagtcctacgttcaagtagcagccgggaacagctctgaccacagtggttccggggagaagcctttccaggacccatgtgtaggcacaactgttttccctgatcaggatacttgcggcactcaacagaggaaagcacggaatcgagaaacaccacggaatcgagaatgcagcatgtcttcaacgactcggaccgatg

SEQ ID NO: 14215 - DNA, 203 bp, Homo sapiens
ggcgcgccagtcctatggatacaaagcagccgggaacagctctgaccacagtggttccggggagaagcctttccaggacccatgtgtaggcacaactgttttccctgatcaggatacttgcggcactcaacagaggaaagcgtcaattcctttaacaccgtcaattcctttatgcagcatgtcttcaacgactcggaccgatg

SEQ ID NO: 14216 - DNA, 203 bp, Homo sapiens
ggcgcgccagtccttgtgcagtgtagcagccgggaacagctctgaccacagtggttccggggagaagcctttccaggacccatgtgtaggcacaactgttttccctgatcaggatacttgcggcactcaacagaggaaagtactccctaagggaacactactcccaaagtactgcatactcccttcaacgactcggaccgatg

SEQ ID NO: 14217 - DNA, 203 bp, Homo sapiens
ggcgcgccagtccttaaggttaggagcagccgggaacagctctgaccacattcttggcaaagagaagcttcttggcaaaccatgtgttcttggcaaagttttccttcttggcaaaacttgcgttcttggcaaaaggaaagttcttggcaaaggaacacttcttggcaaatactgcattcttggcaaaacgactcggaccgatg

SEQ ID NO: 14218 - DNA, 203 bp, Homo sapiens
ggcgcgccagtcctttgcaaaaggagcagccgtactcccctctgaccacatactccccggggagaagctactcccggacccatgtgtactcccaactgttttcctactcccggatacttgcgtactcccacagaggaaagtactccctaagggaacactactcccaaagtactgcatactcccttcaacgactcggaccgatg

SEQ ID NO: 14219 - DNA, 203 bp, Homo sapiens
ggcgcgccagtcctacatggtaggagcagccgttcttggcaaagaccacattcttggcaaagagaagcttcttggcaaaccatgtgttcttggcaaagttttccttcttggcaaaacttgcgttcttggcaaaaggaaagttcttggcaaaggaacacttcttggcaaatactgcattcttggcaaaacgactcggaccgatg

SEQ ID NO: 14220 - DNA, 203 bp, Homo sapiens
ggcgcgccagtccttagctaagtgagcctcctcacggaatcgagaacctacacggaatcgagaaaggacacggaatcgagaattaacacggaatcgagaagagccacggaatcgagaacaagcacggaatcgagaaccctcacggaatcgagaacaatcacggaatcgagaatgaccagtcacagattcgactcggaccgatg

SEQ ID NO: 14221 - DNA, 203 bp, Homo sapiens
ggcgcgccagtccttccagtgcatagcctcctcgtcaattcctttacctacgtcaattcctttaaggacgtcaattcctttattaacgtcaattcctttagagccgtcaattcctttacaagcgtcaattcctttaccctcgtcaattcctttacaatcgtcaattcctttatgaccagtcacagattcgactcggaccgatg

SEQ ID NO: 14222 - DNA, 203 bp, Homo sapiens
ggcgcgccagtcctacctcaagtgagcctcctgttgcacggtcttgcctaaccggccgtctccaaggaaccggccgtcataattaaaccggccgtatgtcgagcaccggccgtaagaccaagaccggccgtaagcgccctaccggccgtacatccaataccggccgtatgtttgacaccggccgtattcgactcggaccgatg

SEQ ID NO: 14223 - DNA, 203 bp, Homo sapiens
ggcgcgccagtcctctaaggtccaagcctcctgttgcacggtcttgcctaaggtgaagcctccaaggaagccattagcataattaaacaaccaccatgtcgagcaaaaaggcaaagaccaagaccaccaagaagcgccctaccggccgtacatccaataccggccgtatgtttgacaccggccgtattcgactcggaccgatg

SEQ ID NO: 14224 - DNA, 203 bp, Homo sapiens
ggcgcgccagtcctagtctttcatagcctcctgttgcacggtcttgcctaaggtgaagcctccaaggaagccattagcataattaaacaaccaccatgtcgagcaaaaaggcaaagaccaagaccaccaagaagcgccctcagcgtgcaacatccaatcacggaatcgagaatgaccagtcacagattcgactcggaccgatg

SEQ ID NO: 14225 - DNA, 203 bp, Homo sapiens
ggcgcgccagtcctctgactaggtagcctcctgttgcacggtcttgcctaaggtgaagcctccaaggaagccattagcataattaaacaaccaccatgtcgagcaaaaaggcaaagaccaagaccaccaagaagcgccctcagcgtgcaacatccaatgtgtttgccatgtttgaccagtcacagattcgactcggaccgatg

SEQ ID NO: 14226 - DNA, 203 bp, Homo sapiens
ggcgcgccagtcctctgacggtgaagcctcctgttgcacggtcttgcctaaggtgaagcctccaaggaagccattagcataattaaacaaccaccatgtcgagcaaaaaggcaaagaccaagaccaccaagaagcgccctcagcgtgcaacatccaatgtgtttgccatgtttgacccggcgggtattcgactcggaccgatg

SEQ ID NO: 14227 - DNA, 203 bp, Homo sapiens
ggcgcgccagtcctctttcttcagagcctcctgttgcacggtcttgcctaaggtgaagcctccaaggaagccattagcataattaaacaaccaccatgtcgagcaaaaaggcaaagaccaagaccggccgtaagcgccctaccggccgtacatccaataccggccgtatgtttgacaccggccgtattcgactcggaccgatg

SEQ ID NO: 14228 - DNA, 203 bp, Homo sapiens
ggcgcgccagtccttgtccaagaaagcctcctgttgcacggtcttgcctaaggtgaagcctccaaggaagccattagcataattaaacaaccaccatgtcgagcaaaaaggcaaagaccaagccggcgggtaagcgccctccggcgggtacatccaatccggcgggtatgtttgacccggcgggtattcgactcggaccgatg

SEQ ID NO: 14229 - DNA, 203 bp, Homo sapiens
ggcgcgccagtccttacagttaagagcctcctgttgcacggtcttgcctaaggtgaagcctccaaggaagccattagcataattaaacaaccaccatgtcgagccgtcaattcctttacaagcgtcaattcctttaccctcgtcaattcctttacaatcgtcaattcctttatgaccagtcacagattcgactcggaccgatg

SEQ ID NO: 14230 - DNA, 203 bp, Homo sapiens
ggcgcgccagtcctatccttgccaagcctcctgttgcacggtcttgcctaaggtgaagcctccaaggaagccattagcataattaacacggaatcgagaagagccacggaatcgagaacaagcacggaatcgagaaccctcacggaatcgagaacaatcacggaatcgagaatgaccagtcacagattcgactcggaccgatg

SEQ ID NO: 14231 - DNA, 203 bp, Homo sapiens
ggcgcgccagtcctcttaaggcgtagcctcctgttgcacggtcttgcctaaggtgaagcctccaaggacacggaatcgagaattaacacggaatcgagaagagccacggaatcgagaacaagcacggaatcgagaaccctcacggaatcgagaacaatcacggaatcgagaatgaccagtcacagattcgactcggaccgatg

SEQ ID NO: 14232 - DNA, 203 bp, Homo sapiens
ggcgcgccagtcctatcacaaaggagcctcctgttgcacggtcttgcctatactcccgcctccaaggatactcccagcataattaatactcccccatgtcgagctactccccaaagaccaagtactcccagaagcgcccttactccccaacatccaattactcccccatgtttgactactcccagattcgactcggaccgatg

SEQ ID NO: 14233 - DNA, 203 bp, Homo sapiens
ggcgcgccagtcctagaaaggtttaggcgcttacagtgcaccaagatggccgcccccgtggatctagagctgaagaaggccttcacagagcttcaagccaaagttactcccactcaacagaatactcccctcgcagacattactcccgaacagctaaatactcccaaaaagcatgctactcccacagacgactcggaccgatg

SEQ ID NO: 14234 - DNA, 203 bp, Homo sapiens
ggcgcgccagtcctcaaccggtataggcgcttacagtgcaccaagatggccgcccccgtggatctagagctgaagaaggccttcacagagcttcaagccaaagttattgacactcaacagaaggtgaagctcgcagacatacagattgaacagctaaacacggaatcgagaaatgcacatcttacagacgactcggaccgatg

SEQ ID NO: 14235 - DNA, 203 bp, Homo sapiens
ggcgcgccagtccttgacgaccagaggcgcttacagtgcaccaagatggccgcccccgtggatctagagctgaagaaggccttcacagagcttcaagccaaagttattgacactcaacagaaggtgaagctcgcagacatacagattgaacagctaaatactcccaaaaagcatgctactcccacagacgactcggaccgatg

SEQ ID NO: 14236 - DNA, 203 bp, Homo sapiens
ggcgcgccagtcctctggtacttgaggcgcttacagtgcaccaagatggccgcccccgtggatctagagctgaagaaggccttcacagagcttcaagccaaagttattgacactcaacagaaggtgaagctcgcagacatacagattgaacagctaaattcttggcaaaagcatgcttcttggcaaaacgactcggaccgatg

SEQ ID NO: 14237 - DNA, 203 bp, Homo sapiens
ggcgcgccagtccttggtaggataaggcgcttacagtgcaccaagatggccgcccccgtggatctagagctgaagaaggccttcacagagcttcaagccaaagttattgacactcaacagaaggtgaagctcgcagacatccggcgggtacagctaaaccggcgggtaaagcatgcccggcgggtagacgactcggaccgatg

SEQ ID NO: 14238 - DNA, 203 bp, Homo sapiens
ggcgcgccagtccttctttgagctaggcgcttacagtgcaccaagatggccgcccccgtggatctagagctgaagaaggccttcacagagcttcaagccaaagttattgacactcaacagaaggtgaagctcgcagacatcgtcaattcctttataaacgtcaattcctttaatgcacatcttacagacgactcggaccgatg

SEQ ID NO: 14239 - DNA, 203 bp, Homo sapiens
ggcgcgccagtcctagtctcaaaaaggcgcttacagtgcaccaagatggccgcccccgtggatctagagctgaagaaggccttcacagagcttcaagccaaagttattgacactcaacagaaggtgaagctcgcagacattactcccgaacagctaaatactcccaaaaagcatgctactcccacagacgactcggaccgatg

SEQ ID NO: 14240 - DNA, 203 bp, Homo sapiens
ggcgcgccagtcctctcaaaactaaggcgcttacagtgcaccaagatggccgcccccgtggatctagagctgaagaaggccttcacagagcttcaagccaaagttattgacactcaacagaaggtgaagctcgcagacatttcttggcaaaagctaaattcttggcaaaagcatgcttcttggcaaaacgactcggaccgatg

SEQ ID NO: 14241 - DNA, 203 bp, Homo sapiens
ggcgcgccagtcctaatacagcgaaggcgcttacagtgcaccaagatggccgcccccgtggatctagagctgaagaaggccttcacagagcttcaagccaaagttattgacactcaacagaatactcccctcgcagacattactcccgaacagctaaatactcccaaaaagcatgctactcccacagacgactcggaccgatg

SEQ ID NO: 14242 - DNA, 203 bp, Homo sapiens
ggcgcgccagtcctagctgctgtgaggcgcttacagtgcaccaagatggccgcccccgtggatctagatactcccaaggccttcactactccccaagccaaagttactcccactcaacagaatactcccctcgcagacattactcccgaacagctaaatactcccaaaaagcatgctactcccacagacgactcggaccgatg

SEQ ID NO: 14243 - DNA, 203 bp, Homo sapiens
ggcgcgccagtcctatcagattcaaggcgcttacagtgcaccaagatggccgtcaattcctttatagacgtcaattcctttatcaccgtcaattcctttaaagtcgtcaattcctttaagaacgtcaattcctttaacatcgtcaattcctttataaacgtcaattcctttaatgcacatcttacagacgactcggaccgatg

SEQ ID NO: 14244 - DNA, 203 bp, Homo sapiens
ggcgcgccagtccttgttactggaaggcgcttacagtgcaccaagatggcttcttggcaaaatctagattcttggcaaaccttcacttcttggcaaaccaaagtttcttggcaaaaacagaattcttggcaaacagacatttcttggcaaaagctaaattcttggcaaaagcatgcttcttggcaaaacgactcggaccgatg

SEQ ID NO: 14245 - DNA, 203 bp, Homo sapiens
ggcgcgccagtcctagtatggtcaaggcgcttccggcgggtcaagatggcccggcgggtggatctagaccggcgggtggccttcacccggcgggtagccaaagtccggcgggttcaacagaaccggcgggtcgcagacatccggcgggtacagctaaaccggcgggtaaagcatgcccggcgggtagacgactcggaccgatg

SEQ ID NO: 14246 - DNA, 203 bp, Homo sapiens
ggcgcgccagtcctacgcttacttaggctgccaccggccgtcccccagctaccggccgtgtccctctcaccggccgtctccatccgaccggccgttgcccagggaccggccgtagatgtcgcaccggccgtgcctgtgtcaccggccgttcgttggccaccggccgtccaccagagaccggccgttgacgactcggaccgatg

SEQ ID NO: 14247 - DNA, 203 bp, Homo sapiens
ggcgcgccagtcctccttacttgtaggctgcccacggaatcgagaaagctcacggaatcgagaatctccacggaatcgagaatccgcacggaatcgagaaacggcacggaatcgagaatcgccacggaatcgagaatgtccacggaatcgagaaggcccacggaatcgagaaagaggacagacgttgacgactcggaccgatg

SEQ ID NO: 14248 - DNA, 203 bp, Homo sapiens
ggcgcgccagtcctaggttacttgaggctgccccggcgggtcccccagctccggcgggtgtccctctcccggcgggtctccatccgccggcgggttgcccacggccggcgggtagatgtcgcccggcgggtgcctgtgtcccggcgggttcgttggccccggcgggtccaccagagccggcgggttgacgactcggaccgatg

SEQ ID NO: 14249 - DNA, 203 bp, Homo sapiens
ggcgcgccagtccttgaggtttagaggctgcccgtcaattcctttaagctcgtcaattcctttatctccgtcaattcctttatccgcgtcaattcctttaacggcgtcaattcctttatcgccgtcaattcctttatgtccgtcaattcctttaggcccgtcaattcctttaagaggacagacgttgacgactcggaccgatg

SEQ ID NO: 14250 - DNA, 203 bp, Homo sapiens
ggcgcgccagtcctaaccgttaggaggctgccggcttaggacccccagctaccggccgtgtccctctcaccggccgtctccatccgaccggccgttgcccagggaccggccgtagatgtcgcaccggccgtgcctgtgtcaccggccgttcgttggccaccggccgtccaccagagaccggccgttgacgactcggaccgatg

SEQ ID NO: 14251 - DNA, 203 bp, Homo sapiens
ggcgcgccagtcctcactgaggtgaggctgccggcttaggacccccagctccgacgtaagtccctctccacggaatcgagaatccgcacggaatcgagaaacggcacggaatcgagaatcgccacggaatcgagaatgtccacggaatcgagaaggcccacggaatcgagaaagaggacagacgttgacgactcggaccgatg

SEQ ID NO: 14252 - DNA, 203 bp, Homo sapiens
ggcgcgccagtcctaacctcagttaggctgccggcttaggacccccagctccgacgtaagtccctctcgtgcgccacctccatccgaccggccgttgcccagggaccggccgtagatgtcgcaccggccgtgcctgtgtcaccggccgttcgttggccaccggccgtccaccagagaccggccgttgacgactcggaccgatg

SEQ ID NO: 14253 - DNA, 203 bp, Homo sapiens
ggcgcgccagtcctctacactgagaggctgccggcttaggacccccagctccgacgtaagtccctctcgtgcgccacctccatccgcacggaatcgagaaacggcacggaatcgagaatcgccacggaatcgagaatgtccacggaatcgagaaggcccacggaatcgagaaagaggacagacgttgacgactcggaccgatg

SEQ ID NO: 14254 - DNA, 203 bp, Homo sapiens
ggcgcgccagtcctcttcactctcaggctgccggcttaggacccccagctccgacgtaagtccctctcgtgcgccacctccatccgctgcccctctgcccacgggccgggctcagatgtcgcaccggccgtgcctgtgtcaccggccgttcgttggccaccggccgtccaccagagaccggccgttgacgactcggaccgatg

SEQ ID NO: 14255 - DNA, 203 bp, Homo sapiens
ggcgcgccagtccttgtaacggtcaggctgccggcttaggacccccagctccgacgtaagtccctctcgtgcgccacctccatccgctgcccctctgcccacgggccgggctcagatgtcgccacggaatcgagaatgtccacggaatcgagaaggcccacggaatcgagaaagaggacagacgttgacgactcggaccgatg

SEQ ID NO: 14256 - DNA, 203 bp, Homo sapiens
ggcgcgccagtcctgactcgtctaaggctgccggcttaggacccccagctccgacgtaagtccctctcgtgcgccacctccatccgctgcccctctgcccacgggccgggctcagatgtcgcccggcgggtgcctgtgtcccggcgggttcgttggccccggcgggtccaccagagccggcgggttgacgactcggaccgatg

SEQ ID NO: 14257 - DNA, 203 bp, Homo sapiens
ggcgcgccagtcctcaggactgtcaggctgccggcttaggacccccagctccgacgtaagtccctctcgtgcgccacctccatccgctgcccctctgcccacgggccgggctcagatgtcgccctctggtcgcctgtgtcaccggccgttcgttggccaccggccgtccaccagagaccggccgttgacgactcggaccgatg

SEQ ID NO: 14258 - DNA, 203 bp, Homo sapiens
ggcgcgccagtcctgacgcttgaaaggctgccggcttaggacccccagctccgacgtaagtccctctcgtgcgccacctccatccgctgcccctctgcccacgggccgggctcagatgtcgccctctggtcgcctgtgtccacggaatcgagaaggcccacggaatcgagaaagaggacagacgttgacgactcggaccgatg

SEQ ID NO: 14259 - DNA, 203 bp, Homo sapiens
ggcgcgccagtcctgacctttgtcaggctgccggcttaggacccccagctccgacgtaagtccctctcgtgcgccacctccatccgctgcccctctgcccacgggccgggctcagatgtcgccctctggtcgcctgtgtcttctcaccatcgttggccccggcgggtccaccagagccggcgggttgacgactcggaccgatg

SEQ ID NO: 14260 - DNA, 203 bp, Homo sapiens
ggcgcgccagtccttcagaacgtcaggctgccggcttaggacccccagctccgacgtaagtccctctcgtgcgccacctccatccgctgcccctctgcccacgggccgggctcagatgtcgccctctggtcgcctgtgtcttctcaccatcgttggcctactcccccccaccagagtactcccgttgacgactcggaccgatg

SEQ ID NO: 14261 - DNA, 203 bp, Homo sapiens
ggcgcgccagtcctacagctagtcaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagagaccggccgttgacgactcggaccgatg

SEQ ID NO: 14262 - DNA, 203 bp, Homo sapiens
ggcgcgccagtcctgaccggtcataggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagagccggcgggttgacgactcggaccgatg

SEQ ID NO: 14263 - DNA, 203 bp, Homo sapiens
ggcgcgccagtcctatgacagctcaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagaggacagacgttgacgactcggaccgatg

SEQ ID NO: 14264 - DNA, 203 bp, Homo sapiens
ggcgcgccagtcctgaaccttgctaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagagtactcccgttgacgactcggaccgatg

SEQ ID NO: 14265 - DNA, 203 bp, Homo sapiens
ggcgcgccagtcctgagctcaagaaggctgccggcttaggacccccagctccgacgtaagtccctctcgtgcgccacctccatccgctgcccctctgcccacgggccgggctcagatgtcgccctctggtcgcctgtgtcttctcaccatcgttggccttcttggcaaaaccagagttcttggcaaaacgactcggaccgatg

SEQ ID NO: 14266 - DNA, 203 bp, Homo sapiens
ggcgcgccagtcctatccaagctcaggctgccggcttaggacccccagctccgacgtaagtccctctcgtgcgccacctccatccgctgcccctctgcccacgggccgggctcagatgtcgccgtcaattcctttatgtccgtcaattcctttaggcccgtcaattcctttaagaggacagacgttgacgactcggaccgatg

SEQ ID NO: 14267 - DNA, 203 bp, Homo sapiens
ggcgcgccagtcctgagctgagtaaggctgccggcttaggacccccagctccgacgtaagtccctctcgtgcgccacctccatccgctgcccctctgcccacgggccgggctcagatgtcgctactccctcgcctgtgtctactccccatcgttggcctactcccccccaccagagtactcccgttgacgactcggaccgatg

SEQ ID NO: 14268 - DNA, 203 bp, Homo sapiens
ggcgcgccagtcctgagctgtatcaggctgccggcttaggacccccagctccgacgtaagtccctctcgtgcgccacctccatccgctgcccctctgcccacggtactccctcagatgtcgctactccctcgcctgtgtctactccccatcgttggcctactcccccccaccagagtactcccgttgacgactcggaccgatg

SEQ ID NO: 14269 - DNA, 203 bp, Homo sapiens
ggcgcgccagtcctgaacctctgtaggctgccggcttaggacccccagctccgacgtaagtccctctcgtgcgccacctccatccgctgcccctctgcccacggttcttggcaaaatgtcgcttcttggcaaactgtgtcttcttggcaaagttggccttcttggcaaaaccagagttcttggcaaaacgactcggaccgatg

SEQ ID NO: 14270 - DNA, 203 bp, Homo sapiens
ggcgcgccagtcctgagcagtttgaggctgccggcttaggacccccagctccgacgtaagtccctctcgtgcgccacctccatccgtactccctctgcccacggtactccctcagatgtcgctactccctcgcctgtgtctactccccatcgttggcctactcccccccaccagagtactcccgttgacgactcggaccgatg

SEQ ID NO: 14271 - DNA, 203 bp, Homo sapiens
ggcgcgccagtcctgactgagctcaggctgccggcttaggacccccagctccgacgtaagtccctctcgtgcgccacctccatccgttcttggcaaacccacggttcttggcaaaatgtcgcttcttggcaaactgtgtcttcttggcaaagttggccttcttggcaaaaccagagttcttggcaaaacgactcggaccgatg

SEQ ID NO: 14272 - DNA, 203 bp, Homo sapiens
ggcgcgccagtcctgagttaccgtaggctgccggcttaggacccccagctccgacgtaagtccctctcttcttggcaaaccatccgttcttggcaaacccacggttcttggcaaaatgtcgcttcttggcaaactgtgtcttcttggcaaagttggccttcttggcaaaaccagagttcttggcaaaacgactcggaccgatg

SEQ ID NO: 14273 - DNA, 203 bp, Homo sapiens
ggcgcgccagtcctcaaaaccgtcaggctgccggcttaggacccccagctcgtcaattcctttatctccgtcaattcctttatccgcgtcaattcctttaacggcgtcaattcctttatcgccgtcaattcctttatgtccgtcaattcctttaggcccgtcaattcctttaagaggacagacgttgacgactcggaccgatg

SEQ ID NO: 14274 - DNA, 203 bp, Homo sapiens
ggcgcgccagtcctgacctctgctaggctgccggcttaggacccccagcttactcccaagtccctctctactcccacctccatccgtactccctctgcccacggtactccctcagatgtcgctactccctcgcctgtgtctactccccatcgttggcctactcccccccaccagagtactcccgttgacgactcggaccgatg

SEQ ID NO: 14275 - DNA, 203 bp, Homo sapiens
ggcgcgccagtcctgactcagagaaggctgccggcttaggacccccagctttcttggcaaaccctctcttcttggcaaaccatccgttcttggcaaacccacggttcttggcaaaatgtcgcttcttggcaaactgtgtcttcttggcaaagttggccttcttggcaaaaccagagttcttggcaaaacgactcggaccgatg

SEQ ID NO: 14276 - DNA, 203 bp, Homo sapiens
ggcgcgccagtcctgacggtcattaggctgcctactcccgacccccagcttactcccaagtccctctctactcccacctccatccgtactccctctgcccacggtactccctcagatgtcgctactccctcgcctgtgtctactccccatcgttggcctactcccccccaccagagtactcccgttgacgactcggaccgatg

SEQ ID NO: 14277 - DNA, 203 bp, Homo sapiens
ggcgcgccagtcctcttcaacgtcatatttgaaccggccgttgtatgattaccggccgtgagacaggaaccggccgtaagatggcaaccggccgttctaattagaccggccgttaattttctaccggccgtagtttgttcaccggccgtaacctgcttaccggccgtatcagaaagaccggccgtggacgactcggaccgatg

SEQ ID NO: 14278 - DNA, 203 bp, Homo sapiens
ggcgcgccagtcctccaactggtcatatttgacacggaatcgagaagattcacggaatcgagaaaggacacggaatcgagaaggcacacggaatcgagaattagcacggaatcgagaattctcacggaatcgagaagttccacggaatcgagaagcttcacggaatcgagaaaaagacatccttcggacgactcggaccgatg

SEQ ID NO: 14279 - DNA, 203 bp, Homo sapiens
ggcgcgccagtcctcatgaccttaatatttgattcttggcaaatatgattttcttggcaaagacaggattcttggcaaagatggcattcttggcaaataattagttcttggcaaaattttctttcttggcaaatttgttcttcttggcaaacctgcttttcttggcaaacagaaagttcttggcaaaacgactcggaccgatg

SEQ ID NO: 14280 - DNA, 203 bp, Homo sapiens
ggcgcgccagtcctacggtcatgaatatttgattttttgcatgtatgattaccggccgtgagacaggaaccggccgtaagatggcaaccggccgttctaattagaccggccgttaattttctaccggccgtagtttgttcaccggccgtaacctgcttaccggccgtatcagaaagaccggccgtggacgactcggaccgatg

SEQ ID NO: 14281 - DNA, 203 bp, Homo sapiens
ggcgcgccagtcctttgagtgagtatatttgattttttgcatgtatgattataccatgagagacaggattaatatagaagatggcaaggcaaatttctaattagaccggccgttaattttctaccggccgtagtttgttcaccggccgtaacctgcttaccggccgtatcagaaagaccggccgtggacgactcggaccgatg

SEQ ID NO: 14282 - DNA, 203 bp, Homo sapiens
ggcgcgccagtcctgaacagtctcatatttgattttttgcatgtatgattataccatgagagacaggattaatatagaagatggcaaggcaaatttctaattagagggaatattaattttctacaaaataaagtttgttcatcaatacaaacctgcttcacggaatcgagaaaaagacatccttcggacgactcggaccgatg

SEQ ID NO: 14283 - DNA, 203 bp, Homo sapiens
ggcgcgccagtccttaaactcatgatatttgattttttgcatgtatgattataccatgagagacaggattaatatagaagatggcaaggcaaatttctaattagagggaatattaattttctacaaaataaagtttgttcccggcgggtaacctgcttccggcgggtatcagaaagccggcgggtggacgactcggaccgatg

SEQ ID NO: 14284 - DNA, 203 bp, Homo sapiens
ggcgcgccagtccttcactacactatatttgattttttgcatgtatgattataccatgagagacaggattaatatagaagatggcaaggcaaatttctaattagagggaatattaattttctcgtcaattcctttagttccgtcaattcctttagcttcgtcaattcctttaaaagacatccttcggacgactcggaccgatg

SEQ ID NO: 14285 - DNA, 203 bp, Homo sapiens
ggcgcgccagtccttgtagtgaatatatttgattttttgcatgtatgattttcttggcaaagacaggattcttggcaaagatggcattcttggcaaataattagttcttggcaaaattttctttcttggcaaatttgttcttcttggcaaacctgcttttcttggcaaacagaaagttcttggcaaaacgactcggaccgatg

SEQ ID NO: 14286 - DNA, 203 bp, Homo sapiens
ggcgcgccagtcctaactacactgatgatcttaagtagataagtgctgttaccggccgttcaacagaaaccggccgttacgtctttaccggccgtaagaacacaaccggccgtatgctctcaaccggccgttttttatttaccggccgtggaaagctcaccggccgttacgaatagaccggccgttatcgactcggaccgatg

SEQ ID NO: 14287 - DNA, 203 bp, Homo sapiens
ggcgcgccagtcctactacaactgatgatcttaagtagataagtgctgttcgtcaattcctttaagaacgtcaattcctttactttcgtcaattcctttacacacgtcaattcctttactcacgtcaattcctttaatttcgtcaattcctttagctccgtcaattcctttaatagccaaccctttatcgactcggaccgatg

SEQ ID NO: 14288 - DNA, 203 bp, Homo sapiens
ggcgcgccagtcctacgttaactaatgatcttaagtagataagtgctgttgcttgtagttcaacagaaagctttgagtacgtctttccggcgggtaagaacacaccggcgggtatgctctcaccggcgggttttttatttccggcgggtggaaagctcccggcgggttacgaatagccggcgggttatcgactcggaccgatg

SEQ ID NO: 14289 - DNA, 203 bp, Homo sapiens
ggcgcgccagtccttaagagtattatgatcttaagtagataagtgctgttgcttgtagttcaacagaaagctttgagtacgtctttcgtcaattcctttacacacgtcaattcctttactcacgtcaattcctttaatttcgtcaattcctttagctccgtcaattcctttaatagccaaccctttatcgactcggaccgatg

SEQ ID NO: 14290 - DNA, 203 bp, Homo sapiens
ggcgcgccagtccttttactgtgtatgatcttaagtagataagtgctgttgcttgtagttcaacagaaagctttgagtacgtctttcttgcgagaaagaacacatgcattcttatgctctcaattctattatttttattttgggcgaaaggaaagctctactcccagtacgaatagtactccctttatcgactcggaccgatg

SEQ ID NO: 14291 - DNA, 203 bp, Homo sapiens
ggcgcgccagtcctaggactgtgaatgatcttaagtagataagtgctgttgcttgtagttcaacagaaagctttgagtacgtctttcttgcgagaaagaacacatgcattcttatgctctcaattctattatttttattttgggcgaaaggaaagctctcacgcgagtacgaatagaccggccgttatcgactcggaccgatg

SEQ ID NO: 14292 - DNA, 203 bp, Homo sapiens
ggcgcgccagtccttaaactttggatgatcttaagtagataagtgctgttgcttgtagttcaacagaaagctttgagtacgtctttcttgcgagaaagaacacatgcattcttatgctctcaattctattatttttatttttcttggcaaaaaagctcttcttggcaaacgaatagttcttggcaaatcgactcggaccgatg

SEQ ID NO: 14293 - DNA, 203 bp, Homo sapiens
ggcgcgccagtcctactgctttggatgatcttaagtagataagtgctgttgcttgtagttcaacagaaagctttgagtacgtctttcttgcgagaaagaacacatgcattcttatgctctcaccggcgggttttttatttccggcgggtggaaagctcccggcgggttacgaatagccggcgggttatcgactcggaccgatg

SEQ ID NO: 14294 - DNA, 203 bp, Homo sapiens
ggcgcgccagtcctaacctttggtatgatcttaagtagataagtgctgttgcttgtagttcaacagaaagctttgagtacgtctttcttgcgagaaagaacacatgcattcttatgctctcacgtcaattcctttaatttcgtcaattcctttagctccgtcaattcctttaatagccaaccctttatcgactcggaccgatg

SEQ ID NO: 14295 - DNA, 203 bp, Homo sapiens
ggcgcgccagtcctagtccaggttatgatcttaagtagataagtgctgttgcttgtagttcaacagaaagctttgagtacgtctttttcttggcaaagaacacattcttggcaaagctctcattcttggcaaatttatttttcttggcaaaaaagctcttcttggcaaacgaatagttcttggcaaatcgactcggaccgatg

SEQ ID NO: 14296 - DNA, 203 bp, Homo sapiens
ggcgcgccagtccttctaacactaatgatcttaagtagataagtgctgttgcttgtagttcaacagaaccggcgggttacgtctttccggcgggtaagaacacaccggcgggtatgctctcaccggcgggttttttatttccggcgggtggaaagctcccggcgggttacgaatagccggcgggttatcgactcggaccgatg

SEQ ID NO: 14297 - DNA, 203 bp, Homo sapiens
ggcgcgccagtcctacgactgttcatgatcttaagtagataagtgctgtttactcccgttcaacagaatactcccagtacgtcttttactcccgaaagaacacatactcccttatgctctcatactccctatttttattttactcccaaggaaagctctactcccagtacgaatagtactccctttatcgactcggaccgatg

SEQ ID NO: 14298 - DNA, 203 bp, Homo sapiens
ggcgcgccagtcctgagaactggtatgatcttaccggccgtagtgctgttaccggccgttcaacagaaaccggccgttacgtctttaccggccgtaagaacacaaccggccgtatgctctcaaccggccgttttttatttaccggccgtggaaagctcaccggccgttacgaatagaccggccgttatcgactcggaccgatg

SEQ ID NO: 14299 - DNA, 203 bp, Homo sapiens
ggcgcgccagtccttaccactaggatgatcttcacggaatcgagaatgttcacggaatcgagaaagaacacggaatcgagaactttcacggaatcgagaacacacacggaatcgagaactcacacggaatcgagaaatttcacggaatcgagaagctccacggaatcgagaaatagccaaccctttatcgactcggaccgatg

SEQ ID NO: 14300 - DNA, 203 bp, Homo sapiens
ggcgcgccagtcctatcagtggtcatgatcttccggcgggtagtgctgttccggcgggttcaacagaaccggcgggttacgtctttccggcgggtaagaacacaccggcgggtatgctctcaccggcgggttttttatttccggcgggtggaaagctcccggcgggttacgaatagccggcgggttatcgactcggaccgatg

SEQ ID NO: 14301 - DNA, 203 bp, Homo sapiens
ggcgcgccagtcctcacagtggttatgatcttcgtcaattcctttatgttcgtcaattcctttaagaacgtcaattcctttactttcgtcaattcctttacacacgtcaattcctttactcacgtcaattcctttaatttcgtcaattcctttagctccgtcaattcctttaatagccaaccctttatcgactcggaccgatg

SEQ ID NO: 14302 - DNA, 203 bp, Homo sapiens
ggcgcgccagtccttgtagtggtaatgatctttactccctaagtgctgtttactcccgttcaacagaatactcccagtacgtcttttactcccgaaagaacacatactcccttatgctctcatactccctatttttattttactcccaaggaaagctctactcccagtacgaatagtactccctttatcgactcggaccgatg

SEQ ID NO: 14303 - DNA, 203 bp, Homo sapiens
ggcgcgccagtcctttggtgactgatttgacccgaggcttcttagaagaattcttggcaaatccaagtttcttggcaaaatgtgctttcttggcaaaagaatgattcttggcaaaaaaaattttcttggcaaattttattttcttggcaaagctgaaattcttggcaaacgaaatcttcttggcaaaacgactcggaccgatg

SEQ ID NO: 14304 - DNA, 203 bp, Homo sapiens
ggcgcgccagtcctacgtactcgtatttgacccgaggcttcttagaagaattttttaacattccaagtttatctaatagatgtgctatgaagagaacagaatgaaccggccgtaaaaaaattaccggccgtatttttattaccggccgtgagctgaaaaccggccgtggcgaaatcaccggccgtaaacgactcggaccgatg

SEQ ID NO: 14305 - DNA, 203 bp, Homo sapiens
ggcgcgccagtcctttcaaccggtatttgacccgaggcttcttagaagaattttttaacattccaagtttatctaatagatgtgctatgaagagaacagaatgacacggaatcgagaaaattcacggaatcgagaatattcacggaatcgagaagaaacacggaatcgagaaaatcaaaattcataaacgactcggaccgatg

SEQ ID NO: 14306 - DNA, 203 bp, Homo sapiens
ggcgcgccagtcctccatgaagatatttgacccgaggcttcttagaagaattttttaacattccaagtttatctaatagatgtgctatgaagagaacagaatgatactcccttaaaaaaatttactcccttatttttatttactcccatgagctgaaatactcccgtggcgaaatctactcccataaacgactcggaccgatg

SEQ ID NO: 14307 - DNA, 203 bp, Homo sapiens
ggcgcgccagtccttcgtcacaagatttgacccgaggcttcttagaagaattttttaacattccaagtttatctaatagatgtgctatgaagagaacagaatgatgggactttaaaaaaattaccggccgtatttttattaccggccgtgagctgaaaaccggccgtggcgaaatcaccggccgtaaacgactcggaccgatg

SEQ ID NO: 14308 - DNA, 203 bp, Homo sapiens
ggcgcgccagtcctagaccgagttatttgacccgaggcttcttagaagaattttttaacattccaagtttatctaatagatgtgctatgaagagaacagaatgatgggactttaaaaaaatttttacagttatttttattcgtcaattcctttagaaacgtcaattcctttaaatcaaaattcataaacgactcggaccgatg

SEQ ID NO: 14309 - DNA, 203 bp, Homo sapiens
ggcgcgccagtccttaaaccactaatttgacccgaggcttcttagaagaattttttaacattccaagtttatctaatagatgtgcttactcccgaacagaatgatactcccttaaaaaaatttactcccttatttttatttactcccatgagctgaaatactcccgtggcgaaatctactcccataaacgactcggaccgatg

SEQ ID NO: 14310 - DNA, 203 bp, Homo sapiens
ggcgcgccagtcctgattctgaggatttgaccttcttggcaaaagaagaattcttggcaaatccaagtttcttggcaaaatgtgctttcttggcaaaagaatgattcttggcaaaaaaaattttcttggcaaattttattttcttggcaaagctgaaattcttggcaaacgaaatcttcttggcaaaacgactcggaccgatg

SEQ ID NO: 14311 - DNA, 203 bp, Homo sapiens
ggcgcgccagtcctcctcaagcttcaaagagcagttctgtcaaagaaaacaacataaatcaggtacagaatttcagagtgggatataccggccgtagtgtgaagaccggccgtcattaaaccaccggccgttagaactgaaccggccgtaagaaaattaccggccgtttaaaactgaccggccgtatccgactcggaccgatg

SEQ ID NO: 14312 - DNA, 203 bp, Homo sapiens
ggcgcgccagtcctatgtgcacaacaaagagcagttctgtcaaagaaaacaacataaatcaggtacagaatttcagagtgggatatcagatctttagtgtgaagatacatctacattaaaccaggaatcactagaactgacacggaatcgagaaaattcacggaatcgagaaactgtgaaggttgatccgactcggaccgatg

SEQ ID NO: 14313 - DNA, 203 bp, Homo sapiens
ggcgcgccagtcctcaaaggtgttcaaagagcagttctgtcaaagaaaacaacataaatcaggtacagaatttcagagtgggatatcagatctttagtgtgaagatacatctacattaaaccaggaatcactagaactgacatttggacaagaaaattccggcgggtttaaaactgccggcgggtatccgactcggaccgatg

SEQ ID NO: 14314 - DNA, 203 bp, Homo sapiens
ggcgcgccagtcctgagaagtactcaaagagcagttctgtcaaagaaaacccggcgggtcaggtacagccggcgggtgtgggatatccggcgggtagtgtgaagccggcgggtcattaaaccccggcgggttagaactgaccggcgggtaagaaaattccggcgggtttaaaactgccggcgggtatccgactcggaccgatg

SEQ ID NO: 14315 - DNA, 203 bp, Homo sapiens
ggcgcgccagtcctgaccaacttacaaagagccgtcaattcctttaaaaccgtcaattcctttaacagcgtcaattcctttaatatcgtcaattcctttagaagcgtcaattcctttaaacccgtcaattcctttactgacgtcaattcctttaaattcgtcaattcctttaactgtgaaggttgatccgactcggaccgatg

SEQ ID NO: 14316 - DNA, 203 bp, Homo sapiens
ggcgcgccagtcctgaggtagtttcaccggccgttgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14317 - DNA, 203 bp, Homo sapiens
ggcgcgccagtcctgacgttgtatcaccggccgttgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14318 - DNA, 203 bp, Homo sapiens
ggcgcgccagtccttttgagtcgtcattggctcgtcaattcctttattgacgtcaattcctttaatagcgtcaattcctttaatcccgtcaattcctttactatcgtcaattcctttattggcgtcaattcctttaattacgtcaattcctttactctcgtcaattcctttacactcaatacagcaaacgactcggaccgatg

SEQ ID NO: 14319 - DNA, 203 bp, Homo sapiens
ggcgcgccagtccttttgtaagcacattggctgcttatggtgacaattgacaaattgttaccatatagcgtcaattcctttaatcccgtcaattcctttactatcgtcaattcctttattggcgtcaattcctttaattacgtcaattcctttactctcgtcaattcctttacactcaatacagcaaacgactcggaccgatg

SEQ ID NO: 14320 - DNA, 203 bp, Homo sapiens
ggcgcgccagtcctctgcagtacacattggctgcttatggtgacaattgacaaattgttaccatatagctattggattggccatccggtgacaaacagagctatcgtcaattcctttattggcgtcaattcctttaattacgtcaattcctttactctcgtcaattcctttacactcaatacagcaaacgactcggaccgatg

SEQ ID NO: 14321 - DNA, 203 bp, Homo sapiens
ggcgcgccagtccttctacagcatcattggctgcttatggtgacaattgacaaattgttaccatatagctattggattggccatccggtgacaaacagagctattgtttacttgtttgttggcacggaatcgagaaattacacggaatcgagaactctcacggaatcgagaacactcaatacagcaaacgactcggaccgatg

SEQ ID NO: 14322 - DNA, 203 bp, Homo sapiens
ggcgcgccagtccttgtgctgtagcattggctgcttatggtgacaattgacaaattgttaccatatagctattggattggccatccggtgacaaacagagctattgtttacttgtttgttggcgtcaattcctttaattacgtcaattcctttactctcgtcaattcctttacactcaatacagcaaacgactcggaccgatg

SEQ ID NO: 14323 - DNA, 203 bp, Homo sapiens
ggcgcgccagtcctgaatctcactcattggctgcttatggtgacaattgacaaattgttaccatatagctattggattggccatccggtgacaaacagagctattgtttacttgtttgttggtttcataccattaaattacaaggtcttagaaactctcaactttattttgacactcaatacagcaaacgactcggaccgatg

SEQ ID NO: 14324 - DNA, 203 bp, Homo sapiens
ggcgcgccagtcctagtgctgtcacattggctgcttatggtgacaattgacaaattgttaccatatagctattggattggccatccggtgacaaacagagctattgtttacttgtttgttggtttcataccattaaattacaaggtcttagaaactctcaactttattttgacactccggcgggtaaacgactcggaccgatg

SEQ ID NO: 14325 - DNA, 203 bp, Homo sapiens
ggcgcgccagtcctgacgttgaggcattggctgcttatggtgacaattgacaaattgttaccatatagctattggattggccatccggtgacaaacagagctattgtttacttgtttgttggtttcataccattaaattacaaggtcttagaaactctccggcgggttttgacactccggcgggtaaacgactcggaccgatg

SEQ ID NO: 14326 - DNA, 203 bp, Homo sapiens
ggcgcgccagtcctaatcagttttcattggctgcttatggtgacaattgacaaattgttaccatatagctattggattggccatccggtgacaaacagagctattgtttacttgtttgttggtttcataccattaaattacaaggtcttagaaactctttcttggcaaatgacactttcttggcaaaacgactcggaccgatg

SEQ ID NO: 14327 - DNA, 203 bp, Homo sapiens
ggcgcgccagtcctctcaaggccacattggctgcttatggtgacaattgacaaattgttaccatatagctattggattggccatccggtgacaaacagagctattgtttacttgtttgttggtttcataccattaaattacgtcaattcctttactctcgtcaattcctttacactcaatacagcaaacgactcggaccgatg

SEQ ID NO: 14328 - DNA, 203 bp, Homo sapiens
ggcgcgccagtcctcagtttctgcccacggaatcgagaatcactagcaacctcaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14329 - DNA, 203 bp, Homo sapiens
ggcgcgccagtcctaatgtacagcccatgatgcctcgctcccatcagccgaccggccgtccacatgaaaccggccgtcaagaagcgaccggccgtattgatgaaaccggccgtgaaatagacaccggccgtgaacaagccaccggccgtattttgaaaaccggccgtaaatataacaccggccgtcaacgactcggaccgatg

SEQ ID NO: 14330 - DNA, 203 bp, Homo sapiens
ggcgcgccagtcctctaagagtgcccatgatgcctcgctcccatcagccgccgccgccgccacatgaaaaagaacagcaagaagcgattgaacacattgatgaagtacaaaatgaaatagacaccggccgtgaacaagccaccggccgtattttgaaaaccggccgtaaatataacaccggccgtcaacgactcggaccgatg

SEQ ID NO: 14331 - DNA, 203 bp, Homo sapiens
ggcgcgccagtcctacgttcttgcccatgatgcctcgctcccatcagccgccgccgccgccacatgaaaaagaacagcaagaagcgattgaacacattgatgaagtacaaaatgaaatagacagacttaatgaacaagccagtgaggagattttgaaacgtcaattcctttataacaaactccgccaacgactcggaccgatg

SEQ ID NO: 14332 - DNA, 203 bp, Homo sapiens
ggcgcgccagtcctaaagtgttgcccatgatgcctcgctcccatcagccgccgccgccgccacatgaaaaagaacagcaagaagcgattgaacacattgatgaagtacaaaatgaaatagacagacttaatgaacaagccagtgaggagattttgaaagtagaacagaaatataacccggcgggtcaacgactcggaccgatg

SEQ ID NO: 14333 - DNA, 203 bp, Homo sapiens
ggcgcgccagtccttagtttgagcccatgatgcctcgctcccatcagccgccgccgccgccacatgaaaaagaacagcaagaagcgattgaacacattgatgaagtacaaaatgaaatagacagacttaatgaacaagcctactcccagattttgaaatactcccagaaatataactactcccgccaacgactcggaccgatg

SEQ ID NO: 14334 - DNA, 203 bp, Homo sapiens
ggcgcgccagtcctaggtttgtgcccatgatgcctcgctcccatcagccgccgccgccgccacatgaaaaagaacagcaagaagcgccggcgggtattgatgaaccggcgggtgaaatagacccggcgggtgaacaagccccggcgggtattttgaaaccggcgggtaaatataacccggcgggtcaacgactcggaccgatg

SEQ ID NO: 14335 - DNA, 203 bp, Homo sapiens
ggcgcgccagtcctagaagcaggcccatgatgcctcgctcccatcagccgccgccgccgccacatgaacgtcaattcctttaagcgcgtcaattcctttatgaacgtcaattcctttaagaccgtcaattcctttaagcccgtcaattcctttagaaacgtcaattcctttataacaaactccgccaacgactcggaccgatg

SEQ ID NO: 14336 - DNA, 203 bp, Homo sapiens
ggcgcgccagtcctgctagtctgtccatgatgcctcgctcccatcagccgcgtcaattcctttatgaacgtcaattcctttaagcgcgtcaattcctttatgaacgtcaattcctttaagaccgtcaattcctttaagcccgtcaattcctttagaaacgtcaattcctttataacaaactccgccaacgactcggaccgatg

SEQ ID NO: 14337 - DNA, 203 bp, Homo sapiens
ggcgcgccagtcctgcttgagcttcccactatcacggaatcgagaaagttcacggaatcgagaacgaacacggaatcgagaaccaccacggaatcgagaagctacacggaatcgagaaaaaacacggaatcgagaacccgcacggaatcgagaaccttcacggaatcgagaaggtggtagctgcaacccgactcggaccgatg

SEQ ID NO: 14338 - DNA, 203 bp, Homo sapiens
ggcgcgccagtcctgcctcttaagcccactatccggcgggtctccgagttccggcgggtatggccgaaccggcgggttggggccacccggcgggtgccgtgctaccggcgggtaggggaaaaccggcgggtgtgaccccgccggcgggtccctcccttccggcgggtagtgtggtgccggcgggtacccgactcggaccgatg

SEQ ID NO: 14339 - DNA, 203 bp, Homo sapiens
ggcgcgccagtcctgctcgtcaggcccactattgttgtgggctccgagttcctctagggatggccgaaaggcagccatggggccaccacggaatcgagaagctacacggaatcgagaaaaaacacggaatcgagaacccgcacggaatcgagaaccttcacggaatcgagaaggtggtagctgcaacccgactcggaccgatg

SEQ ID NO: 14340 - DNA, 203 bp, Homo sapiens
ggcgcgccagtcctgcctaactctcccactattgttgtgggctccgagttcctctagggatggccgaaaggcagccatggggccacccaggcggcgccgtgctacacggaatcgagaaaaaacacggaatcgagaacccgcacggaatcgagaaccttcacggaatcgagaaggtggtagctgcaacccgactcggaccgatg

SEQ ID NO: 14341 - DNA, 203 bp, Homo sapiens
ggcgcgccagtcctgcacagtagccccactattgttgtgggctccgagttcctctagggatggccgaaaggcagccatggggccacccaggcggcgccgtgctacaggcggcaaggggaaaaatccttcgggtgaccccgcgtcaattcctttaccttcgtcaattcctttaggtggtagctgcaacccgactcggaccgatg

SEQ ID NO: 14342 - DNA, 203 bp, Homo sapiens
ggcgcgccagtcctgcaccttcaacccactattgttgtgggctccgagttcctctagggatggccgaaaggcagccatggggccacccaggcggcgccgtgctacaggcggcaaggggaaaaatccttcgggtgaccccgggtggcattccctcccttaccggccgtagtgtggtgaccggccgtacccgactcggaccgatg

SEQ ID NO: 14343 - DNA, 203 bp, Homo sapiens
ggcgcgccagtcctgctactctagcccactattgttgtgggctccgagttcctctagggatggccgaaaggcagccatggggccacccaggcggcgccgtgctacaggcggcaaggggaaaaatccttcgggtgaccccgggtggcattccctcccttagcagcatgagtgtggtgtactccccaacccgactcggaccgatg

SEQ ID NO: 14344 - DNA, 203 bp, Homo sapiens
ggcgcgccagtcctgctcaagttgcccactattgttgtgggctccgagttcctctagggatggccgaaaggcagccatggggccacccaggcggcgccgtgctacaggcggcaaggggaaaaatccttcgggtgaccccgggtggcattccctccctttactccctgagtgtggtgtactccccaacccgactcggaccgatg

SEQ ID NO: 14345 - DNA, 203 bp, Homo sapiens
ggcgcgccagtcctgcctagtagtcccactattgttgtgggctccgagttcctctagggatggccgaaaggcagccatggggccacccaggcggcgccgtgctacaggcggcaaggggaaaaatccttcgggtgaccccgggtggcattccctcccttttcttggcaaatgtggtgttcttggcaaaccgactcggaccgatg

SEQ ID NO: 14346 - DNA, 203 bp, Homo sapiens
ggcgcgccagtcctgctctgcaagcccactattgttgtgggctccgagttcctctagggatggccgaaaggcagccatggggccacccaggcggcgccgtgctacaggcggcaaggggaaaaatccttcgggtgaccccgtactcccttccctccctttactccctgagtgtggtgtactccccaacccgactcggaccgatg

SEQ ID NO: 14347 - DNA, 203 bp, Homo sapiens
ggcgcgccagtcctgctcacctggcccactattgttgtgggctccgagttcctctagggatggccgaaaggcagccatggggccacccaggcggcgccgtgctacaggcggcaaggggaaaatactcccgggtgaccccgtactcccttccctccctttactccctgagtgtggtgtactccccaacccgactcggaccgatg

SEQ ID NO: 14348 - DNA, 203 bp, Homo sapiens
ggcgcgccagtcctgctcttaagacccactattgttgtgggctccgagttcctctagggatggccgaaaggcagccatggggccacccaggcggcgccgtgctacgtcaattcctttaaaaacgtcaattcctttacccgcgtcaattcctttaccttcgtcaattcctttaggtggtagctgcaacccgactcggaccgatg

SEQ ID NO: 14349 - DNA, 203 bp, Homo sapiens
ggcgcgccagtcctgcagtatgcacccactattgttgtgggctccgagttcctctagggatggccgaaaggcagccatggggccacccaggcggcgccgtgctatactccccaaggggaaaatactcccgggtgaccccgtactcccttccctccctttactccctgagtgtggtgtactccccaacccgactcggaccgatg

SEQ ID NO: 14350 - DNA, 203 bp, Homo sapiens
ggcgcgccagtcctagagccttcacccactattgttgtgggctccgagttcctctagggatggccgaacgtcaattcctttaccaccgtcaattcctttagctacgtcaattcctttaaaaacgtcaattcctttacccgcgtcaattcctttaccttcgtcaattcctttaggtggtagctgcaacccgactcggaccgatg

SEQ ID NO: 14351 - DNA, 203 bp, Homo sapiens
ggcgcgccagtcctgaagccttttcccactattgttgtgggctccgagttcgtcaattcctttacgaacgtcaattcctttaccaccgtcaattcctttagctacgtcaattcctttaaaaacgtcaattcctttacccgcgtcaattcctttaccttcgtcaattcctttaggtggtagctgcaacccgactcggaccgatg

SEQ ID NO: 14352 - DNA, 203 bp, Homo sapiens
ggcgcgccagtcctacaagtgctccccactatttcttggcaaaccgagttttcttggcaaaggccgaattcttggcaaagggccacttcttggcaaacgtgctattcttggcaaagggaaaattcttggcaaagaccccgttcttggcaaactcccttttcttggcaaatgtggtgttcttggcaaaccgactcggaccgatg

SEQ ID NO: 14353 - DNA, 203 bp, Homo sapiens
ggcgcgccagtcctaaagaaggatcccggcgggttgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14354 - DNA, 203 bp, Homo sapiens
ggcgcgccagtcctctctggactgcccggcgggttgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14355 - DNA, 203 bp, Homo sapiens
ggcgcgccagtccttcaacgtaggccgcccgccacggaatcgagaacccccacggaatcgagaacccccacggaatcgagaaccttcacggaatcgagaactcgcacggaatcgagaaggctcacggaatcgagaagtgacacggaatcgagaaactccacggaatcgagaacagaacactgctcgaccgactcggaccgatg

SEQ ID NO: 14356 - DNA, 203 bp, Homo sapiens
ggcgcgccagtcctgagttctgtcccgcccgcccctattgttccgcccccaccggccgtcccttccccaccggccgtgctccccttaccggccgtgtcgcctcgaccggccgttttttggctaccggccgtaaccagtgaaccggccgttgaccactcaccggccgtctccccagaaccggccgtgaccgactcggaccgatg

SEQ ID NO: 14357 - DNA, 203 bp, Homo sapiens
ggcgcgccagtcctagctgtacacccgcccgcccctattgttccgccccccgtcaattcctttacccccgtcaattcctttaccttcgtcaattcctttactcgcgtcaattcctttaggctcgtcaattcctttagtgacgtcaattcctttaactccgtcaattcctttacagaacactgctcgaccgactcggaccgatg

SEQ ID NO: 14358 - DNA, 203 bp, Homo sapiens
ggcgcgccagtcctgtagtgctaaccgcccgcccctattgttccgcccccggcctcccgcccttccccccggcgggtgctccccttccggcgggtgtcgcctcgccggcgggttttttggctccggcgggtaaccagtgaccggcgggttgaccactcccggcgggtctccccagaccggcgggtgaccgactcggaccgatg

SEQ ID NO: 14359 - DNA, 203 bp, Homo sapiens
ggcgcgccagtcctgtgctctcgtccgcccgcccctattgttccgcccccggcctcccgcccttccccttcccgcccgctccccttaccggccgtgtcgcctcgaccggccgttttttggctaccggccgtaaccagtgaaccggccgttgaccactcaccggccgtctccccagaaccggccgtgaccgactcggaccgatg

SEQ ID NO: 14360 - DNA, 203 bp, Homo sapiens
ggcgcgccagtcctctgtgtacacccgcccgcccctattgttccgcccccggcctcccgcccttccccttcccgcccgctcccctttactccccagtcgcctcgtactcccagtttttggcttactcccccaaccagtgatactccccttgaccactctactcccagctccccagatactccctcgaccgactcggaccgatg

SEQ ID NO: 14361 - DNA, 203 bp, Homo sapiens
ggcgcgccagtcctgtgaatgttgccgcccgcccctattgttccgcccccggcctcccgcccttccccttcccgcccgctccccttttcccctcagtcgcctcgaccggccgttttttggctaccggccgtaaccagtgaaccggccgttgaccactcaccggccgtctccccagaaccggccgtgaccgactcggaccgatg

SEQ ID NO: 14362 - DNA, 203 bp, Homo sapiens
ggcgcgccagtcctgaccgagaacccgcccgcccctattgttccgcccccggcctcccgcccttccccttcccgcccgctccccttttcccctcagtcgcctcgcgcctgcagtttttggctccggcgggtaaccagtgaccggcgggttgaccactcccggcgggtctccccagaccggcgggtgaccgactcggaccgatg

SEQ ID NO: 14363 - DNA, 203 bp, Homo sapiens
ggcgcgccagtcctgttactggacccgcccgcccctattgttccgcccccggcctcccgcccttccccttcccgcccgctccccttttcccctcagtcgcctcgcgcctgcagtttttggctttcacccccaaccagtgaaccggccgttgaccactcaccggccgtctccccagaaccggccgtgaccgactcggaccgatg

SEQ ID NO: 14364 - DNA, 203 bp, Homo sapiens
ggcgcgccagtcctgtctacccagccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaccggcgggtgaccgactcggaccgatg

SEQ ID NO: 14365 - DNA, 203 bp, Homo sapiens
ggcgcgccagtcctgttgtaactgccgcccgcccctattgttccgcccccggcctcccgcccttccccttcccgcccgctccccttttcccctcagtcgcctcgcgcctgcagtttttggctttcacccccaaccagtgaccaaagacttgaccactccacggaatcgagaacagaacactgctcgaccgactcggaccgatg

SEQ ID NO: 14366 - DNA, 203 bp, Homo sapiens
ggcgcgccagtcctgtggttgactccgcccgcccctattgttccgcccccggcctcccgcccttccccttcccgcccgctccccttttcccctcagtcgcctcgcgcctgcagtttttggctttcacccccaaccagtgaccaaagacttgaccactctactcccagctccccagatactccctcgaccgactcggaccgatg

SEQ ID NO: 14367 - DNA, 203 bp, Homo sapiens
ggcgcgccagtcctatgagttgacccgcccgcccctattgttccgcccccggcctcccgcccttccccttcccgcccgctccccttttcccctcagtcgcctcgcgcctgcagtttttggctttcacccccaaccagtgaccaaagacttgaccactcttcttggcaaaccccagattcttggcaaaccgactcggaccgatg

SEQ ID NO: 14368 - DNA, 203 bp, Homo sapiens
ggcgcgccagtcctgtgaatcagtccgcccgcccctattgttccgcccccggcctcccgcccttccccttcccgcccgctccccttttcccctcagtcgcctcgtactcccagtttttggcttactcccccaaccagtgatactccccttgaccactctactcccagctccccagatactccctcgaccgactcggaccgatg

SEQ ID NO: 14369 - DNA, 203 bp, Homo sapiens
ggcgcgccagtcctctgacaaaacccgcccgcccctattgttccgccccctactccccgcccttcccctactcccccgctcccctttactccccagtcgcctcgtactcccagtttttggcttactcccccaaccagtgatactccccttgaccactctactcccagctccccagatactccctcgaccgactcggaccgatg

SEQ ID NO: 14370 - DNA, 203 bp, Homo sapiens
ggcgcgccagtcctcagtaactacccgcccgcccctattgttccgcccccttcttggcaaacttccccttcttggcaaatccccttttcttggcaaacgcctcgttcttggcaaatttggctttcttggcaaaccagtgattcttggcaaaaccactcttcttggcaaaccccagattcttggcaaaccgactcggaccgatg

SEQ ID NO: 14371 - DNA, 203 bp, Homo sapiens
ggcgcgccagtcctgtcacagttgccgcccgcccggcgggttccgcccccccggcgggtcccttccccccggcgggtgctccccttccggcgggtgtcgcctcgccggcgggttttttggctccggcgggtaaccagtgaccggcgggttgaccactcccggcgggtctccccagaccggcgggtgaccgactcggaccgatg

SEQ ID NO: 14372 - DNA, 203 bp, Homo sapiens
ggcgcgccagtcctgagaccagacccgcccgccgtcaattcctttacccccgtcaattcctttacccccgtcaattcctttaccttcgtcaattcctttactcgcgtcaattcctttaggctcgtcaattcctttagtgacgtcaattcctttaactccgtcaattcctttacagaacactgctcgaccgactcggaccgatg

SEQ ID NO: 14373 - DNA, 203 bp, Homo sapiens
ggcgcgccagtcctgtcaagcgttccgcccgctactcccgttccgccccctactccccgcccttcccctactcccccgctcccctttactccccagtcgcctcgtactcccagtttttggcttactcccccaaccagtgatactccccttgaccactctactcccagctccccagatactccctcgaccgactcggaccgatg

SEQ ID NO: 14374 - DNA, 203 bp, Homo sapiens
ggcgcgccagtcctccagagaaacccgcccgcttcttggcaaacgcccccttcttggcaaacttccccttcttggcaaatccccttttcttggcaaacgcctcgttcttggcaaatttggctttcttggcaaaccagtgattcttggcaaaaccactcttcttggcaaaccccagattcttggcaaaccgactcggaccgatg

SEQ ID NO: 14375 - DNA, 203 bp, Homo sapiens
ggcgcgccagtcctgtagaccgacccgtcaattcctttatcactagcaacctcaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14376 - DNA, 203 bp, Homo sapiens
ggcgcgccagtcctgttcaagaaccgagatgccatgtggacgagggcgtgcacggaatcgagaataaccacggaatcgagaacttgcacggaatcgagaagttacacggaatcgagaaagtacacggaatcgagaagttgcacggaatcgagaaaccacacggaatcgagaactgctgtacatggcaccgactcggaccgatg

SEQ ID NO: 14377 - DNA, 203 bp, Homo sapiens
ggcgcgccagtcctgtcctgtcagcgagatgccatgtggacgagggcgtgcccacggtgtatcttaacccaggcgggggccgcttgggtgaaatagggttgttaccggcgggtttgggagtaccggcgggtagggtgttgccggcgggtgctacaccaccggcgggtaaactctgcccggcgggtcaccgactcggaccgatg

SEQ ID NO: 14378 - DNA, 203 bp, Homo sapiens
ggcgcgccagtcctttcacttgaccgagatgccatgtggacgagggcgtgcccacggtgtatcttaacccaggcgggggccgcttgggtgaaatagggttgttacgtcaattcctttaagtacgtcaattcctttagttgcgtcaattcctttaaccacgtcaattcctttactgctgtacatggcaccgactcggaccgatg

SEQ ID NO: 14379 - DNA, 203 bp, Homo sapiens
ggcgcgccagtcctgtctctgttacgagatgccatgtggacgagggcgtgcccacggtgtatcttaacccaggcgggggccgcttgggtgaaatagggttgttatacaagcctttgggagtaaccggccgtagggtgttgaccggccgtgctacaccaaccggccgtaaactctgcaccggccgtcaccgactcggaccgatg

SEQ ID NO: 14380 - DNA, 203 bp, Homo sapiens
ggcgcgccagtcctgtgagagcctcgagatgccatgtggacgagggcgtgcccacggtgtatcttaacccaggcgggggccgcttgggtgaaatagggttgttatacaagcctttgggagtacacggaatcgagaagttgcacggaatcgagaaaccacacggaatcgagaactgctgtacatggcaccgactcggaccgatg

SEQ ID NO: 14381 - DNA, 203 bp, Homo sapiens
ggcgcgccagtcctgtccactagtcgagatgccatgtggacgagggcgtgcccacggtgtatcttaacccaggcgggggccgcttgggtgaaatagggttgttatacaagcctttgggagtacagcctgatagggtgttgcagagacctgctacaccaccggcgggtaaactctgcccggcgggtcaccgactcggaccgatg

SEQ ID NO: 14382 - DNA, 203 bp, Homo sapiens
ggcgcgccagtcctgtgaccaaagcgagatgccatgtggacgagggcgtgcccacggtgtatcttaacccaggcgggggccgcttgggtgaaatagggttgttatacaagcctttgggagtacagcctgatagggtgttgcagagacctgctacaccacgtcaattcctttactgctgtacatggcaccgactcggaccgatg

SEQ ID NO: 14383 - DNA, 203 bp, Homo sapiens
ggcgcgccagtcctgagtagataccgagatgccatgtggacgagggcgtgcccacggtgtatcttaacccaggcgggggccgcttgggtgaaatagggttgttatacaagcctttgggagtacagcctgatagggtgttgcagagacctgctacaccactagtataaaaactctgcccggcgggtcaccgactcggaccgatg

SEQ ID NO: 14384 - DNA, 203 bp, Homo sapiens
ggcgcgccagtcctgtgaccggttcgagatgccatgtggacgagggcgtgcccacggtgtatcttaacccaggcgggggccgcttgggtgaaatagggttgttatacaagcctttgggagtacagcctgatagggtgttgcagagacctgctacaccattcttggcaaaactctgcttcttggcaaaccgactcggaccgatg

SEQ ID NO: 14385 - DNA, 203 bp, Homo sapiens
ggcgcgccagtcctgtcaacgtaccgagatgccatgtggacgagggcgtgcccacggtgtatcttaacccaggcgggggccgcttgggtgaaatagggttgttatacaagcctttgggagtacgtcaattcctttagttgcgtcaattcctttaaccacgtcaattcctttactgctgtacatggcaccgactcggaccgatg

SEQ ID NO: 14386 - DNA, 203 bp, Homo sapiens
ggcgcgccagtcctgcagtcagaccgagatgccatgtggacgagggcgtgcccacggtgtatcttaaccgtcaattcctttacttgcgtcaattcctttagttacgtcaattcctttaagtacgtcaattcctttagttgcgtcaattcctttaaccacgtcaattcctttactgctgtacatggcaccgactcggaccgatg

SEQ ID NO: 14387 - DNA, 203 bp, Homo sapiens
ggcgcgccagtcctagtatgcaaccgagatgccatgtggacgagggcgtgcccacggtgtatcttaacttcttggcaaaccgcttgttcttggcaaagttgttattcttggcaaagggagtattcttggcaaaggtgttgttcttggcaaatacaccattcttggcaaaactctgcttcttggcaaaccgactcggaccgatg

SEQ ID NO: 14388 - DNA, 203 bp, Homo sapiens
ggcgcgccagtccttgaatcctaccgagatgccatgtggacgagggcgtgttcttggcaaatcttaacttcttggcaaaccgcttgttcttggcaaagttgttattcttggcaaagggagtattcttggcaaaggtgttgttcttggcaaatacaccattcttggcaaaactctgcttcttggcaaaccgactcggaccgatg

SEQ ID NO: 14389 - DNA, 203 bp, Homo sapiens
ggcgcgccagtcctcagaagttaccgccgggcaccggccgtgagcgtgagaccggccgtgcgttgcgtaccggccgttctgtgagcaccggccgtatacaccataccggccgttcaccctccaccggccgtaaaatttataccggccgtgttatcattaccggccgttggtggcagaccggccgtaggcgactcggaccgatg

SEQ ID NO: 14390 - DNA, 203 bp, Homo sapiens
ggcgcgccagtccttgtcttggaccgccgggccacggaatcgagaatgagcacggaatcgagaagcgtcacggaatcgagaagagccacggaatcgagaaccatcacggaatcgagaactcccacggaatcgagaattatcacggaatcgagaacattcacggaatcgagaagcagacatgtccaaggcgactcggaccgatg

SEQ ID NO: 14391 - DNA, 203 bp, Homo sapiens
ggcgcgccagtcctgttaacagaccgccgggcccggcgggtgagcgtgagccggcgggtgcgttgcgtccggcgggttctgtgagcccggcgggtatacaccatccggcgggttcaccctccccggcgggtaaaatttatccggcgggtgttatcattccggcgggttggtggcagccggcgggtaggcgactcggaccgatg

SEQ ID NO: 14392 - DNA, 203 bp, Homo sapiens
ggcgcgccagtccttgcaagtaaccgccgggcctacagcgggagcgtgagaccggccgtgcgttgcgtaccggccgttctgtgagcaccggccgtatacaccataccggccgttcaccctccaccggccgtaaaatttataccggccgtgttatcattaccggccgttggtggcagaccggccgtaggcgactcggaccgatg

SEQ ID NO: 14393 - DNA, 203 bp, Homo sapiens
ggcgcgccagtccttaagtaggaccgccgggcctacagcgggagcgtgagcacggaatcgagaagcgtcacggaatcgagaagagccacggaatcgagaaccatcacggaatcgagaactcccacggaatcgagaattatcacggaatcgagaacattcacggaatcgagaagcagacatgtccaaggcgactcggaccgatg

SEQ ID NO: 14394 - DNA, 203 bp, Homo sapiens
ggcgcgccagtcctgtaactacagcgccgggcctacagcgggagcgtgagcgtcaattcctttagcgtcgtcaattcctttagagccgtcaattcctttaccatcgtcaattcctttactcccgtcaattcctttattatcgtcaattcctttacattcgtcaattcctttagcagacatgtccaaggcgactcggaccgatg

SEQ ID NO: 14395 - DNA, 203 bp, Homo sapiens
ggcgcgccagtcctgttcagagaacgccgggcctacagcgggagcgtgaggaaagccgtgcgttgcgtaccggccgttctgtgagcaccggccgtatacaccataccggccgttcaccctccaccggccgtaaaatttataccggccgtgttatcattaccggccgttggtggcagaccggccgtaggcgactcggaccgatg

SEQ ID NO: 14396 - DNA, 203 bp, Homo sapiens
ggcgcgccagtcctatcggtgaaccgccgggcctacagcgggagcgtgaggaaagccgtgcgttgcgtcgtcaattcctttagagccgtcaattcctttaccatcgtcaattcctttactcccgtcaattcctttattatcgtcaattcctttacattcgtcaattcctttagcagacatgtccaaggcgactcggaccgatg

SEQ ID NO: 14397 - DNA, 203 bp, Homo sapiens
ggcgcgccagtcctctaagttcaccgccgggcctacagcgggagcgtgaggaaagccgtgcgttgcgttactccccatctgtgagctactcccgtatacaccattactcccgctcaccctcctactcccaaaaaatttattactcccaagttatcatttactcccaatggtggcagtactccccaaggcgactcggaccgatg

SEQ ID NO: 14398 - DNA, 203 bp, Homo sapiens
ggcgcgccagtcctcaagaatcatcgccgggcctacagcgggagcgtgaggaaagccgtgcgttgcgttccaaggcatctgtgagcccgcggagtatacaccatcacggaatcgagaactcccacggaatcgagaattatcacggaatcgagaacattcacggaatcgagaagcagacatgtccaaggcgactcggaccgatg

SEQ ID NO: 14399 - DNA, 203 bp, Homo sapiens
ggcgcgccagtcctcaacgagttacgccgggcctacagcgggagcgtgaggaaagccgtgcgttgcgttccaaggcatctgtgagcccgcggagtatacaccatcgtcaattcctttactcccgtcaattcctttattatcgtcaattcctttacattcgtcaattcctttagcagacatgtccaaggcgactcggaccgatg

SEQ ID NO: 14400 - DNA, 203 bp, Homo sapiens
ggcgcgccagtcctccaacgatctcgccgggcctacagcgggagcgtgaggaaagccgtgcgttgcgttccaaggcatctgtgagcccgcggagtatacaccatgagcaaagctcaccctcccacggaatcgagaattatcacggaatcgagaacattcacggaatcgagaagcagacatgtccaaggcgactcggaccgatg

SEQ ID NO: 14401 - DNA, 203 bp, Homo sapiens
ggcgcgccagtcctctcttcaaagcgccgggcctacagcgggagcgtgaggaaagccgtgcgttgcgttccaaggcatctgtgagcccgcggagtatacaccatgagcaaagctcaccctcccgagttgaaaaaatttatcgtcaattcctttacattcgtcaattcctttagcagacatgtccaaggcgactcggaccgatg

SEQ ID NO: 14402 - DNA, 203 bp, Homo sapiens
ggcgcgccagtcctctcaccatgtcgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattccggcgggttggtggcagccggcgggtaggcgactcggaccgatg

SEQ ID NO: 14403 - DNA, 203 bp, Homo sapiens
ggcgcgccagtcctctagagtaaacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattcgtcaattcctttagcagacatgtccaaggcgactcggaccgatg

SEQ ID NO: 14404 - DNA, 203 bp, Homo sapiens
ggcgcgccagtcctctgagcctaccgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagaccggccgtaggcgactcggaccgatg

SEQ ID NO: 14405 - DNA, 203 bp, Homo sapiens
ggcgcgccagtccttcaaagagatcgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagccggcgggtaggcgactcggaccgatg

SEQ ID NO: 14406 - DNA, 203 bp, Homo sapiens
ggcgcgccagtccttgaagacgaccgccgggcctacagcgggagcgtgaggaaagccgtgcgttgcgttccaaggcatctgtgagcccgcggagtatacaccatgagcaaagctcaccctcccgagttgaaaaaatttattactcccaagttatcatttactcccaatggtggcagtactccccaaggcgactcggaccgatg

SEQ ID NO: 14407 - DNA, 203 bp, Homo sapiens
ggcgcgccagtcctgatcacaagtcgccgggcctacagcgggagcgtgaggaaagccgtgcgttgcgttccaaggcatctgtgagcccgcggagtatacaccatgagcaaagctcaccctcccgagttgaaaaaatttatttcttggcaaatatcattttcttggcaaagtggcagttcttggcaaagcgactcggaccgatg

SEQ ID NO: 14408 - DNA, 203 bp, Homo sapiens
ggcgcgccagtcctacgctagacacgccgggcctacagcgggagcgtgaggaaagccgtgcgttgcgttccaaggcatctgtgagcccgcggagtatacaccattactcccgctcaccctcctactcccaaaaaatttattactcccaagttatcatttactcccaatggtggcagtactccccaaggcgactcggaccgatg

SEQ ID NO: 14409 - DNA, 203 bp, Homo sapiens
ggcgcgccagtccttaactagcgtcgccgggcctacagcgggagcgtgaggaaagccgtgcgttgcgttccaaggcatctgtgagcccgcggagtatacaccatttcttggcaaaaccctccttcttggcaaaaatttatttcttggcaaatatcattttcttggcaaagtggcagttcttggcaaagcgactcggaccgatg

SEQ ID NO: 14410 - DNA, 203 bp, Homo sapiens
ggcgcgccagtcctagagtcctagcgccgggcctacagcgggagcgtgaggaaagccgtgcgttgcgttccaaggcatctgtgagcccggcgggtatacaccatccggcgggttcaccctccccggcgggtaaaatttatccggcgggtgttatcattccggcgggttggtggcagccggcgggtaggcgactcggaccgatg

SEQ ID NO: 14411 - DNA, 203 bp, Homo sapiens
ggcgcgccagtcctcagagtcctacgccgggcctacagcgggagcgtgaggaaagccgtgcgttgcgttccaaggcatctgtgagccgtcaattcctttaccatcgtcaattcctttactcccgtcaattcctttattatcgtcaattcctttacattcgtcaattcctttagcagacatgtccaaggcgactcggaccgatg

SEQ ID NO: 14412 - DNA, 203 bp, Homo sapiens
ggcgcgccagtcctaaaccgttcactccggaaaccggccgtagaattcataccggccgtgaatttttaaccggccgtacaaaaagaaccggccgttgccgaaacaccggccgtttagagaataccggccgtaaaagagaaaccggccgtaaggaaaagaccggccgtgaacgtgaaaccggccgtctacgactcggaccgatg

SEQ ID NO: 14413 - DNA, 203 bp, Homo sapiens
ggcgcgccagtcctaccgttcatactccggaaagtgataacagaattcataccggccgtgaatttttaaccggccgtacaaaaagaaccggccgttgccgaaacaccggccgtttagagaataccggccgtaaaagagaaaccggccgtaaggaaaagaccggccgtgaacgtgaaaccggccgtctacgactcggaccgatg

SEQ ID NO: 14414 - DNA, 203 bp, Homo sapiens
ggcgcgccagtcctatggtcacagctccggaaagtgataacagaattcatcgtcaattcctttatttacgtcaattcctttaaagacgtcaattcctttaaaaccgtcaattcctttagaatcgtcaattcctttaagaacgtcaattcctttaaaagcgtcaattcctttatgaaaaggaagagctacgactcggaccgatg

SEQ ID NO: 14415 - DNA, 203 bp, Homo sapiens
ggcgcgccagtcctagctaacgtactccggaaagtgataacagaattcattgaagtggagaatttttaaagaaggtaacaaaaagagaaagaaaatgccgaaaccaggcacaattagagaatgaaaagaagaaaagagaaatagcagaaaaggaaaaggaaagaatagaacgtgaaccggcgggtctacgactcggaccgatg

SEQ ID NO: 14416 - DNA, 203 bp, Homo sapiens
ggcgcgccagtcctttgttcagtgctccggaaagtgataacagaattcattgaagtggagaatttttaaagaaggtaacaaaaagagaaagaaaatgccgaaaccaggcacaattagagaatgaaaagaagaaaagagaaatagcagaaaaggaaaaggaaagaatagaacgtgaattcttggcaaaacgactcggaccgatg

SEQ ID NO: 14417 - DNA, 203 bp, Homo sapiens
ggcgcgccagtcctctcaactgaactccggaaagtgataacagaattcattgaagtggagaatttttaaagaaggtaacaaaaagagaaagaaaatgccgaaaccaggcacaattagagaatgaaaagaagaaaagagaacgtcaattcctttaaaagcgtcaattcctttatgaaaaggaagagctacgactcggaccgatg

SEQ ID NO: 14418 - DNA, 203 bp, Homo sapiens
ggcgcgccagtcctagagactgaactccggaaagtgataacagaattcattgaagtggagaatttttaaagaaggtaacaaaaagagaaagaaaatgccgaaaccaggcacaattagagaatgaaaagaagaaaagagaattcttggcaaaggaaaagttcttggcaaaacgtgaattcttggcaaaacgactcggaccgatg

SEQ ID NO: 14419 - DNA, 203 bp, Homo sapiens
ggcgcgccagtcctgagtactgaactccggaaagtgataacagaattcattgaagtggagaatttttaaagaaggtaacaaaaagagaaagaaaatgccgaaaccgtcaattcctttagaatcgtcaattcctttaagaacgtcaattcctttaaaagcgtcaattcctttatgaaaaggaagagctacgactcggaccgatg

SEQ ID NO: 14420 - DNA, 203 bp, Homo sapiens
ggcgcgccagtccttcactgaaagctccggaaagtgataacagaattcattgaagtggagaatttttaaagaaggtaacaaaaagagaaagaaaatgccgaaacttcttggcaaaagagaatttcttggcaaaaagagaattcttggcaaaggaaaagttcttggcaaaacgtgaattcttggcaaaacgactcggaccgatg

SEQ ID NO: 14421 - DNA, 203 bp, Homo sapiens
ggcgcgccagtcctcccaacggtcctccggaaagtgataacagaattcattgaagtggagaatttttaaagaaggtaacaaaaagatactcccaatgccgaaactactcccaattagagaattactcccagaaaagagaatactcccaaaaggaaaagtactccctagaacgtgaatactcccagctacgactcggaccgatg

SEQ ID NO: 14422 - DNA, 203 bp, Homo sapiens
ggcgcgccagtcctgttgggtcagctccggaaagtgataacagaattcattgaagtggagaatttttaccggcgggtacaaaaagaccggcgggttgccgaaacccggcgggtttagagaatccggcgggtaaaagagaaccggcgggtaaggaaaagccggcgggtgaacgtgaaccggcgggtctacgactcggaccgatg

SEQ ID NO: 14423 - DNA, 203 bp, Homo sapiens
ggcgcgccagtcctaaagagagacctccggaattcttggcaaaaattcatttcttggcaaaatttttattcttggcaaaaaaaagattcttggcaaaccgaaacttcttggcaaaagagaatttcttggcaaaaagagaattcttggcaaaggaaaagttcttggcaaaacgtgaattcttggcaaaacgactcggaccgatg

SEQ ID NO: 14424 - DNA, 203 bp, Homo sapiens
ggcgcgccagtccttccacggtgcctgaagtgacaagccacgctgcttctcacggaatcgagaaccaacacggaatcgagaacccccacggaatcgagaagtcacacggaatcgagaacgttcacggaatcgagaaccaccacggaatcgagaaggatcacggaatcgagaaaacagaaagtaaaaaacgactcggaccgatg

SEQ ID NO: 14425 - DNA, 203 bp, Homo sapiens
ggcgcgccagtcctactcaccttactgaagtgacaagccacgctgcttctccggcgggtgctgaccaaccggcgggtatccaccccccggcgggtctcaggtcaccggcgggtgccctcgttccggcgggttatccccacccggcgggtggtgaggatccggcgggtcactcaacaccggcgggtaaacgactcggaccgatg

SEQ ID NO: 14426 - DNA, 203 bp, Homo sapiens
ggcgcgccagtcctacccaagcgactgaagtgacaagccacgctgcttctggagccaaagctgaccaacgtcaattcctttacccccgtcaattcctttagtcacgtcaattcctttacgttcgtcaattcctttaccaccgtcaattcctttaggatcgtcaattcctttaaacagaaagtaaaaaacgactcggaccgatg

SEQ ID NO: 14427 - DNA, 203 bp, Homo sapiens
ggcgcgccagtcctcccaagcttgctgaagtgacaagccacgctgcttctggagccaaagctgaccaagaagaacaaatccaccccaccggccgtctcaggtcaaccggccgtgccctcgttaccggccgttatccccacaccggccgtggtgaggataccggccgtcactcaacaaccggccgtaaacgactcggaccgatg

SEQ ID NO: 14428 - DNA, 203 bp, Homo sapiens
ggcgcgccagtcctgacccaagtcctgaagtgacaagccacgctgcttctggagccaaagctgaccaagaagaacaaatccaccccagatctagactcaggtcaaccggccgtgccctcgttaccggccgttatccccacaccggccgtggtgaggataccggccgtcactcaacaaccggccgtaaacgactcggaccgatg

SEQ ID NO: 14429 - DNA, 203 bp, Homo sapiens
ggcgcgccagtcctattcttgggtctgaagtgacaagccacgctgcttctggagccaaagctgaccaagaagaacaaatccaccccagatctagactcaggtcacctcctgaagccctcgttaccggccgttatccccacaccggccgtggtgaggataccggccgtcactcaacaaccggccgtaaacgactcggaccgatg

SEQ ID NO: 14430 - DNA, 203 bp, Homo sapiens
ggcgcgccagtcctagactacggtctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacatactcccaaaaacgactcggaccgatg

SEQ ID NO: 14431 - DNA, 203 bp, Homo sapiens
ggcgcgccagtcctctaccgtaagctgaagtgacaagccacgctgcttctggagccaaagctgaccaagaagaacaaatccaccccagatctagactcaggtcacctcctgaagccctcgttcagggtcgatatccccactactcccacggtgaggattactcccaccactcaacatactcccaaaaacgactcggaccgatg

SEQ ID NO: 14432 - DNA, 203 bp, Homo sapiens
ggcgcgccagtcctctacggttaactgaagtgacaagccacgctgcttctggagccaaagctgaccaagaagaacaaatccaccccagatctagactcaggtcacctcctgaagccctcgttccggcgggttatccccacccggcgggtggtgaggatccggcgggtcactcaacaccggcgggtaaacgactcggaccgatg

SEQ ID NO: 14433 - DNA, 203 bp, Homo sapiens
ggcgcgccagtcctaatgcacattctgaagtgacaagccacgctgcttctggagccaaagctgaccaagaagaacaaatccaccccagatctagactcaggtcacgtcaattcctttacgttcgtcaattcctttaccaccgtcaattcctttaggatcgtcaattcctttaaacagaaagtaaaaaacgactcggaccgatg

SEQ ID NO: 14434 - DNA, 203 bp, Homo sapiens
ggcgcgccagtcctcagcagcctactgaagtgacaagccacgctgcttctggagccaaagctgaccaagaagaacaaatccacccccacggaatcgagaagtcacacggaatcgagaacgttcacggaatcgagaaccaccacggaatcgagaaggatcacggaatcgagaaaacagaaagtaaaaaacgactcggaccgatg

SEQ ID NO: 14435 - DNA, 203 bp, Homo sapiens
ggcgcgccagtcctaactttacttctgaagtgacaagccacgctgcttctggagccaaagctgaccaagaagaacaaatccacccctactcccgactcaggtcatactcccaagccctcgtttactcccgatatccccactactcccacggtgaggattactcccaccactcaacatactcccaaaaacgactcggaccgatg

SEQ ID NO: 14436 - DNA, 203 bp, Homo sapiens
ggcgcgccagtcctacttgggtctctgaagtgacaagccacgctgcttcttactcccaagctgaccaatactcccaaatccacccctactcccgactcaggtcatactcccaagccctcgtttactcccgatatccccactactcccacggtgaggattactcccaccactcaacatactcccaaaaacgactcggaccgatg

SEQ ID NO: 14437 - DNA, 203 bp, Homo sapiens
ggcgcgccagtcctagcacggtctctgaagtgcacggaatcgagaattctcacggaatcgagaaccaacacggaatcgagaacccccacggaatcgagaagtcacacggaatcgagaacgttcacggaatcgagaaccaccacggaatcgagaaggatcacggaatcgagaaaacagaaagtaaaaaacgactcggaccgatg

SEQ ID NO: 14438 - DNA, 203 bp, Homo sapiens
ggcgcgccagtcctacagaccgtactgaagtgttcttggcaaatgcttctttcttggcaaatgaccaattcttggcaaaccaccccttcttggcaaacaggtcattcttggcaaacctcgttttcttggcaaatccccacttcttggcaaatgaggatttcttggcaaactcaacattcttggcaaaacgactcggaccgatg

SEQ ID NO: 14439 - DNA, 203 bp, Homo sapiens
ggcgcgccagtcctccaccatgaactgacacaaccggccgtactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14440 - DNA, 203 bp, Homo sapiens
ggcgcgccagtcctttttcaaaagctgacacaaccggccgtactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14441 - DNA, 203 bp, Homo sapiens
ggcgcgccagtcctagtaactgtactgacacaaccggccgtactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14442 - DNA, 203 bp, Homo sapiens
ggcgcgccagtccttctctgtagactgacacaaccgtcaattcctttaacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14443 - DNA, 203 bp, Homo sapiens
ggcgcgccagtcctacgatacccactgacacaaccgtcaattcctttaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14444 - DNA, 203 bp, Homo sapiens
ggcgcgccagtcctacgtttcgttctgacacaaccgtcaattcctttaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14445 - DNA, 203 bp, Homo sapiens
ggcgcgccagtcctttagctgcacctgacacaaccgtcaattcctttaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14446 - DNA, 203 bp, Homo sapiens
ggcgcgccagtccttgcagctctgctgacacaactaccggccgtagcaacctcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14447 - DNA, 203 bp, Homo sapiens
ggcgcgccagtcctgtgcagctgcctgacacaactactcccactagcaacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14448 - DNA, 203 bp, Homo sapiens
ggcgcgccagtccttctacaaggcctgacacaactactcccactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14449 - DNA, 203 bp, Homo sapiens
ggcgcgccagtcctccacctgcacctgacacaactccggcgggtagcaacctcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14450 - DNA, 203 bp, Homo sapiens
ggcgcgccagtcctttcatactaactgacacaactgtgtaccggccgtacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14451 - DNA, 203 bp, Homo sapiens
ggcgcgccagtcctaatactagctctgacacaactgtgtaccggccgtacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14452 - DNA, 203 bp, Homo sapiens
ggcgcgccagtcctaggtgagtggctgacacaactgtgtaccggccgtacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14453 - DNA, 203 bp, Homo sapiens
ggcgcgccagtcctgaaactgcatctgacacaactgtgtcacggaatcgagaaaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14454 - DNA, 203 bp, Homo sapiens
ggcgcgccagtcctccaagcctgtctgacacaactgtgtcacggaatcgagaaaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14455 - DNA, 203 bp, Homo sapiens
ggcgcgccagtcctcctctctcgtctgacacaactgtgtccggcgggtacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14456 - DNA, 203 bp, Homo sapiens
ggcgcgccagtccttaggatcaagctgacacaactgtgtccggcgggtacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14457 - DNA, 203 bp, Homo sapiens
ggcgcgccagtcctgacgacacctctgacacaactgtgtccggcgggtacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14458 - DNA, 203 bp, Homo sapiens
ggcgcgccagtcctttcaacgaaactgacacaactgtgtcgtcaattcctttaaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14459 - DNA, 203 bp, Homo sapiens
ggcgcgccagtcctacaccgaactctgacacaactgtgttactccccaacctcaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14460 - DNA, 203 bp, Homo sapiens
ggcgcgccagtcctacgttcggtgctgacacaactgtgttactccccaacctcaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14461 - DNA, 203 bp, Homo sapiens
ggcgcgccagtcctaattcggtgtctgacacaactgtgttcaaccggccgttcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14462 - DNA, 203 bp, Homo sapiens
ggcgcgccagtccttaaccttggactgacacaactgtgttcaccggcgggttcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14463 - DNA, 203 bp, Homo sapiens
ggcgcgccagtccttttgaggcagctgacacaactgtgttcactaaagccgcaggctccactcctggtggtgcccttccgtcaattcctttaagtttcagctttgcaaccatactccccccggaacccaaagactttggtttcccggaagctgcccggcgggtcatgggaataacgccgccgcgaggtcgactcggaccgatg

SEQ ID NO: 14464 - DNA, 203 bp, Homo sapiens
ggcgcgccagtcctaactgaggcactgacacaactgtgttcactaccggccgtaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14465 - DNA, 203 bp, Homo sapiens
ggcgcgccagtccttttgtgaggcctgacacaactgtgttcactaccggccgtaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14466 - DNA, 203 bp, Homo sapiens
ggcgcgccagtcctgcctcatggtctgacacaactgtgttcactacggaactacgacggtatctgatcgtcttcgaacctccgactttcgttcttgattaatgaaaacattcttggcaaatgctttcgctctggtccgtcttgcgccggtccaagaatttcacctctagcggcgcaatacgaagaggtcgactcggaccgatg

SEQ ID NO: 14467 - DNA, 203 bp, Homo sapiens
ggcgcgccagtcctacgcctcagtctgacacaactgtgttcactagaccggccgtacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14468 - DNA, 203 bp, Homo sapiens
ggcgcgccagtcctgacgaagttcctgacacaactgtgttcactagaccggccgtacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14469 - DNA, 203 bp, Homo sapiens
ggcgcgccagtccttgtacgttgtctgacacaactgtgttcactagcaacaccggccgtacaccatggaccggccgtctcctgaggaccggccgtccgttactgaccggccgtgcaaggtgaaccggccgtaagttggtggtgaggccctgggcaggctgctggtggtctacccttggacccagaggtcgactcggaccgatg

SEQ ID NO: 14470 - DNA, 203 bp, Homo sapiens
ggcgcgccagtcctaatcacctgtctgacacaactgtgttcactagcaacaccggccgtacaccatggaccggccgtctcctgaggaccggccgtccgttactgaccggccgtgcaaggtgaacgtggatgaagttggtgaccggccgttgggcaggcaccggccgttctacccttaccggccgtggtcgactcggaccgatg

SEQ ID NO: 14471 - DNA, 203 bp, Homo sapiens
ggcgcgccagtcctgcttgaggacctgacacaactgtgttcactagcaacaccggccgtacaccatggaccggccgtctcctgaggaccggccgtccgttactgaccggccgtgcaaggtgaacgtggatgaagttggtgaccggccgttgggcaggctgctggtggtctacccttggacccagaggtcgactcggaccgatg

SEQ ID NO: 14472 - DNA, 203 bp, Homo sapiens
ggcgcgccagtcctaacgaactctctgacacaactgtgttcactagcaacaccggccgtacaccatggaccggccgtctcctgaggaccggccgtccgttactgccctgtggggcaaggtgaaccggccgtaagttggtgaccggccgttgggcaggcaccggccgttctacccttaccggccgtggtcgactcggaccgatg

SEQ ID NO: 14473 - DNA, 203 bp, Homo sapiens
ggcgcgccagtcctgtcatacccactgacacaactgtgttcactagcaacaccggccgtacaccatggaccggccgtctcctgaggaccggccgtccgttactgccctgtggggcaaggtgaaccggccgtaagttggtgaccggccgttgggcaggctgctggtggtctacccttggacccagaggtcgactcggaccgatg

SEQ ID NO: 14474 - DNA, 203 bp, Homo sapiens
ggcgcgccagtccttattctttagctgacacaactgtgttcactagcaacaccggccgtacaccatggaccggccgtctcctgaggaccggccgtccgttactgccctgtggggcaaggtgaaccggccgtaagttggtggtgaggccctgggcaggcaccggccgttctacccttggacccagaggtcgactcggaccgatg

SEQ ID NO: 14475 - DNA, 203 bp, Homo sapiens
ggcgcgccagtcctcccattcgtactgacacaactgtgttcactagcaacaccggccgtacaccatggaccggccgtctcctgaggaccggccgtccgttactgccctgtggggcaaggtgaacgtggatgaagttggtgaccggccgttgggcaggcaccggccgttctacccttaccggccgtggtcgactcggaccgatg

SEQ ID NO: 14476 - DNA, 203 bp, Homo sapiens
ggcgcgccagtcctagtgcaactactgacacaactgtgttcactagcaacaccggccgtacaccatggaccggccgtctcctgaggaccggccgtccgttactgccctgtggggcaaggtgaacgtggatgaagttggtgaccggccgttgggcaggcaccggccgttctacccttggacccagaggtcgactcggaccgatg

SEQ ID NO: 14477 - DNA, 203 bp, Homo sapiens
ggcgcgccagtcctctgcaacttactgacacaactgtgttcactagcaacaccggccgtacaccatggaccggccgtctcctgaggaccggccgtccgttactgccctgtggggcaaggtgaacgtggatgaagttggtgaccggccgttgggcaggctgctggtggtctacccttggacccagaggtcgactcggaccgatg

SEQ ID NO: 14478 - DNA, 203 bp, Homo sapiens
ggcgcgccagtcctctaacctctcctgacacaactgtgttcactagcaacaccggccgtacaccatggaccggccgtctcctgaggaccggccgtccgttactgccctgtggggcaaggtgaacgtggatgaagttggtggtgaggccctgggcaggctgctggtggtctacccttggacccagaggtcgactcggaccgatg

SEQ ID NO: 14479 - DNA, 203 bp, Homo sapiens
ggcgcgccagtccttgtctcagtcctgacacaactgtgttcactagcaacaccggccgtacaccatggaccggccgtctcctgaggagaagtctgccgttactgaccggccgtgcaaggtgaaccggccgtaagttggtgaccggccgttgggcaggcaccggccgttctacccttaccggccgtggtcgactcggaccgatg

SEQ ID NO: 14480 - DNA, 203 bp, Homo sapiens
ggcgcgccagtcctacatgagacactgacacaactgtgttcactagcaacaccggccgtacaccatggaccggccgtctcctgaggagaagtctgccgttactgaccggccgtgcaaggtgaaccggccgtaagttggtgaccggccgttgggcaggcaccggccgttctacccttggacccagaggtcgactcggaccgatg

SEQ ID NO: 14481 - DNA, 203 bp, Homo sapiens
ggcgcgccagtccttaacggtgtactgacacaactgtgttcactagcaacaccggccgtacaccatggaccggccgtctcctgaggagaagtctgccgttactgaccggccgtgcaaggtgaaccggccgtaagttggtgaccggccgttgggcaggctgctggtggtctacccttaccggccgtggtcgactcggaccgatg

SEQ ID NO: 14482 - DNA, 203 bp, Homo sapiens
ggcgcgccagtccttcgatcatggctgacacaactgtgttcactagcaacaccggccgtacaccatggaccggccgtctcctgaggagaagtctgccgttactgaccggccgtgcaaggtgaaccggccgtaagttggtgaccggccgttgggcaggctgctggtggtctacccttggacccagaggtcgactcggaccgatg

SEQ ID NO: 14483 - DNA, 203 bp, Homo sapiens
ggcgcgccagtcctacaacagtttctgacacaactgtgttcactagcaacaccggccgtacaccatggaccggccgtctcctgaggagaagtctgccgttactgaccggccgtgcaaggtgaaccggccgtaagttggtggtgaggccctgggcaggctgctggtggtctacccttggacccagaggtcgactcggaccgatg

SEQ ID NO: 14484 - DNA, 203 bp, Homo sapiens
ggcgcgccagtccttgaatgctctctgacacaactgtgttcactagcaacaccggccgtacaccatggaccggccgtctcctgaggagaagtctgccgttactgaccggccgtgcaaggtgaacgtggatgaagttggtgaccggccgttgggcaggcaccggccgttctacccttggacccagaggtcgactcggaccgatg

SEQ ID NO: 14485 - DNA, 203 bp, Homo sapiens
ggcgcgccagtcctctttgaaaacctgacacaactgtgttcactagcaacaccggccgtacaccatggaccggccgtctcctgaggagaagtctgccgttactgaccggccgtgcaaggtgaacgtggatgaagttggtgaccggccgttgggcaggctgctggtggtctacccttggacccagaggtcgactcggaccgatg

SEQ ID NO: 14486 - DNA, 203 bp, Homo sapiens
ggcgcgccagtcctagtacttaacctgacacaactgtgttcactagcaacaccggccgtacaccatggaccggccgtctcctgaggagaagtctgccgttactgaccggccgtgcaaggtgaacgtggatgaagttggtggtgaggccctgggcaggctgctggtggtctacccttggacccagaggtcgactcggaccgatg

SEQ ID NO: 14487 - DNA, 203 bp, Homo sapiens
ggcgcgccagtcctaacaaagtacctgacacaactgtgttcactagcaacaccggccgtacaccatggaccggccgtctcctgaggagaagtctgccgttactgccctgtggggcaaggtgaaccggccgtaagttggtgaccggccgttgggcaggctgctggtggtctacccttaccggccgtggtcgactcggaccgatg

SEQ ID NO: 14488 - DNA, 203 bp, Homo sapiens
ggcgcgccagtcctgaatcttcttctgacacaactgtgttcactagcaacaccggccgtacaccatggaccggccgtctcctgaggagaagtctgccgttactgccctgtggggcaaggtgaacgtggatgaagttggtgaccggccgttgggcaggcaccggccgttctacccttggacccagaggtcgactcggaccgatg

SEQ ID NO: 14489 - DNA, 203 bp, Homo sapiens
ggcgcgccagtcctgttgtagtatctgacacaactgtgttcactagcaacaccggccgtacaccatggaccggccgtctcctgaggagaagtctgccgttactgccctgtggggcaaggtgaacgtggatgaagttggtgaccggccgttgggcaggctgctggtggtctacccttggacccagaggtcgactcggaccgatg

SEQ ID NO: 14490 - DNA, 203 bp, Homo sapiens
ggcgcgccagtccttattcttagcctgacacaactgtgttcactagcaacaccggccgtacaccatggtgcatctgactcctgaggaccggccgtccgttactgaccggccgtgcaaggtgaaccggccgtaagttggtgaccggccgttgggcaggcaccggccgttctacccttaccggccgtggtcgactcggaccgatg

SEQ ID NO: 14491 - DNA, 203 bp, Homo sapiens
ggcgcgccagtcctgtcttttcaactgacacaactgtgttcactagcaacaccggccgtacaccatggtgcatctgactcctgaggaccggccgtccgttactgaccggccgtgcaaggtgaaccggccgtaagttggtgaccggccgttgggcaggctgctggtggtctacccttaccggccgtggtcgactcggaccgatg

SEQ ID NO: 14492 - DNA, 203 bp, Homo sapiens
ggcgcgccagtccttaagttactcctgacacaactgtgttcactagcaacaccggccgtacaccatggtgcatctgactcctgaggaccggccgtccgttactgaccggccgtgcaaggtgaaccggccgtaagttggtggtgaggccctgggcaggctgctggtggtctacccttaccggccgtggtcgactcggaccgatg

SEQ ID NO: 14493 - DNA, 203 bp, Homo sapiens
ggcgcgccagtccttaactcaaacctgacacaactgtgttcactagcaacaccggccgtacaccatggtgcatctgactcctgaggaccggccgtccgttactgaccggccgtgcaaggtgaaccggccgtaagttggtggtgaggccctgggcaggctgctggtggtctacccttggacccagaggtcgactcggaccgatg

SEQ ID NO: 14494 - DNA, 203 bp, Homo sapiens
ggcgcgccagtcctatgtagaaacctgacacaactgtgttcactagcaacaccggccgtacaccatggtgcatctgactcctgaggaccggccgtccgttactgaccggccgtgcaaggtgaacgtggatgaagttggtgaccggccgttgggcaggcaccggccgttctacccttggacccagaggtcgactcggaccgatg

SEQ ID NO: 14495 - DNA, 203 bp, Homo sapiens
ggcgcgccagtcctacgaaggatcctgacacaactgtgttcactagcaacaccggccgtacaccatggtgcatctgactcctgaggaccggccgtccgttactgaccggccgtgcaaggtgaacgtggatgaagttggtgaccggccgttgggcaggctgctggtggtctacccttggacccagaggtcgactcggaccgatg

SEQ ID NO: 14496 - DNA, 203 bp, Homo sapiens
ggcgcgccagtcctcttcatacagctgacacaactgtgttcactagcaacaccggccgtacaccatggtgcatctgactcctgaggaccggccgtccgttactgccctgtggggcaaggtgaaccggccgtaagttggtggtgaggccctgggcaggcaccggccgttctacccttaccggccgtggtcgactcggaccgatg

SEQ ID NO: 14497 - DNA, 203 bp, Homo sapiens
ggcgcgccagtccttcgttgtatgctgacacaactgtgttcactagcaacaccggccgtacaccatggtgcatctgactcctgaggaccggccgtccgttactgccctgtggggcaaggtgaaccggccgtaagttggtggtgaggccctgggcaggcaccggccgttctacccttggacccagaggtcgactcggaccgatg

SEQ ID NO: 14498 - DNA, 203 bp, Homo sapiens
ggcgcgccagtcctctctgtatggctgacacaactgtgttcactagcaacaccggccgtacaccatggtgcatctgactcctgaggaccggccgtccgttactgccctgtggggcaaggtgaaccggccgtaagttggtggtgaggccctgggcaggctgctggtggtctacccttaccggccgtggtcgactcggaccgatg

SEQ ID NO: 14499 - DNA, 203 bp, Homo sapiens
ggcgcgccagtcctatgtatgtagctgacacaactgtgttcactagcaacaccggccgtacaccatggtgcatctgactcctgaggaccggccgtccgttactgccctgtggggcaaggtgaaccggccgtaagttggtggtgaggccctgggcaggctgctggtggtctacccttggacccagaggtcgactcggaccgatg

SEQ ID NO: 14500 - DNA, 203 bp, Homo sapiens
ggcgcgccagtccttgtatgagatctgacacaactgtgttcactagcaacaccggccgtacaccatggtgcatctgactcctgaggaccggccgtccgttactgccctgtggggcaaggtgaacgtggatgaagttggtgaccggccgttgggcaggcaccggccgttctacccttggacccagaggtcgactcggaccgatg

SEQ ID NO: 14501 - DNA, 203 bp, Homo sapiens
ggcgcgccagtccttgtatgaagactgacacaactgtgttcactagcaacaccggccgtacaccatggtgcatctgactcctgaggaccggccgtccgttactgccctgtggggcaaggtgaacgtggatgaagttggtgaccggccgttgggcaggctgctggtggtctacccttaccggccgtggtcgactcggaccgatg

SEQ ID NO: 14502 - DNA, 203 bp, Homo sapiens
ggcgcgccagtcctatcagacgaactgacacaactgtgttcactagcaacaccggccgtacaccatggtgcatctgactcctgaggaccggccgtccgttactgccctgtggggcaaggtgaacgtggatgaagttggtggtgaggccctgggcaggcaccggccgttctacccttggacccagaggtcgactcggaccgatg

SEQ ID NO: 14503 - DNA, 203 bp, Homo sapiens
ggcgcgccagtccttcagaagttactgacacaactgtgttcactagcaacaccggccgtacaccatggtgcatctgactcctgaggaccggccgtccgttactgccctgtggggcaaggtgaacgtggatgaagttggtggtgaggccctgggcaggctgctggtggtctacccttggacccagaggtcgactcggaccgatg

SEQ ID NO: 14504 - DNA, 203 bp, Homo sapiens
ggcgcgccagtcctactggtaggactgacacaactgtgttcactagcaacaccggccgtacaccatggtgcatctgactcctgaggagaagtctgccgttactgaccggccgtgcaaggtgaaccggccgtaagttggtgaccggccgttgggcaggctgctggtggtctacccttaccggccgtggtcgactcggaccgatg

SEQ ID NO: 14505 - DNA, 203 bp, Homo sapiens
ggcgcgccagtcctaggatacctcctgacacaactgtgttcactagcaacaccggccgtacaccatggtgcatctgactcctgaggagaagtctgccgttactgaccggccgtgcaaggtgaaccggccgtaagttggtggtgaggccctgggcaggcaccggccgttctacccttggacccagaggtcgactcggaccgatg

SEQ ID NO: 14506 - DNA, 203 bp, Homo sapiens
ggcgcgccagtcctgaggtatgacctgacacaactgtgttcactagcaacaccggccgtacaccatggtgcatctgactcctgaggagaagtctgccgttactgaccggccgtgcaaggtgaaccggccgtaagttggtggtgaggccctgggcaggctgctggtggtctacccttggacccagaggtcgactcggaccgatg

SEQ ID NO: 14507 - DNA, 203 bp, Homo sapiens
ggcgcgccagtcctgtgctgaactctgacacaactgtgttcactagcaacaccggccgtacaccatggtgcatctgactcctgaggagaagtctgccgttactgaccggccgtgcaaggtgaacgtggatgaagttggtgaccggccgttgggcaggctgctggtggtctacccttggacccagaggtcgactcggaccgatg

SEQ ID NO: 14508 - DNA, 203 bp, Homo sapiens
ggcgcgccagtcctgcagttcacactgacacaactgtgttcactagcaacaccggccgtacaccatggtgcatctgactcctgaggagaagtctgccgttactgaccggccgtgcaaggtgaacgtggatgaagttggtggtgaggccctgggcaggcaccggccgttctacccttggacccagaggtcgactcggaccgatg

SEQ ID NO: 14509 - DNA, 203 bp, Homo sapiens
ggcgcgccagtcctcagcagttctctgacacaactgtgttcactagcaacaccggccgtacaccatggtgcatctgactcctgaggagaagtctgccgttactgaccggccgtgcaaggtgaacgtggatgaagttggtggtgaggccctgggcaggctgctggtggtctacccttaccggccgtggtcgactcggaccgatg

SEQ ID NO: 14510 - DNA, 203 bp, Homo sapiens
ggcgcgccagtcctctaccagtagctgacacaactgtgttcactagcaacaccggccgtacaccatggtgcatctgactcctgaggagaagtctgccgttactgccctgtggggcaaggtgaaccggccgtaagttggtgaccggccgttgggcaggcaccggccgttctacccttaccggccgtggtcgactcggaccgatg

SEQ ID NO: 14511 - DNA, 203 bp, Homo sapiens
ggcgcgccagtcctcctgctgacactgacacaactgtgttcactagcaacaccggccgtacaccatggtgcatctgactcctgaggagaagtctgccgttactgccctgtggggcaaggtgaaccggccgtaagttggtgaccggccgttgggcaggcaccggccgttctacccttggacccagaggtcgactcggaccgatg

SEQ ID NO: 14512 - DNA, 203 bp, Homo sapiens
ggcgcgccagtccttgtcagcattctgacacaactgtgttcactagcaacaccggccgtacaccatggtgcatctgactcctgaggagaagtctgccgttactgccctgtggggcaaggtgaaccggccgtaagttggtgaccggccgttgggcaggctgctggtggtctacccttaccggccgtggtcgactcggaccgatg

SEQ ID NO: 14513 - DNA, 203 bp, Homo sapiens
ggcgcgccagtcctctaggtgactctgacacaactgtgttcactagcaacaccggccgtacaccatggtgcatctgactcctgaggagaagtctgccgttactgccctgtggggcaaggtgaaccggccgtaagttggtgaccggccgttgggcaggctgctggtggtctacccttggacccagaggtcgactcggaccgatg

SEQ ID NO: 14514 - DNA, 203 bp, Homo sapiens
ggcgcgccagtccttagagtgcagctgacacaactgtgttcactagcaacaccggccgtacaccatggtgcatctgactcctgaggagaagtctgccgttactgccctgtggggcaaggtgaaccggccgtaagttggtggtgaggccctgggcaggcaccggccgttctacccttggacccagaggtcgactcggaccgatg

SEQ ID NO: 14515 - DNA, 203 bp, Homo sapiens
ggcgcgccagtcctgtggtgattcctgacacaactgtgttcactagcaacaccggccgtacaccatggtgcatctgactcctgaggagaagtctgccgttactgccctgtggggcaaggtgaaccggccgtaagttggtggtgaggccctgggcaggctgctggtggtctacccttggacccagaggtcgactcggaccgatg

SEQ ID NO: 14516 - DNA, 203 bp, Homo sapiens
ggcgcgccagtccttctgaagacactgacacaactgtgttcactagcaacaccggccgtacaccatggtgcatctgactcctgaggagaagtctgccgttactgccctgtggggcaaggtgaacgtggatgaagttggtgaccggccgttgggcaggctgctggtggtctacccttaccggccgtggtcgactcggaccgatg

SEQ ID NO: 14517 - DNA, 203 bp, Homo sapiens
ggcgcgccagtccttctgaagtacctgacacaactgtgttcactagcaacaccggccgtacaccatggtgcatctgactcctgaggagaagtctgccgttactgccctgtggggcaaggtgaacgtggatgaagttggtggtgaggccctgggcaggcaccggccgttctacccttggacccagaggtcgactcggaccgatg

SEQ ID NO: 14518 - DNA, 203 bp, Homo sapiens
ggcgcgccagtccttctgttctggctgacacaactgtgttcactagcaacaccggccgtacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14519 - DNA, 203 bp, Homo sapiens
ggcgcgccagtcctcttgttcagactgacacaactgtgttcactagcaaccacggaatcgagaaatggcacggaatcgagaagaggagaagtctgccgttactgcacggaatcgagaagtgaacgtggatgaagttggtgcacggaatcgagaaaggccacggaatcgagaaccttggacccagaggtcgactcggaccgatg

SEQ ID NO: 14520 - DNA, 203 bp, Homo sapiens
ggcgcgccagtcctaccactcagactgacacaactgtgttcactagcaaccacggaatcgagaaatggcacggaatcgagaagaggagaagtctgccgttactgcacggaatcgagaagtgaacgtggatgaagttggtggtgaggccctgggcaggccacggaatcgagaaccttggacccagaggtcgactcggaccgatg

SEQ ID NO: 14521 - DNA, 203 bp, Homo sapiens
ggcgcgccagtccttacaacctggctgacacaactgtgttcactagcaaccacggaatcgagaaatggcacggaatcgagaagaggagaagtctgccgttactgcacggaatcgagaagtgacacggaatcgagaaggtggtgaggccctgggcaggccacggaatcgagaaccttggacccagaggtcgactcggaccgatg

SEQ ID NO: 14522 - DNA, 203 bp, Homo sapiens
ggcgcgccagtccttgtaggctttctgacacaactgtgttcactagcaaccacggaatcgagaaatggcacggaatcgagaagaggagaagtctgccgttactgcacggaatcgagaagtgacacggaatcgagaaggtggtgaggccctgggcaggctgctggtggtctacccttggacccagaggtcgactcggaccgatg

SEQ ID NO: 14523 - DNA, 203 bp, Homo sapiens
ggcgcgccagtcctgagcaactggctgacacaactgtgttcactagcaaccacggaatcgagaaatggcacggaatcgagaagaggagaagtctgccgttactgccctgtggggcaaggtgaacgtggatgaagttggtgcacggaatcgagaaaggctgctggtggtctacccttggacccagaggtcgactcggaccgatg

SEQ ID NO: 14524 - DNA, 203 bp, Homo sapiens
ggcgcgccagtcctaggtttcaagctgacacaactgtgttcactagcaaccacggaatcgagaaatggcacggaatcgagaagaggagaagtctgccgttactgccctgtggggcaaggtgacacggaatcgagaaggtggtgaggccctgggcaggccacggaatcgagaaccttggacccagaggtcgactcggaccgatg

SEQ ID NO: 14525 - DNA, 203 bp, Homo sapiens
ggcgcgccagtcctcttttcagcactgacacaactgtgttcactagcaaccacggaatcgagaaatggcacggaatcgagaagaggcacggaatcgagaaactgcacggaatcgagaagtgacacggaatcgagaaggtgcacggaatcgagaaaggctgctggtggtctacccttggacccagaggtcgactcggaccgatg

SEQ ID NO: 14526 - DNA, 203 bp, Homo sapiens
ggcgcgccagtccttaactctcaactgacacaactgtgttcactagcaaccacggaatcgagaaatggcacggaatcgagaagaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 14527 - DNA, 203 bp, Homo sapiens
ggcgcgccagtcctggcaacgagcctgacacaactgtgttcactagcaaccacggaatcgagaaatggcacggaatcgagaagaggcacggaatcgagaaactgccctgtggggcaaggtgaacgtggatgaagttggtgcacggaatcgagaaaggctgctggtggtctacccttggacccagaggtcgactcggaccgatg

SEQ ID NO: 14528 - DNA, 203 bp, Homo sapiens
ggcgcgccagtcctggcactgtgcctgacacaactgtgttcactagcaaccacggaatcgagaaatggcacggaatcgagaagaggcacggaatcgagaaactgccctgtggggcaaggtgaacgtggatgaagttggtggtgaggccctgggcaggctgctggtggtctacccttggacccagaggtcgactcggaccgatg

SEQ ID NO: 14529 - DNA, 203 bp, Homo sapiens
ggcgcgccagtcctggacggtcacctgacacaactgtgttcactagcaaccacggaatcgagaaatggcacggaatcgagaagaggcacggaatcgagaaactgccctgtggggcaaggtgacacggaatcgagaaggtgcacggaatcgagaaaggccacggaatcgagaaccttggacccagaggtcgactcggaccgatg

SEQ ID NO: 14530 - DNA, 203 bp, Homo sapiens
ggcgcgccagtcctgtgaccgtccctgacacaactgtgttcactagcaaccacggaatcgagaaatggtgcatctgactcctgaggagaagtctgccgttactgcacggaatcgagaagtgaacgtggatgaagttggtgcacggaatcgagaaaggctgctggtggtctacccttggacccagaggtcgactcggaccgatg

SEQ ID NO: 14531 - DNA, 203 bp, Homo sapiens
ggcgcgccagtcctcaaggctttcctgacacaactgtgttcactagcaaccacggaatcgagaaatggtgcatctgactcctgaggagaagtctgccgttactgcacggaatcgagaagtgacacggaatcgagaaggtgcacggaatcgagaaaggctgctggtggtctacccttggacccagaggtcgactcggaccgatg

SEQ ID NO: 14532 - DNA, 203 bp, Homo sapiens
ggcgcgccagtcctacaaagccttctgacacaactgtgttcactagcaaccacggaatcgagaaatggtgcatctgactcctgaggagaagtctgccgttactgcacggaatcgagaagtgacacggaatcgagaaggtggtgaggccctgggcaggccacggaatcgagaaccttggacccagaggtcgactcggaccgatg

SEQ ID NO: 14533 - DNA, 203 bp, Homo sapiens
ggcgcgccagtcctacaacggtccctgacacaactgtgttcactagcaaccacggaatcgagaaatggtgcatctgactcctgaggagaagtctgccgttactgccctgtggggcaaggtgacacggaatcgagaaggtgcacggaatcgagaaaggccacggaatcgagaaccttggacccagaggtcgactcggaccgatg

SEQ ID NO: 14534 - DNA, 203 bp, Homo sapiens
ggcgcgccagtcctgtagctcaccctgacacaactgtgttcactagcaaccacggaatcgagaaatggtgcatctgactcctgaggagaagtctgccgttactgccctgtggggcaaggtgacacggaatcgagaaggtgcacggaatcgagaaaggctgctggtggtctacccttggacccagaggtcgactcggaccgatg

SEQ ID NO: 14535 - DNA, 203 bp, Homo sapiens
ggcgcgccagtcctgtcacctaccctgacacaactgtgttcactagcaaccacggaatcgagaaatggtgcatctgactcctgaggcacggaatcgagaaactgcacggaatcgagaagtgaacgtggatgaagttggtgcacggaatcgagaaaggccacggaatcgagaaccttggacccagaggtcgactcggaccgatg

SEQ ID NO: 14536 - DNA, 203 bp, Homo sapiens
ggcgcgccagtccttgagcagtccctgacacaactgtgttcactagcaaccacggaatcgagaaatggtgcatctgactcctgaggcacggaatcgagaaactgcacggaatcgagaagtgaacgtggatgaagttggtgcacggaatcgagaaaggctgctggtggtctacccttggacccagaggtcgactcggaccgatg

SEQ ID NO: 14537 - DNA, 203 bp, Homo sapiens
ggcgcgccagtcctctgaaaggccctgacacaactgtgttcactagcaaccacggaatcgagaaatggtgcatctgactcctgaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 14538 - DNA, 203 bp, Homo sapiens
ggcgcgccagtcctggctctgcaactgacacaactgtgttcactagcaaccacggaatcgagaaatggtgcatctgactcctgaggcacggaatcgagaaactgccctgtggggcaaggtgaacgtggatgaagttggtggtgaggccctgggcaggccacggaatcgagaaccttggacccagaggtcgactcggaccgatg

SEQ ID NO: 14539 - DNA, 203 bp, Homo sapiens
ggcgcgccagtcctatccaggaccctgacacaactgtgttcactagcaaccacggaatcgagaaatggtgcatctgactcctgaggcacggaatcgagaaactgccctgtggggcaaggtgacacggaatcgagaaggtggtgaggccctgggcaggccacggaatcgagaaccttggacccagaggtcgactcggaccgatg

SEQ ID NO: 14540 - DNA, 203 bp, Homo sapiens
ggcgcgccagtcctactgaaggccctgacacaactgtgttcactagcaaccaggagcgagcgaccaaaggaaccataactgatttaatgagccattcgcagtttcactgtaccggccgtgcgtactcagacatgcatggcttaatctttgagacaagcatatgctactggcaggatcgacccagaggtcgactcggaccgatg

SEQ ID NO: 14541 - DNA, 203 bp, Homo sapiens
ggcgcgccagtcctctacagagccctgacacaactgtgttcactagcaaccccggcgggtcaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14542 - DNA, 203 bp, Homo sapiens
ggcgcgccagtcctggcactcaacctgacacaactgtgttcactagcaacccggcgggtacaccatggccggcgggtctcctgaggagaagtctgccgttactgccctgtggggcaaggtgaccggcgggtaagttggtgccggcgggttgggcaggctgctggtggtctacccttccggcgggtggtcgactcggaccgatg

SEQ ID NO: 14543 - DNA, 203 bp, Homo sapiens
ggcgcgccagtcctggtgtagagcctgacacaactgtgttcactagcaacccggcgggtacaccatggccggcgggtctcctgaggagaagtctgccgttactgccctgtggggcaaggtgaccggcgggtaagttggtggtgaggccctgggcaggctgctggtggtctacccttggacccagaggtcgactcggaccgatg

SEQ ID NO: 14544 - DNA, 203 bp, Homo sapiens
ggcgcgccagtcctggtttcggtcctgacacaactgtgttcactagcaacccggcgggtacaccatggccggcgggtctcctgaggagaagtctgccgttactgccggcgggtgcaaggtgaacgtggatgaagttggtgccggcgggttgggcaggcccggcgggttctacccttccggcgggtggtcgactcggaccgatg

SEQ ID NO: 14545 - DNA, 203 bp, Homo sapiens
ggcgcgccagtcctggttggactgctgacacaactgtgttcactagcaacccggcgggtacaccatggccggcgggtctcctgaggagaagtctgccgttactgccggcgggtgcaaggtgaacgtggatgaagttggtggtgaggccctgggcaggcccggcgggttctacccttggacccagaggtcgactcggaccgatg

SEQ ID NO: 14546 - DNA, 203 bp, Homo sapiens
ggcgcgccagtcctgacatgacgactgacacaactgtgttcactagcaacccggcgggtacaccatggccggcgggtctcctgaggagaagtctgccgttactgccggcgggtgcaaggtgaacgtggatgaagttggtggtgaggccctgggcaggctgctggtggtctacccttccggcgggtggtcgactcggaccgatg

SEQ ID NO: 14547 - DNA, 203 bp, Homo sapiens
ggcgcgccagtcctcctctttgtgctgacacaactgtgttcactagcaacccggcgggtacaccatggccggcgggtctcctgaggagaagtctgccgttactgccggcgggtgcaaggtgaacgtggatgaagttggtggtgaggccctgggcaggctgctggtggtctacccttggacccagaggtcgactcggaccgatg

SEQ ID NO: 14548 - DNA, 203 bp, Homo sapiens
ggcgcgccagtccttcgtagaggtctgacacaactgtgttcactagcaacccggcgggtacaccatggccggcgggtctcctgaggagaagtctgccgttactgccggcgggtgcaaggtgaccggcgggtaagttggtgccggcgggttgggcaggctgctggtggtctacccttccggcgggtggtcgactcggaccgatg

SEQ ID NO: 14549 - DNA, 203 bp, Homo sapiens
ggcgcgccagtcctatcgtagtacctgacacaactgtgttcactagcaacccggcgggtacaccatggccggcgggtctcctgaggagaagtctgccgttactgccggcgggtgcaaggtgaccggcgggtaagttggtgccggcgggttgggcaggctgctggtggtctacccttggacccagaggtcgactcggaccgatg

SEQ ID NO: 14550 - DNA, 203 bp, Homo sapiens
ggcgcgccagtcctgctctacgaactgacacaactgtgttcactagcaacccggcgggtacaccatggccggcgggtctcctgaggccggcgggtccgttactgccctgtggggcaaggtgaacgtggatgaagttggtgccggcgggttgggcaggcccggcgggttctacccttggacccagaggtcgactcggaccgatg

SEQ ID NO: 14551 - DNA, 203 bp, Homo sapiens
ggcgcgccagtcctccacctgtgtctgacacaactgtgttcactagcaacccggcgggtacaccatggccggcgggtctcctgaggccggcgggtccgttactgccctgtggggcaaggtgaccggcgggtaagttggtgccggcgggttgggcaggcccggcgggttctacccttccggcgggtggtcgactcggaccgatg

SEQ ID NO: 14552 - DNA, 203 bp, Homo sapiens
ggcgcgccagtcctcctgtgtttgctgacacaactgtgttcactagcaacccggcgggtacaccatggccggcgggtctcctgaggccggcgggtccgttactgccctgtggggcaaggtgaccggcgggtaagttggtgccggcgggttgggcaggctgctggtggtctacccttccggcgggtggtcgactcggaccgatg

SEQ ID NO: 14553 - DNA, 203 bp, Homo sapiens
ggcgcgccagtcctatgtgtccttctgacacaactgtgttcactagcaacccggcgggtacaccatggccggcgggtctcctgaggccggcgggtccgttactgccctgtggggcaaggtgaccggcgggtaagttggtggtgaggccctgggcaggcccggcgggttctacccttggacccagaggtcgactcggaccgatg

SEQ ID NO: 14554 - DNA, 203 bp, Homo sapiens
ggcgcgccagtcctaggacacaggctgacacaactgtgttcactagcaacccggcgggtacaccatggccggcgggtctcctgaggccggcgggtccgttactgccctgtggggcaaggtgaccggcgggtaagttggtggtgaggccctgggcaggctgctggtggtctacccttggacccagaggtcgactcggaccgatg

SEQ ID NO: 14555 - DNA, 203 bp, Homo sapiens
ggcgcgccagtcctgtcgtcatgtctgacacaactgtgttcactagcaacccggcgggtacaccatggccggcgggtctcctgaggccggcgggtccgttactgccggcgggtgcaaggtgaacgtggatgaagttggtggtgaggccctgggcaggcccggcgggttctacccttggacccagaggtcgactcggaccgatg

SEQ ID NO: 14556 - DNA, 203 bp, Homo sapiens
ggcgcgccagtcctacagttgattctgacacaactgtgttcactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14557 - DNA, 203 bp, Homo sapiens
ggcgcgccagtccttaggatcgtcctgacacaactgtgttcactagcaacccggcgggtacaccatggccggcgggtctcctgaggccggcgggtccgttactgccggcgggtgcaaggtgaccggcgggtaagttggtggtgaggccctgggcaggcccggcgggttctacccttccggcgggtggtcgactcggaccgatg

SEQ ID NO: 14558 - DNA, 203 bp, Homo sapiens
ggcgcgccagtccttgcttgggtcctgacacaactgtgttcactagcaacccggcgggtacaccatggccggcgggtctcctgaggccggcgggtccgttactgccggcgggtgcaaggtgaccggcgggtaagttggtggtgaggccctgggcaggctgctggtggtctacccttccggcgggtggtcgactcggaccgatg

SEQ ID NO: 14559 - DNA, 203 bp, Homo sapiens
ggcgcgccagtcctctagacaggactgacacaactgtgttcactagcaacccggcgggtacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14560 - DNA, 203 bp, Homo sapiens
ggcgcgccagtcctggtacggtgactgacacaactgtgttcactagcaacccggcgggtacaccatggtgcatctgactcctgaggagaagtctgccgttactgccctgtggggcaaggtgaccggcgggtaagttggtgccggcgggttgggcaggcccggcgggttctacccttggacccagaggtcgactcggaccgatg

SEQ ID NO: 14561 - DNA, 203 bp, Homo sapiens
ggcgcgccagtccttacactgcctctgacacaactgtgttcactagcaacccggcgggtacaccatggtgcatctgactcctgaggagaagtctgccgttactgccggcgggtgcaaggtgaacgtggatgaagttggtgccggcgggttgggcaggcccggcgggttctacccttggacccagaggtcgactcggaccgatg

SEQ ID NO: 14562 - DNA, 203 bp, Homo sapiens
ggcgcgccagtcctcaggctgttcctgacacaactgtgttcactagcaacccggcgggtacaccatggtgcatctgactcctgaggagaagtctgccgttactgccggcgggtgcaaggtgaacgtggatgaagttggtgccggcgggttgggcaggctgctggtggtctacccttccggcgggtggtcgactcggaccgatg

SEQ ID NO: 14563 - DNA, 203 bp, Homo sapiens
ggcgcgccagtcctaggcagtcttctgacacaactgtgttcactagcaacccggcgggtacaccatggtgcatctgactcctgaggagaagtctgccgttactgccggcgggtgcaaggtgaacgtggatgaagttggtgccggcgggttgggcaggctgctggtggtctacccttggacccagaggtcgactcggaccgatg

SEQ ID NO: 14564 - DNA, 203 bp, Homo sapiens
ggcgcgccagtccttcatggtggactgacacaactgtgttcactagcaacccggcgggtacaccatggtgcatctgactcctgaggagaagtctgccgttactgccggcgggtgcaaggtgaacgtggatgaagttggtggtgaggccctgggcaggcccggcgggttctacccttggacccagaggtcgactcggaccgatg

SEQ ID NO: 14565 - DNA, 203 bp, Homo sapiens
ggcgcgccagtcctagtagagaacctgacacaactgtgttcactagcaacccggcgggtacaccatggtgcatctgactcctgaggagaagtctgccgttactgccggcgggtgcaaggtgaccggcgggtaagttggtgccggcgggttgggcaggcccggcgggttctacccttggacccagaggtcgactcggaccgatg

SEQ ID NO: 14566 - DNA, 203 bp, Homo sapiens
ggcgcgccagtccttgagtccactctgacacaactgtgttcactagcaacccggcgggtacaccatggtgcatctgactcctgaggagaagtctgccgttactgccggcgggtgcaaggtgaccggcgggtaagttggtgccggcgggttgggcaggctgctggtggtctacccttccggcgggtggtcgactcggaccgatg

SEQ ID NO: 14567 - DNA, 203 bp, Homo sapiens
ggcgcgccagtccttttgtgacctctgacacaactgtgttcactagcaacccggcgggtacaccatggtgcatctgactcctgaggagaagtctgccgttactgccggcgggtgcaaggtgaccggcgggtaagttggtggtgaggccctgggcaggcccggcgggttctacccttccggcgggtggtcgactcggaccgatg

SEQ ID NO: 14568 - DNA, 203 bp, Homo sapiens
ggcgcgccagtcctacaggcttacctgacacaactgtgttcactagcaacccggcgggtacaccatggtgcatctgactcctgaggccggcgggtccgttactgccctgtggggcaaggtgaacgtggatgaagttggtgccggcgggttgggcaggctgctggtggtctacccttggacccagaggtcgactcggaccgatg

SEQ ID NO: 14569 - DNA, 203 bp, Homo sapiens
ggcgcgccagtccttaagcctgacctgacacaactgtgttcactagcaacccggcgggtacaccatggtgcatctgactcctgaggccggcgggtccgttactgccctgtggggcaaggtgaacgtggatgaagttggtggtgaggccctgggcaggcccggcgggttctacccttccggcgggtggtcgactcggaccgatg

SEQ ID NO: 14570 - DNA, 203 bp, Homo sapiens
ggcgcgccagtccttacagacaacctgacacaactgtgttcactagcaacccggcgggtacaccatggtgcatctgactcctgaggccggcgggtccgttactgccggcgggtgcaaggtgaacgtggatgaagttggtgccggcgggttgggcaggctgctggtggtctacccttggacccagaggtcgactcggaccgatg

SEQ ID NO: 14571 - DNA, 203 bp, Homo sapiens
ggcgcgccagtcctcttgtctgaactgacacaactgtgttcactagcaacccggcgggtacaccatggtgcatctgactcctgaggccggcgggtccgttactgccggcgggtgcaaggtgaacgtggatgaagttggtggtgaggccctgggcaggcccggcgggttctacccttggacccagaggtcgactcggaccgatg

SEQ ID NO: 14572 - DNA, 203 bp, Homo sapiens
ggcgcgccagtcctaacccatgatctgacacaactgtgttcactagcaacccggcgggtacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14573 - DNA, 203 bp, Homo sapiens
ggcgcgccagtcctaccgagcctgctgacacaactgtgttcactagcaacccggcgggtacaccatggtgcatctgactcctgaggccggcgggtccgttactgccggcgggtgcaaggtgaccggcgggtaagttggtgccggcgggttgggcaggctgctggtggtctacccttccggcgggtggtcgactcggaccgatg

SEQ ID NO: 14574 - DNA, 203 bp, Homo sapiens
ggcgcgccagtcctacctaagcagctgacacaactgtgttcactagcaacccggcgggtacaccatggtgcatctgactcctgaggccggcgggtccgttactgccggcgggtgcaaggtgaccggcgggtaagttggtgccggcgggttgggcaggctgctggtggtctacccttggacccagaggtcgactcggaccgatg

SEQ ID NO: 14575 - DNA, 203 bp, Homo sapiens
ggcgcgccagtcctgtgagaagttctgacacaactgtgttcactagcaacccgtcaattcctttatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14576 - DNA, 203 bp, Homo sapiens
ggcgcgccagtcctcttagaccacctgacacaactgtgttcactagcaaccgtcaattcctttaatggcgtcaattcctttagaggagaagtctgccgttactgccctgtggggcaaggtgaacgtggatgaagttggtggtgaggccctgggcaggccgtcaattcctttaccttggacccagaggtcgactcggaccgatg

SEQ ID NO: 14577 - DNA, 203 bp, Homo sapiens
ggcgcgccagtccttcagcttagactgacacaactgtgttcactagcaaccgtcaattcctttaatggcgtcaattcctttagaggagaagtctgccgttactgccctgtggggcaaggtgacgtcaattcctttaggtggtgaggccctgggcaggctgctggtggtctacccttggacccagaggtcgactcggaccgatg

SEQ ID NO: 14578 - DNA, 203 bp, Homo sapiens
ggcgcgccagtcctccacttctagctgacacaactgtgttcactagcaaccgtcaattcctttaatggcgtcaattcctttagaggagaagtctgccgttactgcgtcaattcctttagtgaacgtggatgaagttggtggtgaggccctgggcaggctgctggtggtctacccttggacccagaggtcgactcggaccgatg

SEQ ID NO: 14579 - DNA, 203 bp, Homo sapiens
ggcgcgccagtcctagtttgggtactgacacaactgtgttcactagcaaccgtcaattcctttaatggcgtcaattcctttagaggagaagtctgccgttactgcgtcaattcctttagtgacgtcaattcctttaggtggtgaggccctgggcaggctgctggtggtctacccttggacccagaggtcgactcggaccgatg

SEQ ID NO: 14580 - DNA, 203 bp, Homo sapiens
ggcgcgccagtcctcaacagtgacctgacacaactgtgttcactagcaaccgtcaattcctttaatggcgtcaattcctttagaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 14581 - DNA, 203 bp, Homo sapiens
ggcgcgccagtcctccacttcggtctgacacaactgtgttcactagcaaccgtcaattcctttaatggcgtcaattcctttagaggcgtcaattcctttaactgccctgtggggcaaggtgacgtcaattcctttaggtgcgtcaattcctttaaggccgtcaattcctttaccttggacccagaggtcgactcggaccgatg

SEQ ID NO: 14582 - DNA, 203 bp, Homo sapiens
ggcgcgccagtcctttgtagcgttctgacacaactgtgttcactagcaaccgtcaattcctttaatggcgtcaattcctttagaggcgtcaattcctttaactgccctgtggggcaaggtgacgtcaattcctttaggtggtgaggccctgggcaggccgtcaattcctttaccttggacccagaggtcgactcggaccgatg

SEQ ID NO: 14583 - DNA, 203 bp, Homo sapiens
ggcgcgccagtcctaacgctactcctgacacaactgtgttcactagcaaccgtcaattcctttaatggcgtcaattcctttagaggcgtcaattcctttaactgccctgtggggcaaggtgacgtcaattcctttaggtggtgaggccctgggcaggctgctggtggtctacccttggacccagaggtcgactcggaccgatg

SEQ ID NO: 14584 - DNA, 203 bp, Homo sapiens
ggcgcgccagtcctcagatcagtgctgacacaactgtgttcactagcaaccgtcaattcctttaatggcgtcaattcctttagaggcgtcaattcctttaactgcgtcaattcctttagtgaacgtggatgaagttggtggtgaggccctgggcaggccgtcaattcctttaccttggacccagaggtcgactcggaccgatg

SEQ ID NO: 14585 - DNA, 203 bp, Homo sapiens
ggcgcgccagtccttcttgacgatctgacacaactgtgttcactagcaaccgtcaattcctttaatggcgtcaattcctttagaggcgtcaattcctttaactgcgtcaattcctttagtgacgtcaattcctttaggtggtgaggccctgggcaggctgctggtggtctacccttggacccagaggtcgactcggaccgatg

SEQ ID NO: 14586 - DNA, 203 bp, Homo sapiens
ggcgcgccagtcctctgatcaagactgacacaactgtgttcactagcaaccgtcaattcctttaatggtgcatctgactcctgaggagaagtctgccgttactgccctgtggggcaaggtgaacgtggatgaagttggtgcgtcaattcctttaaggctgctggtggtctacccttggacccagaggtcgactcggaccgatg

SEQ ID NO: 14587 - DNA, 203 bp, Homo sapiens
ggcgcgccagtccttgaacaacgactgacacaactgtgttcactagcaaccgtcaattcctttaatggtgcatctgactcctgaggagaagtctgccgttactgccctgtggggcaaggtgacgtcaattcctttaggtgcgtcaattcctttaaggccgtcaattcctttaccttggacccagaggtcgactcggaccgatg

SEQ ID NO: 14588 - DNA, 203 bp, Homo sapiens
ggcgcgccagtccttactgggtctctgacacaactgtgttcactagcaaccgtcaattcctttaatggtgcatctgactcctgaggagaagtctgccgttactgccctgtggggcaaggtgacgtcaattcctttaggtgcgtcaattcctttaaggctgctggtggtctacccttggacccagaggtcgactcggaccgatg

SEQ ID NO: 14589 - DNA, 203 bp, Homo sapiens
ggcgcgccagtcctggtaactgggctgacacaactgtgttcactagcaaccgtcaattcctttaatggtgcatctgactcctgaggagaagtctgccgttactgccctgtggggcaaggtgacgtcaattcctttaggtggtgaggccctgggcaggccgtcaattcctttaccttggacccagaggtcgactcggaccgatg

SEQ ID NO: 14590 - DNA, 203 bp, Homo sapiens
ggcgcgccagtcctcactgggttcctgacacaactgtgttcactagcaaccgtcaattcctttaatggtgcatctgactcctgaggagaagtctgccgttactgccctgtggggcaaggtgacgtcaattcctttaggtggtgaggccctgggcaggctgctggtggtctacccttggacccagaggtcgactcggaccgatg

SEQ ID NO: 14591 - DNA, 203 bp, Homo sapiens
ggcgcgccagtcctcccagtttgcctgacacaactgtgttcactagcaaccgtcaattcctttaatggtgcatctgactcctgaggagaagtctgccgttactgcgtcaattcctttagtgacgtcaattcctttaggtgcgtcaattcctttaaggccgtcaattcctttaccttggacccagaggtcgactcggaccgatg

SEQ ID NO: 14592 - DNA, 203 bp, Homo sapiens
ggcgcgccagtcctgaccgtttctctgacacaactgtgttcactagcaaccgtcaattcctttaatggtgcatctgactcctgaggcgtcaattcctttaactgccctgtggggcaaggtgaacgtggatgaagttggtgcgtcaattcctttaaggccgtcaattcctttaccttggacccagaggtcgactcggaccgatg

SEQ ID NO: 14593 - DNA, 203 bp, Homo sapiens
ggcgcgccagtccttgtgaactagctgacacaactgtgttcactagcaaccgtcaattcctttaatggtgcatctgactcctgaggcgtcaattcctttaactgccctgtggggcaaggtgacgtcaattcctttaggtgcgtcaattcctttaaggccgtcaattcctttaccttggacccagaggtcgactcggaccgatg

SEQ ID NO: 14594 - DNA, 203 bp, Homo sapiens
ggcgcgccagtcctctgaactaggctgacacaactgtgttcactagcaaccgtcaattcctttaatggtgcatctgactcctgaggcgtcaattcctttaactgccctgtggggcaaggtgacgtcaattcctttaggtgcgtcaattcctttaaggctgctggtggtctacccttggacccagaggtcgactcggaccgatg

SEQ ID NO: 14595 - DNA, 203 bp, Homo sapiens
ggcgcgccagtcctacgctcaccactgacacaactgtgttcactagcaaccgtcaattcctttaatggtgcatctgactcctgaggcgtcaattcctttaactgcgtcaattcctttagtgaacgtggatgaagttggtgcgtcaattcctttaaggccgtcaattcctttaccttggacccagaggtcgactcggaccgatg

SEQ ID NO: 14596 - DNA, 203 bp, Homo sapiens
ggcgcgccagtcctatgggttaaactgacacaactgtgttcactagcaaccgtcaattcctttaatggtgcatctgactcctgaggcgtcaattcctttaactgcgtcaattcctttagtgaacgtggatgaagttggtgcgtcaattcctttaaggctgctggtggtctacccttggacccagaggtcgactcggaccgatg

SEQ ID NO: 14597 - DNA, 203 bp, Homo sapiens
ggcgcgccagtcctagttaaaggactgacacaactgtgttcactagcaaccgtcaattcctttaatggtgcatctgactcctgaggcgtcaattcctttaactgcgtcaattcctttagtgaacgtggatgaagttggtggtgaggccctgggcaggccgtcaattcctttaccttggacccagaggtcgactcggaccgatg

SEQ ID NO: 14598 - DNA, 203 bp, Homo sapiens
ggcgcgccagtcctacgtaactcgctgacacaactgtgttcactagcaaccgtcaattcctttaatggtgcatctgactcctgaggcgtcaattcctttaactgcgtcaattcctttagtgacgtcaattcctttaggtggtgaggccctgggcaggctgctggtggtctacccttggacccagaggtcgactcggaccgatg

SEQ ID NO: 14599 - DNA, 203 bp, Homo sapiens
ggcgcgccagtcctggtagtctcgctgacacaactgtgttcactagcaacctacgacggtatctgatcgtcttcgaacctccgactttcgttcttgattaatgaaaacattcttggcaaatgctttcgctctggtccgtcttgcgccggtccaagaatttcacctctagcggcgcaagacccagaggtcgactcggaccgatg

SEQ ID NO: 14600 - DNA, 203 bp, Homo sapiens
ggcgcgccagtcctttcaagctcgctgacacaactgtgttcactagcaacctacgacggtatctgatcgtcttcgaacctccgactttcgttcttgattaatgaaaacattcttggcaaatgctttcgctctggtccgtcttgcgccggtccaagaatttcacctctagcggcgcaggacccagaggtcgactcggaccgatg

SEQ ID NO: 14601 - DNA, 203 bp, Homo sapiens
ggcgcgccagtcctgaacttgtcgctgacacaactgtgttcactagcaacctcaaacaaccggccgtgtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14602 - DNA, 203 bp, Homo sapiens
ggcgcgccagtcctttgagtatcgctgacacaactgtgttcactagcaacctcaaacaaccggccgtgtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14603 - DNA, 203 bp, Homo sapiens
ggcgcgccagtcctcgaggttgtcctgacacaactgtgttcactagcaacctcaaacaagcgaccaaaggaaccataactgatttaatgagccattcgcagtttcactgtaccggccgtgcgtactcagacatgcatggcttaatctttgagacaagcatatgctactggacccttggacccagaggtcgactcggaccgatg

SEQ ID NO: 14604 - DNA, 203 bp, Homo sapiens
ggcgcgccagtcctcgacgagcctctgacacaactgtgttcactagcaacctcaaacacacggaatcgagaatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14605 - DNA, 203 bp, Homo sapiens
ggcgcgccagtcctgtagctgtcgctgacacaactgtgttcactagcaacctcaaacacactcctggtggtgcccttccgtcaattcctttaagtttcagctttgcaaccatactccccccggaacccaaagactttggtttcccggaagctgcccggcgggtcatgggaacccttggacccagaggtcgactcggaccgatg

SEQ ID NO: 14606 - DNA, 203 bp, Homo sapiens
ggcgcgccagtcctcgagctctcactgacacaactgtgttcactagcaacctcaaacacgtgttgagtcaaattaagccgcaggctccactcctggtggtgcccttccgtcaattcctttaagtttcagctttgcaaccatactccccccggaacccaaagactttggttacccttggacccagaggtcgactcggaccgatg

SEQ ID NO: 14607 - DNA, 203 bp, Homo sapiens
ggcgcgccagtcctcgagttttcgctgacacaactgtgttcactagcaacctcaaacagaaccggccgtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14608 - DNA, 203 bp, Homo sapiens
ggcgcgccagtcctcgactcttacctgacacaactgtgttcactagcaacctcaaacagacaaccaaaggaaccataactgatttaatgagccattcgcagtttcactgtaccggccgtgcgtactcagacatgcatggcttaatctttgagacaagcatatgctagtctacccttggacccagaggtcgactcggaccgatg

SEQ ID NO: 14609 - DNA, 203 bp, Homo sapiens
ggcgcgccagtcctcgacaacgttctgacacaactgtgttcactagcaacctcaaacagacacaccatactccccccggaacccaaagactttggtttcccggaagctgcccggcgggtcatgggaataacgccgccgcatcgccggtcggcatcgtttatggtcggtctacccttggacccagaggtcgactcggaccgatg

SEQ ID NO: 14610 - DNA, 203 bp, Homo sapiens
ggcgcgccagtcctgagcctctcgctgacacaactgtgttcactagcaacctcaaacagacacacggaatcgagaaactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14611 - DNA, 203 bp, Homo sapiens
ggcgcgccagtcctcgaatcctggctgacacaactgtgttcactagcaacctcaaacagacaccaatcgtcttcgaacctccgactttcgttcttgattaatgaaaacattcttggcaaatgctttcgctctggtccgtcttgcgccggtccaagaatttcacgtggtctacccttggacccagaggtcgactcggaccgatg

SEQ ID NO: 14612 - DNA, 203 bp, Homo sapiens
ggcgcgccagtccttcgctcgtcgctgacacaactgtgttcactagcaacctcaaacagacaccacacggaatcgagaacctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14613 - DNA, 203 bp, Homo sapiens
ggcgcgccagtcctcgatcggtcactgacacaactgtgttcactagcaacctcaaacagacaccacatactccccccggaacccaaagactttggtttcccggaagctgcccggcgggtcatgggaataacgccgccgcatcgccggtcggcatcgtttatgggtggtctacccttggacccagaggtcgactcggaccgatg

SEQ ID NO: 14614 - DNA, 203 bp, Homo sapiens
ggcgcgccagtcctcgaagcttagctgacacaactgtgttcactagcaacctcaaacagacaccaccggcgggttgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14615 - DNA, 203 bp, Homo sapiens
ggcgcgccagtcctcgacttgtatctgacacaactgtgttcactagcaacctcaaacagacaccaggtggtgcccttccgtcaattcctttaagtttcagctttgcaaccatactccccccggaacccaaagactttggtttcccggaagctgcccggcgggtgtggtctacccttggacccagaggtcgactcggaccgatg

SEQ ID NO: 14616 - DNA, 203 bp, Homo sapiens
ggcgcgccagtcctcgacgaactactgacacaactgtgttcactagcaacctcaaacagacaccatgaccggccgtactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14617 - DNA, 203 bp, Homo sapiens
ggcgcgccagtcctggcaacttcgctgacacaactgtgttcactagcaacctcaaacagacaccatgaggaaccataactgatttaatgagccattcgcagtttcactgtaccggccgtgcgtactcagacatgcatggcttaatctttgagacaagcatatggtggtctacccttggacccagaggtcgactcggaccgatg

SEQ ID NO: 14618 - DNA, 203 bp, Homo sapiens
ggcgcgccagtcctcgactggacactgacacaactgtgttcactagcaacctcaaacagacaccatgcgtcaattcctttatgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14619 - DNA, 203 bp, Homo sapiens
ggcgcgccagtcctcgacttcattctgacacaactgtgttcactagcaacctcaaacagacaccatggaccggccgtctcctgaggaccggccgtccgttactgaccggccgtgcaaggtgaaccggccgtaagttggtgaccggccgttgggcaggcaccggccgttctacccttggacccagaggtcgactcggaccgatg

SEQ ID NO: 14620 - DNA, 203 bp, Homo sapiens
ggcgcgccagtcctccactttcttctgacacaactgtgttcactagcaacctcaaacagacaccatggaccggccgtctcctgaggaccggccgtccgttactgaccggccgtgcaaggtgaaccggccgtaagttggtggtgaggccctgggcaggctgctggtggtctacccttaccggccgtggtcgactcggaccgatg

SEQ ID NO: 14621 - DNA, 203 bp, Homo sapiens
ggcgcgccagtcctaaatcacagcctgacacaactgtgttcactagcaacctcaaacagacaccatggaccggccgtctcctgaggaccggccgtccgttactgaccggccgtgcaaggtgaacgtggatgaagttggtgaccggccgttgggcaggcaccggccgttctacccttaccggccgtggtcgactcggaccgatg

SEQ ID NO: 14622 - DNA, 203 bp, Homo sapiens
ggcgcgccagtcctcagcaaatgactgacacaactgtgttcactagcaacctcaaacagacaccatggaccggccgtctcctgaggaccggccgtccgttactgaccggccgtgcaaggtgaacgtggatgaagttggtgaccggccgttgggcaggcaccggccgttctacccttggacccagaggtcgactcggaccgatg

SEQ ID NO: 14623 - DNA, 203 bp, Homo sapiens
ggcgcgccagtcctagcaaaatgcctgacacaactgtgttcactagcaacctcaaacagacaccatggaccggccgtctcctgaggaccggccgtccgttactgaccggccgtgcaaggtgaacgtggatgaagttggtggtgaggccctgggcaggcaccggccgttctacccttggacccagaggtcgactcggaccgatg

SEQ ID NO: 14624 - DNA, 203 bp, Homo sapiens
ggcgcgccagtcctacagaaatcactgacacaactgtgttcactagcaacctcaaacagacaccatggaccggccgtctcctgaggaccggccgtccgttactgccctgtggggcaaggtgaaccggccgtaagttggtgaccggccgttgggcaggcaccggccgttctacccttaccggccgtggtcgactcggaccgatg

SEQ ID NO: 14625 - DNA, 203 bp, Homo sapiens
ggcgcgccagtcctatgaaaatcgctgacacaactgtgttcactagcaacctcaaacagacaccatggaccggccgtctcctgaggaccggccgtccgttactgccctgtggggcaaggtgaaccggccgtaagttggtggtgaggccctgggcaggctgctggtggtctacccttggacccagaggtcgactcggaccgatg

SEQ ID NO: 14626 - DNA, 203 bp, Homo sapiens
ggcgcgccagtccttctcacaaatctgacacaactgtgttcactagcaacctcaaacagacaccatggaccggccgtctcctgaggaccggccgtccgttactgccctgtggggcaaggtgaacgtggatgaagttggtggtgaggccctgggcaggcaccggccgttctacccttaccggccgtggtcgactcggaccgatg

SEQ ID NO: 14627 - DNA, 203 bp, Homo sapiens
ggcgcgccagtcctaaatcgattcctgacacaactgtgttcactagcaacctcaaacagacaccatggaccggccgtctcctgaggagaagtctgccgttactgaccggccgtgcaaggtgaaccggccgtaagttggtgaccggccgttgggcaggctgctggtggtctacccttaccggccgtggtcgactcggaccgatg

SEQ ID NO: 14628 - DNA, 203 bp, Homo sapiens
ggcgcgccagtcctcaacaaatcgctgacacaactgtgttcactagcaacctcaaacagacaccatggaccggccgtctcctgaggagaagtctgccgttactgaccggccgtgcaaggtgaaccggccgtaagttggtgaccggccgttgggcaggctgctggtggtctacccttggacccagaggtcgactcggaccgatg

SEQ ID NO: 14629 - DNA, 203 bp, Homo sapiens
ggcgcgccagtcctctcaaatggtctgacacaactgtgttcactagcaacctcaaacagacaccatggaccggccgtctcctgaggagaagtctgccgttactgaccggccgtgcaaggtgaacgtggatgaagttggtgaccggccgttgggcaggcaccggccgttctacccttaccggccgtggtcgactcggaccgatg

SEQ ID NO: 14630 - DNA, 203 bp, Homo sapiens
ggcgcgccagtcctagctcattttctgacacaactgtgttcactagcaacctcaaacagacaccatggaccggccgtctcctgaggagaagtctgccgttactgaccggccgtgcaaggtgaacgtggatgaagttggtgaccggccgttgggcaggctgctggtggtctacccttaccggccgtggtcgactcggaccgatg

SEQ ID NO: 14631 - DNA, 203 bp, Homo sapiens
ggcgcgccagtcctcctcagatttctgacacaactgtgttcactagcaacctcaaacagacaccatggaccggccgtctcctgaggagaagtctgccgttactgaccggccgtgcaaggtgaacgtggatgaagttggtggtgaggccctgggcaggcaccggccgttctacccttaccggccgtggtcgactcggaccgatg

SEQ ID NO: 14632 - DNA, 203 bp, Homo sapiens
ggcgcgccagtccttacttgatttctgacacaactgtgttcactagcaacctcaaacagacaccatggaccggccgtctcctgaggagaagtctgccgttactgccctgtggggcaaggtgaaccggccgtaagttggtgaccggccgttgggcaggctgctggtggtctacccttggacccagaggtcgactcggaccgatg

SEQ ID NO: 14633 - DNA, 203 bp, Homo sapiens
ggcgcgccagtcctaacatttgaactgacacaactgtgttcactagcaacctcaaacagacaccatggaccggccgtctcctgaggagaagtctgccgttactgccctgtggggcaaggtgaaccggccgtaagttggtggtgaggccctgggcaggcaccggccgttctacccttaccggccgtggtcgactcggaccgatg

SEQ ID NO: 14634 - DNA, 203 bp, Homo sapiens
ggcgcgccagtcctcatttctttgctgacacaactgtgttcactagcaacctcaaacagacaccatggaccggccgtctcctgaggagaagtctgccgttactgccctgtggggcaaggtgaacgtggatgaagttggtgaccggccgttgggcaggctgctggtggtctacccttggacccagaggtcgactcggaccgatg

SEQ ID NO: 14635 - DNA, 203 bp, Homo sapiens
ggcgcgccagtcctgtgatttcacctgacacaactgtgttcactagcaacctcaaacagacaccatggaccggccgtctcctgaggagaagtctgccgttactgccctgtggggcaaggtgaacgtggatgaagttggtggtgaggccctgggcaggcaccggccgttctacccttggacccagaggtcgactcggaccgatg

SEQ ID NO: 14636 - DNA, 203 bp, Homo sapiens
ggcgcgccagtcctcatttcacttctgacacaactgtgttcactagcaacctcaaacagacaccatggaccggccgtctcctgaggagaagtctgccgttactgccctgtggggcaaggtgaacgtggatgaagttggtggtgaggccctgggcaggctgctggtggtctacccttaccggccgtggtcgactcggaccgatg

SEQ ID NO: 14637 - DNA, 203 bp, Homo sapiens
ggcgcgccagtccttgcaacatttctgacacaactgtgttcactagcaacctcaaacagacaccatggcacggaatcgagaagaggagaagtctgccgttactgcacggaatcgagaagtgaacgtggatgaagttggtgcacggaatcgagaaaggctgctggtggtctacccttggacccagaggtcgactcggaccgatg

SEQ ID NO: 14638 - DNA, 203 bp, Homo sapiens
ggcgcgccagtcctagattttcgtctgacacaactgtgttcactagcaacctcaaacagacaccatggcacggaatcgagaagaggagaagtctgccgttactgcacggaatcgagaagtgaacgtggatgaagttggtggtgaggccctgggcaggccacggaatcgagaaccttggacccagaggtcgactcggaccgatg

SEQ ID NO: 14639 - DNA, 203 bp, Homo sapiens
ggcgcgccagtcctccaagatttcctgacacaactgtgttcactagcaacctcaaacagacaccatggcacggaatcgagaagaggagaagtctgccgttactgcacggaatcgagaagtgacacggaatcgagaaggtggtgaggccctgggcaggctgctggtggtctacccttggacccagaggtcgactcggaccgatg

SEQ ID NO: 14640 - DNA, 203 bp, Homo sapiens
ggcgcgccagtcctcgacctacaactgacacaactgtgttcactagcaacctcaaacagacaccatggcacggaatcgagaagaggagaagtctgccgttactgccctgtggggcaaggtgacacggaatcgagaaggtgcacggaatcgagaaaggctgctggtggtctacccttggacccagaggtcgactcggaccgatg

SEQ ID NO: 14641 - DNA, 203 bp, Homo sapiens
ggcgcgccagtcctccaaccagtgctgacacaactgtgttcactagcaacctcaaacagacaccatggcacggaatcgagaagaggagaagtctgccgttactgccctgtggggcaaggtgacacggaatcgagaaggtggtgaggccctgggcaggctgctggtggtctacccttggacccagaggtcgactcggaccgatg

SEQ ID NO: 14642 - DNA, 203 bp, Homo sapiens
ggcgcgccagtcctggctacatggctgacacaactgtgttcactagcaacctcaaacagacaccatggcacggaatcgagaagaggcacggaatcgagaaactgcacggaatcgagaagtgacacggaatcgagaaggtgcacggaatcgagaaaggctgctggtggtctacccttggacccagaggtcgactcggaccgatg

SEQ ID NO: 14643 - DNA, 203 bp, Homo sapiens
ggcgcgccagtcctactacatgagctgacacaactgtgttcactagcaacctcaaacagacaccatggcacggaatcgagaagaggcacggaatcgagaaactgcacggaatcgagaagtgacacggaatcgagaaggtggtgaggccctgggcaggctgctggtggtctacccttggacccagaggtcgactcggaccgatg

SEQ ID NO: 14644 - DNA, 203 bp, Homo sapiens
ggcgcgccagtccttggtatgcgactgacacaactgtgttcactagcaacctcaaacagacaccatggcacggaatcgagaagaggcacggaatcgagaaactgccctgtggggcaaggtgaacgtggatgaagttggtggtgaggccctgggcaggctgctggtggtctacccttggacccagaggtcgactcggaccgatg

SEQ ID NO: 14645 - DNA, 203 bp, Homo sapiens
ggcgcgccagtcctacgagcagcactgacacaactgtgttcactagcaacctcaaacagacaccatggccggcgggtctcctgaggagaagtctgccgttactgccctgtggggcaaggtgaacgtggatgaagttggtgccggcgggttgggcaggctgctggtggtctacccttggacccagaggtcgactcggaccgatg

SEQ ID NO: 14646 - DNA, 203 bp, Homo sapiens
ggcgcgccagtcctgtgcagcatactgacacaactgtgttcactagcaacctcaaacagacaccatggccggcgggtctcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14647 - DNA, 203 bp, Homo sapiens
ggcgcgccagtccttcttcgttggctgacacaactgtgttcactagcaacctcaaacagacaccatggccggcgggtctcctgaggagaagtctgccgttactgccctgtggggcaaggtgaccggcgggtaagttggtggtgaggccctgggcaggcccggcgggttctacccttccggcgggtggtcgactcggaccgatg

SEQ ID NO: 14648 - DNA, 203 bp, Homo sapiens
ggcgcgccagtcctatccaacagtctgacacaactgtgttcactagcaacctcaaacagacaccatggccggcgggtctcctgaggagaagtctgccgttactgccctgtggggcaaggtgaccggcgggtaagttggtggtgaggccctgggcaggcccggcgggttctacccttggacccagaggtcgactcggaccgatg

SEQ ID NO: 14649 - DNA, 203 bp, Homo sapiens
ggcgcgccagtcctcacacttaacctgacacaactgtgttcactagcaacctcaaacagacaccatggccggcgggtctcctgaggagaagtctgccgttactgccctgtggggcaaggtgaccggcgggtaagttggtggtgaggccctgggcaggctgctggtggtctacccttccggcgggtggtcgactcggaccgatg

SEQ ID NO: 14650 - DNA, 203 bp, Homo sapiens
ggcgcgccagtcctttaggcctcgctgacacaactgtgttcactagcaacctcaaacagacaccatggccggcgggtctcctgaggagaagtctgccgttactgccggcgggtgcaaggtgaacgtggatgaagttggtgccggcgggttgggcaggcccggcgggttctacccttccggcgggtggtcgactcggaccgatg

SEQ ID NO: 14651 - DNA, 203 bp, Homo sapiens
ggcgcgccagtcctgttaggcctcctgacacaactgtgttcactagcaacctcaaacagacaccatggccggcgggtctcctgaggagaagtctgccgttactgccggcgggtgcaaggtgaacgtggatgaagttggtgccggcgggttgggcaggcccggcgggttctacccttggacccagaggtcgactcggaccgatg

SEQ ID NO: 14652 - DNA, 203 bp, Homo sapiens
ggcgcgccagtcctggcctagtggctgacacaactgtgttcactagcaacctcaaacagacaccatggccggcgggtctcctgaggagaagtctgccgttactgccggcgggtgcaaggtgaacgtggatgaagttggtgccggcgggttgggcaggctgctggtggtctacccttggacccagaggtcgactcggaccgatg

SEQ ID NO: 14653 - DNA, 203 bp, Homo sapiens
ggcgcgccagtcctttaagcacttctgacacaactgtgttcactagcaacctcaaacagacaccatggccggcgggtctcctgaggagaagtctgccgttactgccggcgggtgcaaggtgaacgtggatgaagttggtggtgaggccctgggcaggctgctggtggtctacccttccggcgggtggtcgactcggaccgatg

SEQ ID NO: 14654 - DNA, 203 bp, Homo sapiens
ggcgcgccagtccttgtgcttgtactgacacaactgtgttcactagcaacctcaaacagacaccatggccggcgggtctcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 14655 - DNA, 203 bp, Homo sapiens
ggcgcgccagtcctatgtgcttacctgacacaactgtgttcactagcaacctcaaacagacaccatggccggcgggtctcctgaggagaagtctgccgttactgccggcgggtgcaaggtgaccggcgggtaagttggtgccggcgggttgggcaggctgctggtggtctacccttggacccagaggtcgactcggaccgatg

SEQ ID NO: 14656 - DNA, 203 bp, Homo sapiens
ggcgcgccagtcctgtgcttgtaactgacacaactgtgttcactagcaacctcaaacagacaccatggccggcgggtctcctgaggagaagtctgccgttactgccggcgggtgcaaggtgaccggcgggtaagttggtggtgaggccctgggcaggcccggcgggttctacccttccggcgggtggtcgactcggaccgatg

SEQ ID NO: 14657 - DNA, 203 bp, Homo sapiens
ggcgcgccagtcctagtgcttttcctgacacaactgtgttcactagcaacctcaaacagacaccatggccggcgggtctcctgaggccggcgggtccgttactgccctgtggggcaaggtgaacgtggatgaagttggtgccggcgggttgggcaggcccggcgggttctacccttccggcgggtggtcgactcggaccgatg

SEQ ID NO: 14658 - DNA, 203 bp, Homo sapiens
ggcgcgccagtcctgtaagcaccactgacacaactgtgttcactagcaacctcaaacagacaccatggccggcgggtctcctgaggccggcgggtccgttactgccctgtggggcaaggtgaacgtggatgaagttggtgccggcgggttgggcaggcccggcgggttctacccttggacccagaggtcgactcggaccgatg

SEQ ID NO: 14659 - DNA, 203 bp, Homo sapiens
ggcgcgccagtccttaggttagttctgacacaactgtgttcactagcaacctcaaacagacaccatggccggcgggtctcctgaggccggcgggtccgttactgccctgtggggcaaggtgaccggcgggtaagttggtgccggcgggttgggcaggctgctggtggtctacccttccggcgggtggtcgactcggaccgatg

SEQ ID NO: 14660 - DNA, 203 bp, Homo sapiens
ggcgcgccagtcctatactgaggactgacacaactgtgttcactagcaacctcaaacagacaccatggccggcgggtctcctgaggccggcgggtccgttactgccctgtggggcaaggtgaccggcgggtaagttggtgccggcgggttgggcaggctgctggtggtctacccttggacccagaggtcgactcggaccgatg

SEQ ID NO: 14661 - DNA, 203 bp, Homo sapiens
ggcgcgccagtcctaatcacttagctgacacaactgtgttcactagcaacctcaaacagacaccatggccggcgggtctcctgaggccggcgggtccgttactgccggcgggtgcaaggtgaacgtggatgaagttggtgccggcgggttgggcaggcccggcgggttctacccttggacccagaggtcgactcggaccgatg

SEQ ID NO: 14662 - DNA, 203 bp, Homo sapiens
ggcgcgccagtcctcacgcctagcctgacacaactgtgttcactagcaacctcaaacagacaccatggccggcgggtctcctgaggccggcgggtccgttactgccggcgggtgcaaggtgaacgtggatgaagttggtggtgaggccctgggcaggctgctggtggtctacccttccggcgggtggtcgactcggaccgatg

SEQ ID NO: 14663 - DNA, 203 bp, Homo sapiens
ggcgcgccagtccttactgagcgactgacacaactgtgttcactagcaacctcaaacagacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14664 - DNA, 203 bp, Homo sapiens
ggcgcgccagtcctgatcaaccgtctgacacaactgtgttcactagcaacctcaaacagacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14665 - DNA, 203 bp, Homo sapiens
ggcgcgccagtccttctgcaacacctgacacaactgtgttcactagcaacctcaaacagacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14666 - DNA, 203 bp, Homo sapiens
ggcgcgccagtcctcctgtaaaccctgacacaactgtgttcactagcaacctcaaacagacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14667 - DNA, 203 bp, Homo sapiens
ggcgcgccagtcctcaagtgaaccctgacacaactgtgttcactagcaacctcaaacagacaccatggccggcgggtctcctgaggccggcgggtccgttactgccggcgggtgcaaggtgaccggcgggtaagttggtggtgaggccctgggcaggcccggcgggttctacccttccggcgggtggtcgactcggaccgatg

SEQ ID NO: 14668 - DNA, 203 bp, Homo sapiens
ggcgcgccagtcctggctaaccttctgacacaactgtgttcactagcaacctcaaacagacaccatggcgtcaattcctttagaggagaagtctgccgttactgccctgtggggcaaggtgaacgtggatgaagttggtgcgtcaattcctttaaggctgctggtggtctacccttggacccagaggtcgactcggaccgatg

SEQ ID NO: 14669 - DNA, 203 bp, Homo sapiens
ggcgcgccagtcctaagagtgtccctgacacaactgtgttcactagcaacctcaaacagacaccatggcgtcaattcctttagaggagaagtctgccgttactgcgtcaattcctttagtgaacgtggatgaagttggtgcgtcaattcctttaaggctgctggtggtctacccttggacccagaggtcgactcggaccgatg

SEQ ID NO: 14670 - DNA, 203 bp, Homo sapiens
ggcgcgccagtccttgaggtaaccctgacacaactgtgttcactagcaacctcaaacagacaccatggcgtcaattcctttagaggagaagtctgccgttactgcgtcaattcctttagtgacgtcaattcctttaggtgcgtcaattcctttaaggctgctggtggtctacccttggacccagaggtcgactcggaccgatg

SEQ ID NO: 14671 - DNA, 203 bp, Homo sapiens
ggcgcgccagtcctggcaacagatctgacacaactgtgttcactagcaacctcaaacagacaccatggcgtcaattcctttagaggagaagtctgccgttactgcgtcaattcctttagtgacgtcaattcctttaggtggtgaggccctgggcaggctgctggtggtctacccttggacccagaggtcgactcggaccgatg

SEQ ID NO: 14672 - DNA, 203 bp, Homo sapiens
ggcgcgccagtcctggtcaaagctctgacacaactgtgttcactagcaacctcaaacagacaccatggcgtcaattcctttagaggcgtcaattcctttaactgccctgtggggcaaggtgacgtcaattcctttaggtgcgtcaattcctttaaggccgtcaattcctttaccttggacccagaggtcgactcggaccgatg

SEQ ID NO: 14673 - DNA, 203 bp, Homo sapiens
ggcgcgccagtcctggttcttgacctgacacaactgtgttcactagcaacctcaaacagacaccatggcgtcaattcctttagaggcgtcaattcctttaactgccctgtggggcaaggtgacgtcaattcctttaggtggtgaggccctgggcaggccgtcaattcctttaccttggacccagaggtcgactcggaccgatg

SEQ ID NO: 14674 - DNA, 203 bp, Homo sapiens
ggcgcgccagtcctggtttgcagtctgacacaactgtgttcactagcaacctcaaacagacaccatggcgtcaattcctttagaggcgtcaattcctttaactgcgtcaattcctttagtgacgtcaattcctttaggtgcgtcaattcctttaaggccgtcaattcctttaccttggacccagaggtcgactcggaccgatg

SEQ ID NO: 14675 - DNA, 203 bp, Homo sapiens
ggcgcgccagtcctggttaaccagctgacacaactgtgttcactagcaacctcaaacagacaccatggggaaccataactgatttaatgagccattcgcagtttcactgtaccggccgtgcgtactcagacatgcatggcttaatctttgagacaagcatctggtggtctacccttggacccagaggtcgactcggaccgatg

SEQ ID NO: 14676 - DNA, 203 bp, Homo sapiens
ggcgcgccagtcctggctaaaggtctgacacaactgtgttcactagcaacctcaaacagacaccatggggtgcccttccgtcaattcctttaagtttcagctttgcaaccatactccccccggaacccaaagactttggtttcccggaagctgcccggcgctggtggtctacccttggacccagaggtcgactcggaccgatg

SEQ ID NO: 14677 - DNA, 203 bp, Homo sapiens
ggcgcgccagtcctggtttctgagctgacacaactgtgttcactagcaacctcaaacagacaccatggtaaattaagccgcaggctccactcctggtggtgcccttccgtcaattcctttaagtttcagctttgcaaccatactccccccggaacccaagctggtggtctacccttggacccagaggtcgactcggaccgatg

SEQ ID NO: 14678 - DNA, 203 bp, Homo sapiens
ggcgcgccagtcctggacaaactgctgacacaactgtgttcactagcaacctcaaacagacaccatggtactcccgactcctgaggagaagtctgccgttactgccctgtggggcaaggtgaacgtggatgaagttggtggtgaggccctgggcaggctactcccggtctaccctttactcccgaggtcgactcggaccgatg

SEQ ID NO: 14679 - DNA, 203 bp, Homo sapiens
ggcgcgccagtcctggactgtcttctgacacaactgtgttcactagcaacctcaaacagacaccatggtactcccgactcctgaggagaagtctgccgttactgccctgtggggcaaggtgaacgtggatgaagttggtgtactccccctgggcaggctactcccggtctacccttggacccagaggtcgactcggaccgatg

SEQ ID NO: 14680 - DNA, 203 bp, Homo sapiens
ggcgcgccagtcctagtcgataccctgacacaactgtgttcactagcaacctcaaacagacaccatggtactcccgactcctgaggagaagtctgccgttactgccctgtggggcaaggtgatactccctgaagttggtggtgaggccctgggcaggctgctggtggtctaccctttactcccgaggtcgactcggaccgatg

SEQ ID NO: 14681 - DNA, 203 bp, Homo sapiens
ggcgcgccagtcctgtagtcgatactgacacaactgtgttcactagcaacctcaaacagacaccatggtactcccgactcctgaggagaagtctgccgttactgccctgtggggcaaggtgatactccctgaagttggtgtactccccctgggcaggctgctggtggtctacccttggacccagaggtcgactcggaccgatg

SEQ ID NO: 14682 - DNA, 203 bp, Homo sapiens
ggcgcgccagtccttcgactgtcactgacacaactgtgttcactagcaacctcaaacagacaccatggtactcccgactcctgaggagaagtctgccgttactgtactcccgggcaaggtgaacgtggatgaagttggtggtgaggccctgggcaggctactcccggtctacccttggacccagaggtcgactcggaccgatg

SEQ ID NO: 14683 - DNA, 203 bp, Homo sapiens
ggcgcgccagtcctagcgttttgcctgacacaactgtgttcactagcaacctcaaacagacaccatggtactcccgactcctgaggagaagtctgccgttactgtactcccgggcaaggtgaacgtggatgaagttggtgtactccccctgggcaggctactcccggtctaccctttactcccgaggtcgactcggaccgatg

SEQ ID NO: 14684 - DNA, 203 bp, Homo sapiens
ggcgcgccagtcctaacagcgtttctgacacaactgtgttcactagcaacctcaaacagacaccatggtactcccgactcctgaggagaagtctgccgttactgtactcccgggcaaggtgaacgtggatgaagttggtgtactccccctgggcaggctgctggtggtctaccctttactcccgaggtcgactcggaccgatg

SEQ ID NO: 14685 - DNA, 203 bp, Homo sapiens
ggcgcgccagtcctaaacgctcgtctgacacaactgtgttcactagcaacctcaaacagacaccatggtactcccgactcctgaggagaagtctgccgttactgtactcccgggcaaggtgatactccctgaagttggtggtgaggccctgggcaggctgctggtggtctaccctttactcccgaggtcgactcggaccgatg

SEQ ID NO: 14686 - DNA, 203 bp, Homo sapiens
ggcgcgccagtcctgtgggtctacctgacacaactgtgttcactagcaacctcaaacagacaccatggtactcccgactcctgaggagaagtctgccgttactgtactcccgggcaaggtgatactccctgaagttggtgtactccccctgggcaggctactcccggtctacccttggacccagaggtcgactcggaccgatg

SEQ ID NO: 14687 - DNA, 203 bp, Homo sapiens
ggcgcgccagtcctggttgcaccactgacacaactgtgttcactagcaacctcaaacagacaccatggtactcccgactcctgaggtactccctgccgttactgccctgtggggcaaggtgaacgtggatgaagttggtggtgaggccctgggcaggctactcccggtctaccctttactcccgaggtcgactcggaccgatg

SEQ ID NO: 14688 - DNA, 203 bp, Homo sapiens
ggcgcgccagtcctgaggtacacactgacacaactgtgttcactagcaacctcaaacagacaccatggtactcccgactcctgaggtactccctgccgttactgccctgtggggcaaggtgaacgtggatgaagttggtgtactccccctgggcaggctgctggtggtctacccttggacccagaggtcgactcggaccgatg

SEQ ID NO: 14689 - DNA, 203 bp, Homo sapiens
ggcgcgccagtcctgctcaaaattctgacacaactgtgttcactagcaacctcaaacagacaccatggtactcccgactcctgaggtactccctgccgttactgccctgtggggcaaggtgatactccctgaagttggtggtgaggccctgggcaggctactcccggtctaccctttactcccgaggtcgactcggaccgatg

SEQ ID NO: 14690 - DNA, 203 bp, Homo sapiens
ggcgcgccagtcctccaccaaattctgacacaactgtgttcactagcaacctcaaacagacaccatggtactcccgactcctgaggtactccctgccgttactgccctgtggggcaaggtgatactccctgaagttggtggtgaggccctgggcaggctgctggtggtctaccctttactcccgaggtcgactcggaccgatg

SEQ ID NO: 14691 - DNA, 203 bp, Homo sapiens
ggcgcgccagtccttgtagaaattctgacacaactgtgttcactagcaacctcaaacagacaccatggtactcccgactcctgaggtactccctgccgttactgccctgtggggcaaggtgatactccctgaagttggtgtactccccctgggcaggctactcccggtctaccctttactcccgaggtcgactcggaccgatg

SEQ ID NO: 14692 - DNA, 203 bp, Homo sapiens
ggcgcgccagtccttagaacttgcctgacacaactgtgttcactagcaacctcaaacagacaccatggtactcccgactcctgaggtactccctgccgttactgtactcccgggcaaggtgatactccctgaagttggtgtactccccctgggcaggctgctggtggtctaccctttactcccgaggtcgactcggaccgatg

SEQ ID NO: 14693 - DNA, 203 bp, Homo sapiens
ggcgcgccagtcctctagaacttcctgacacaactgtgttcactagcaacctcaaacagacaccatggtatcgctccaccaactaagaacggccatgcaccaccacccacggaatcgagaaagagctatcaatctgtcaatcctgtccgtgtccgggccgctggtggtctacccttggacccagaggtcgactcggaccgatg

SEQ ID NO: 14694 - DNA, 203 bp, Homo sapiens
ggcgcgccagtcctaatctgacgtctgacacaactgtgttcactagcaacctcaaacagacaccatggtcacggaatcgagaaaggagaagtctgccgttactgccctgtggggcaaggtgaacgtggatgaagttggtggtgaggccctgggcaggctgctggtggtctacccttggacctactccccgactcggaccgatg

SEQ ID NO: 14695 - DNA, 203 bp, Homo sapiens
ggcgcgccagtccttgctcggtgactgacacaactgtgttcactagcaacctcaaacagacaccatggtcgtcaattcctttaaggagaagtctgccgttactgccctgtggggcaaggtgaacgtggatgaagttggtggtgaggccctgggcaggctgctggtggtctacccttggacccagaggtcgactcggaccgatg

SEQ ID NO: 14696 - DNA, 203 bp, Homo sapiens
ggcgcgccagtcctgacaacattcctgacacaactgtgttcactagcaacctcaaacagacaccatggtgcacacggaatcgagaaagaagtctgccgttactgccctgtggggcaaggtgaacgtggatgaagttggtggtgaggccctgggcaggctgctggtggtctacccttgttcttggcaaacgactcggaccgatg

SEQ ID NO: 14697 - DNA, 203 bp, Homo sapiens
ggcgcgccagtcctgtgtaccatgctgacacaactgtgttcactagcaacctcaaacagacaccatggtgcacgtcaattcctttaagaagtctgccgttactgccctgtggggcaaggtgaacgtggatgaagttggtggtgaggccctgggcaggctgctggtggtctacccttgttcttggcaaacgactcggaccgatg

SEQ ID NO: 14698 - DNA, 203 bp, Homo sapiens
ggcgcgccagtcctgcacgatcgtctgacacaactgtgttcactagcaacctcaaacagacaccatggtgcatcaccggccgtaggagaagtctgccgttactgccctgtggggcaaggtgaacgtggatgaagttggtggtgaggccctgggcaggctgctggtggtctacccttggacccagaggtcgactcggaccgatg

SEQ ID NO: 14699 - DNA, 203 bp, Homo sapiens
ggcgcgccagtcctatcacgatacctgacacaactgtgttcactagcaacctcaaacagacaccatggtgcatcaccggccgtaggagaagtctgccgttactgccctgtggggcaaggtgaacgtggatgaagttggtggtgaggccctgggcaggctgctggtggtctacccttggacctactccccgactcggaccgatg

SEQ ID NO: 14700 - DNA, 203 bp, Homo sapiens
ggcgcgccagtcctgacgtcactactgacacaactgtgttcactagcaacctcaaacagacaccatggtgcatcataactgatttaatgagccattcgcagtttcactgtaccggccgtgcgtactcagacatgcatggcttaatctttgagacaggctgctggtggtctacccttggacccagaggtcgactcggaccgatg

SEQ ID NO: 14701 - DNA, 203 bp, Homo sapiens
ggcgcgccagtcctactctcgtgtctgacacaactgtgttcactagcaacctcaaacagacaccatggtgcatcccggcgggtaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14702 - DNA, 203 bp, Homo sapiens
ggcgcgccagtcctcaactcgtgactgacacaactgtgttcactagcaacctcaaacagacaccatggtgcatcccggcgggtaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14703 - DNA, 203 bp, Homo sapiens
ggcgcgccagtccttgagctcgtgctgacacaactgtgttcactagcaacctcaaacagacaccatggtgcatccgtcaattcctttaaagtctgccgttactgccctgtggggcaaggtgaacgtggatgaagttggtggtgaggccctgggcaggctgctggtggtctacccttggaaccggccgtcgactcggaccgatg

SEQ ID NO: 14704 - DNA, 203 bp, Homo sapiens
ggcgcgccagtcctcacgagctagctgacacaactgtgttcactagcaacctcaaacagacaccatggtgcatccgtcaattcctttaaagtctgccgttactgccctgtggggcaaggtgaacgtggatgaagttggtggtgaggccctgggcaggctgctggtggtctacccttggaccggcgggtcgactcggaccgatg

SEQ ID NO: 14705 - DNA, 203 bp, Homo sapiens
ggcgcgccagtccttaagcacgagctgacacaactgtgttcactagcaacctcaaacagacaccatggtgcatccttccgtcaattcctttaagtttcagctttgcaaccatactccccccggaacccaaagactttggtttcccggaagctgcaggctgctggtggtctacccttggacccagaggtcgactcggaccgatg

SEQ ID NO: 14706 - DNA, 203 bp, Homo sapiens
ggcgcgccagtcctcacgagtttcctgacacaactgtgttcactagcaacctcaaacagacaccatggtgcatccttccgtcaattcctttaagtttcagctttgcaaccatactccccccggaacccaaagactttggtttcccggaagctgccggctgctggtggtctacccttggacccagaggtcgactcggaccgatg

SEQ ID NO: 14707 - DNA, 203 bp, Homo sapiens
ggcgcgccagtccttcacgagtatctgacacaactgtgttcactagcaacctcaaacagacaccatggtgcatctaacctccgactttcgttcttgattaatgaaaacattcttggcaaatgctttcgctctggtccgtcttgcgccggtccacaggctgctggtggtctacccttggacccagaggtcgactcggaccgatg

SEQ ID NO: 14708 - DNA, 203 bp, Homo sapiens
ggcgcgccagtccttctgttgagcctgacacaactgtgttcactagcaacctcaaacagacaccatggtgcatctagccgcaggctccactcctggtggtgcccttccgtcaattcctttaagtttcagctttgcaaccatactccccccggacaggctgctggtggtctacccttggacccagaggtcgactcggaccgatg

SEQ ID NO: 14709 - DNA, 203 bp, Homo sapiens
ggcgcgccagtccttatgcacggtctgacacaactgtgttcactagcaacctcaaacagacaccatggtgcatctccaccaactaagaacggccatgcaccaccacccacggaatcgagaaagagctatcaatctgtcaatcctgtccgtgtccgggctgctggtggtctacccttggacccagaggtcgactcggaccgatg

SEQ ID NO: 14710 - DNA, 203 bp, Homo sapiens
ggcgcgccagtcctaaggctcggtctgacacaactgtgttcactagcaacctcaaacagacaccatggtgcatctgacccaactaagaacggccatgcaccaccacccacggaatcgagaaagagctatcaatctgtcaatcctgtccgtgggcaggctgctggtggtctacccttggacccagaggtcgactcggaccgatg

SEQ ID NO: 14711 - DNA, 203 bp, Homo sapiens
ggcgcgccagtcctacggtctaaactgacacaactgtgttcactagcaacctcaaacagacaccatggtgcatctgaccggcgggtagaagtctgccgttactgccctgtggggcaaggtgaacgtggatgaagttggtggtgaggccctgggcaggctgctggtggtctacccttgttcttggcaaacgactcggaccgatg

SEQ ID NO: 14712 - DNA, 203 bp, Homo sapiens
ggcgcgccagtcctctttagagtactgacacaactgtgttcactagcaacctcaaacagacaccatggtgcatctgacctccgactttcgttcttgattaatgaaaacattcttggcaaatgctttcgctctggtccgtcttgcgccggtcggcaggctgctggtggtctacccttggacccagaggtcgactcggaccgatg

SEQ ID NO: 14713 - DNA, 203 bp, Homo sapiens
ggcgcgccagtcctagtctaaaggctgacacaactgtgttcactagcaacctcaaacagacaccatggtgcatctgacctgatttaatgagccattcgcagtttcactgtaccggccgtgcgtactcagacatgcatggcttaatctttggggcaggctgctggtggtctacccttggacccagaggtcgactcggaccgatg

SEQ ID NO: 14714 - DNA, 203 bp, Homo sapiens
ggcgcgccagtcctataccatgttctgacacaactgtgttcactagcaacctcaaacagacaccatggtgcatctgactaacccaaagactttggtttcccggaagctgcccggcgggtcatgggaataacgccgccgcatcgccggtctgggcaggctgctggtggtctacccttggacccagaggtcgactcggaccgatg

SEQ ID NO: 14715 - DNA, 203 bp, Homo sapiens
ggcgcgccagtccttccagaaacgctgacacaactgtgttcactagcaacctcaaacagacaccatggtgcatctgactaccggccgtaagtctgccgttactgccctgtggggcaaggtgaacgtggatgaagttggtggtgaggccctgggcaggctgctggtggtctacccttggaaccggccgtcgactcggaccgatg

SEQ ID NO: 14716 - DNA, 203 bp, Homo sapiens
ggcgcgccagtcctccagtgcacgctgacacaactgtgttcactagcaacctcaaacagacaccatggtgcatctgactccaccggccgtgtctgccgttactgccctgtggggcaaggtgaacgtggatgaagttggtggtgaggccctgggcaggctgctggtggtctaccccgtcaattcctttacgactcggaccgatg

SEQ ID NO: 14717 - DNA, 203 bp, Homo sapiens
ggcgcgccagtcctctcagagacgctgacacaactgtgttcactagcaacctcaaacagacaccatggtgcatctgactccaccggccgtgtctgccgttactgccctgtggggcaaggtgaacgtggatgaagttggtggtgaggccctgggcaggctgctggtggtctacccttggacctactccccgactcggaccgatg

SEQ ID NO: 14718 - DNA, 203 bp, Homo sapiens
ggcgcgccagtcctcgttagtttactgacacaactgtgttcactagcaacctcaaacagacaccatggtgcatctgactccatttaatgagccattcgcagtttcactgtaccggccgtgcgtactcagacatgcatggcttaatctcctgggcaggctgctggtggtctacccttggacccagaggtcgactcggaccgatg

SEQ ID NO: 14719 - DNA, 203 bp, Homo sapiens
ggcgcgccagtcctcgtcgtctacctgacacaactgtgttcactagcaacctcaaacagacaccatggtgcatctgactcccacggaatcgagaaccgttactgccctgtggggcaaggtgaacgtggatgaagttggtggtgaggccctgggcaggctgctggtggtctacccttggaaccggccgtcgactcggaccgatg

SEQ ID NO: 14720 - DNA, 203 bp, Homo sapiens
ggcgcgccagtcctcgacaagacgctgacacaactgtgttcactagcaacctcaaacagacaccatggtgcatctgactcccacggaatcgagaaccgttactgccctgtggggcaaggtgaacgtggatgaagttggtggtgaggccctgggcaggctgctggtggtctacccttggaccggcgggtcgactcggaccgatg

SEQ ID NO: 14721 - DNA, 203 bp, Homo sapiens
ggcgcgccagtcctacgcctgacgctgacacaactgtgttcactagcaacctcaaacagacaccatggtgcatctgactcccccaaagactttggtttcccggaagctgcccggcgggtcatgggaataacgccgccgcatcgccggcctgggcaggctgctggtggtctacccttggacccagaggtcgactcggaccgatg

SEQ ID NO: 14722 - DNA, 203 bp, Homo sapiens
ggcgcgccagtcctaatcttaacgctgacacaactgtgttcactagcaacctcaaacagacaccatggtgcatctgactcccgactttcgttcttgattaatgaaaacattcttggcaaatgctttcgctctggtccgtcttgcgcccctgggcaggctgctggtggtctacccttggacccagaggtcgactcggaccgatg

SEQ ID NO: 14723 - DNA, 203 bp, Homo sapiens
ggcgcgccagtcctgagctttacgctgacacaactgtgttcactagcaacctcaaacagacaccatggtgcatctgactcctactcccaagtctgccgttactgccctgtggggcaaggtgaacgtggatgaagttggtggtgaggccctgggcaggctgctggtggtctacccttggaccggcgggtcgactcggaccgatg

SEQ ID NO: 14724 - DNA, 203 bp, Homo sapiens
ggcgcgccagtcctcgtgctcacgctgacacaactgtgttcactagcaacctcaaacagacaccatggtgcatctgactcctgaccggcgggttgccgttactgccctgtggggcaaggtgaacgtggatgaagttggtggtgaggccctgggcaggctgctggtggtctacccttgttcttggcaaacgactcggaccgatg

SEQ ID NO: 14725 - DNA, 203 bp, Homo sapiens
ggcgcgccagtcctcgtcagcacgctgacacaactgtgttcactagcaacctcaaacagacaccatggtgcatctgactcctgactccactcctggtggtgcccttccgtcaattcctttaagtttcagctttgcaaccatactggccctgggcaggctgctggtggtctacccttggacccagaggtcgactcggaccgatg

SEQ ID NO: 14726 - DNA, 203 bp, Homo sapiens
ggcgcgccagtcctgaatcagacgctgacacaactgtgttcactagcaacctcaaacagacaccatggtgcatctgactcctgagaatgagccattcgcagtttcactgtaccggccgtgcgtactcagacatgcatggcttaaggccctgggcaggctgctggtggtctacccttggacccagaggtcgactcggaccgatg

SEQ ID NO: 14727 - DNA, 203 bp, Homo sapiens
ggcgcgccagtcctcactctaacgctgacacaactgtgttcactagcaacctcaaacagacaccatggtgcatctgactcctgagagaacggccatgcaccaccacccacggaatcgagaaagagctatcaatctgtcaatccaggccctgggcaggctgctggtggtctacccttggacccagaggtcgactcggaccgatg

SEQ ID NO: 14728 - DNA, 203 bp, Homo sapiens
ggcgcgccagtcctcgtacacattctgacacaactgtgttcactagcaacctcaaacagacaccatggtgcatctgactcctgaggaaacggccatgcaccaccacccacggaatcgagaaagagctatcaatctgtcaattgaggccctgggcaggctgctggtggtctacccttggacccagaggtcgactcggaccgatg

SEQ ID NO: 14729 - DNA, 203 bp, Homo sapiens
ggcgcgccagtcctgttgtgaacgctgacacaactgtgttcactagcaacctcaaacagacaccatggtgcatctgactcctgaggaacggaatcgagaaactgaacggaatcgagaagtgaaacggaatcgagaaggtgaacggaatcgagaaaggcaacggaatcgagaaccttggacccagaggtcgactcggaccgatg

SEQ ID NO: 14730 - DNA, 203 bp, Homo sapiens
ggcgcgccagtcctcgtcttctggctgacacaactgtgttcactagcaacctcaaacagacaccatggtgcatctgactcctgaggaactccctgccgttactgaactcccgggcaaggtgaaactccctgaagttggtgaactccccctgggcaggcaactcccggtctacccttggacccagaggtcgactcggaccgatg

SEQ ID NO: 14731 - DNA, 203 bp, Homo sapiens
ggcgcgccagtcctcgtcaccttcctgacacaactgtgttcactagcaacctcaaacagacaccatggtgcatctgactcctgaggaccgagcgtccgttactgaccgagcgtgcaaggtgaaccgagcgtaagttggtgaccgagcgttgggcaggcaccgagcgttctacccttggacccagaggtcgactcggaccgatg

SEQ ID NO: 14732 - DNA, 203 bp, Homo sapiens
ggcgcgccagtcctggttagtacgctgacacaactgtgttcactagcaacctcaaacagacaccatggtgcatctgactcctgaggaccgatcgtccgttactgaccgatcgtgcaaggtgaaccgatcgtaagttggtgaccgatcgttgggcaggcaccgatcgttctacccttggacccagaggtcgactcggaccgatg

SEQ ID NO: 14733 - DNA, 203 bp, Homo sapiens
ggcgcgccagtcctcgttaactcgctgacacaactgtgttcactagcaacctcaaacagacaccatggtgcatctgactcctgaggaccgcacgtccgttactgaccgcacgtgcaaggtgaaccgcacgtaagttggtgaccgcacgttgggcaggcaccgcacgttctacccttggacccagaggtcgactcggaccgatg

SEQ ID NO: 14734 - DNA, 203 bp, Homo sapiens
ggcgcgccagtccttacccaaacgctgacacaactgtgttcactagcaacctcaaacagacaccatggtgcatctgactcctgaggaccgcccgtccgttactgaccgcccgtgcaaggtgaaccgcccgtaagttggtgaccgcccgttgggcaggcaccgcccgttctacccttggacccagaggtcgactcggaccgatg

SEQ ID NO: 14735 - DNA, 203 bp, Homo sapiens
ggcgcgccagtcctcgtttgaacactgacacaactgtgttcactagcaacctcaaacagacaccatggtgcatctgactcctgaggaccgctcgtccgttactgaccgctcgtgcaaggtgaaccgctcgtaagttggtgaccgctcgttgggcaggcaccgctcgttctacccttggacccagaggtcgactcggaccgatg

SEQ ID NO: 14736 - DNA, 203 bp, Homo sapiens
ggcgcgccagtcctcgtagtcgagctgacacaactgtgttcactagcaacctcaaacagacaccatggtgcatctgactcctgaggaccggacgtccgttactgaccggacgtgcaaggtgaaccggacgtaagttggtgaccggacgttgggcaggcaccggacgttctacccttggacccagaggtcgactcggaccgatg

SEQ ID NO: 14737 - DNA, 203 bp, Homo sapiens
ggcgcgccagtccttggtagaaccctgacacaactgtgttcactagcaacctcaaacagacaccatggtgcatctgactcctgaggaccggccaaccgttactgaccggccaagcaaggtgaaccggccaaaagttggtgaccggccaatgggcaggcaccggccaatctacccttggacccagaggtcgactcggaccgatg

SEQ ID NO: 14738 - DNA, 203 bp, Homo sapiens
ggcgcgccagtcctgaatacagcgctgacacaactgtgttcactagcaacctcaaacagacaccatggtgcatctgactcctgaggaccggccacccgttactgaccggccacgcaaggtgaaccggccacaagttggtgaccggccactgggcaggcaccggccactctacccttggacccagaggtcgactcggaccgatg

SEQ ID NO: 14739 - DNA, 203 bp, Homo sapiens
ggcgcgccagtccttcttacagcgctgacacaactgtgttcactagcaacctcaaacagacaccatggtgcatctgactcctgaggaccggccagccgttactgaccggccaggcaaggtgaaccggccagaagttggtgaccggccagtgggcaggcaccggccagtctacccttggacccagaggtcgactcggaccgatg

SEQ ID NO: 14740 - DNA, 203 bp, Homo sapiens
ggcgcgccagtcctgcaccaagcgctgacacaactgtgttcactagcaacctcaaacagacaccatggtgcatctgactcctgaggaccggccatccgttactgaccggccatgcaaggtgaaccggccataagttggtgaccggccattgggcaggcaccggccattctacccttggacccagaggtcgactcggaccgatg

SEQ ID NO: 14741 - DNA, 203 bp, Homo sapiens
ggcgcgccagtccttgggtctgcgctgacacaactgtgttcactagcaacctcaaacagacaccatggtgcatctgactcctgaggaccggccccccgttactgaccggccccgcaaggtgaaccggccccaagttggtgaccggcccctgggcaggcaccggcccctctacccttggacccagaggtcgactcggaccgatg

SEQ ID NO: 14742 - DNA, 203 bp, Homo sapiens
ggcgcgccagtcctcctacaagcgctgacacaactgtgttcactagcaacctcaaacagacaccatggtgcatctgactcctgaggaccggccctccgttactgaccggccctgcaaggtgaaccggccctaagttggtgaccggcccttgggcaggcaccggcccttctacccttggacccagaggtcgactcggaccgatg

SEQ ID NO: 14743 - DNA, 203 bp, Homo sapiens
ggcgcgccagtcctctgtgaggcgctgacacaactgtgttcactagcaacctcaaacagacaccatggtgcatctgactcctgaggaccggccggccgttactgaccggccgggcaaggtgaaccggccggaagttggtgaccggccggtgggcaggcaccggccggtctacccttggacccagaggtcgactcggaccgatg

SEQ ID NO: 14744 - DNA, 203 bp, Homo sapiens
ggcgcgccagtcctacggtaagcgctgacacaactgtgttcactagcaacctcaaacagacaccatggtgcatctgactcctgaggaccggccgtccgttactgaccggccgtgcaaggtgaaccggccgtaagttggtgaccggccgttgggcaggcaccggccgttctacccttaccggccgtggtcgactcggaccgatg

SEQ ID NO: 14745 - DNA, 203 bp, Homo sapiens
ggcgcgccagtccttaaactagcgctgacacaactgtgttcactagcaacctcaaacagacaccatggtgcatctgactcctgaggaccggccgtccgttactgaccggccgtgcaaggtgaaccggccgtaagttggtggtgaggccctgggcaggcaccggccgttctacccttggacccagaggtcgactcggaccgatg

SEQ ID NO: 14746 - DNA, 203 bp, Homo sapiens
ggcgcgccagtcctactttaggcgctgacacaactgtgttcactagcaacctcaaacagacaccatggtgcatctgactcctgaggaccggccgtccgttactgaccggccgtgcaaggtgaacgtggatgaagttggtgaccggccgttgggcaggcaccggccgttctacccttaccggccgtggtcgactcggaccgatg

SEQ ID NO: 14747 - DNA, 203 bp, Homo sapiens
ggcgcgccagtcctcaacgttgcgctgacacaactgtgttcactagcaacctcaaacagacaccatggtgcatctgactcctgaggaccggccgtccgttactgaccggccgtgcaaggtgaacgtggatgaagttggtggtgaggccctgggcaggcaccggccgttctacccttaccggccgtggtcgactcggaccgatg

SEQ ID NO: 14748 - DNA, 203 bp, Homo sapiens
ggcgcgccagtcctgtatgctgcgctgacacaactgtgttcactagcaacctcaaacagacaccatggtgcatctgactcctgaggaccggccgtccgttactgaccggccgtgcaaggtgaacgtggatgaagttggtggtgaggccctgggcaggctgctggtggtctacccttggacccagaggtcgactcggaccgatg

SEQ ID NO: 14749 - DNA, 203 bp, Homo sapiens
ggcgcgccagtcctgcttgaagcgctgacacaactgtgttcactagcaacctcaaacagacaccatggtgcatctgactcctgaggaccggccgtccgttactgccctgtggggcaaggtgaaccggccgtaagttggtgaccggccgttgggcaggcaccggccgttctacccttaccggccgtggtcgactcggaccgatg

SEQ ID NO: 14750 - DNA, 203 bp, Homo sapiens
ggcgcgccagtccttggtctagcgctgacacaactgtgttcactagcaacctcaaacagacaccatggtgcatctgactcctgaggaccggccgtccgttactgccctgtggggcaaggtgaaccggccgtaagttggtgaccggccgttgggcaggcaccggccgttctacccttggacccagaggtcgactcggaccgatg

SEQ ID NO: 14751 - DNA, 203 bp, Homo sapiens
ggcgcgccagtcctcgcattcaggctgacacaactgtgttcactagcaacctcaaacagacaccatggtgcatctgactcctgaggaccggccgtccgttactgccctgtggggcaaggtgaaccggccgtaagttggtgaccggccgttgggcaggctgctggtggtctacccttaccggccgtggtcgactcggaccgatg

SEQ ID NO: 14752 - DNA, 203 bp, Homo sapiens
ggcgcgccagtcctcgctaggatcctgacacaactgtgttcactagcaacctcaaacagacaccatggtgcatctgactcctgaggaccggccgtccgttactgccctgtggggcaaggtgaacgtggatgaagttggtgaccggccgttgggcaggcaccggccgttctacccttggacccagaggtcgactcggaccgatg

SEQ ID NO: 14753 - DNA, 203 bp, Homo sapiens
ggcgcgccagtcctcgctgagtatctgacacaactgtgttcactagcaacctcaaacagacaccatggtgcatctgactcctgaggaccggccgtccgttactgccctgtggggcaaggtgaacgtggatgaagttggtgaccggccgttgggcaggctgctggtggtctacccttggacccagaggtcgactcggaccgatg

SEQ ID NO: 14754 - DNA, 203 bp, Homo sapiens
ggcgcgccagtcctcgcaaagtaactgacacaactgtgttcactagcaacctcaaacagacaccatggtgcatctgactcctgaggaccggccgtccgttactgccctgtggggcaaggtgaacgtggatgaagttggtggtgaggccctgggcaggcaccggccgttctacccttaccggccgtggtcgactcggaccgatg

SEQ ID NO: 14755 - DNA, 203 bp, Homo sapiens
ggcgcgccagtcctcgcaaagcctctgacacaactgtgttcactagcaacctcaaacagacaccatggtgcatctgactcctgaggaccggccgtccgttactgccctgtggggcaaggtgaacgtggatgaagttggtggtgaggccctgggcaggctgctggtggtctacccttggaccggcgggtcgactcggaccgatg

SEQ ID NO: 14756 - DNA, 203 bp, Homo sapiens
ggcgcgccagtcctcgcttcatttctgacacaactgtgttcactagcaacctcaaacagacaccatggtgcatctgactcctgaggaccggcctcccgttactgaccggcctcgcaaggtgaaccggcctcaagttggtgaccggcctctgggcaggcaccggcctctctacccttggacccagaggtcgactcggaccgatg

SEQ ID NO: 14757 - DNA, 203 bp, Homo sapiens
ggcgcgccagtcctcgctacacagctgacacaactgtgttcactagcaacctcaaacagacaccatggtgcatctgactcctgaggaccggcctgccgttactgaccggcctggcaaggtgaaccggcctgaagttggtgaccggcctgtgggcaggcaccggcctgtctacccttggacccagaggtcgactcggaccgatg

SEQ ID NO: 14758 - DNA, 203 bp, Homo sapiens
ggcgcgccagtcctcgctgaaaggctgacacaactgtgttcactagcaacctcaaacagacaccatggtgcatctgactcctgaggaccggcgatccgttactgaccggcgatgcaaggtgaaccggcgataagttggtgaccggcgattgggcaggcaccggcgattctacccttggacccagaggtcgactcggaccgatg

SEQ ID NO: 14759 - DNA, 203 bp, Homo sapiens
ggcgcgccagtcctcgcctagtccctgacacaactgtgttcactagcaacctcaaacagacaccatggtgcatctgactcctgaggaccggcgctccgttactgaccggcgctgcaaggtgaaccggcgctaagttggtgaccggcgcttgggcaggcaccggcgcttctacccttggacccagaggtcgactcggaccgatg

SEQ ID NO: 14760 - DNA, 203 bp, Homo sapiens
ggcgcgccagtcctcgcagtaagtctgacacaactgtgttcactagcaacctcaaacagacaccatggtgcatctgactcctgaggaccggctatccgttactgaccggctatgcaaggtgaaccggctataagttggtgaccggctattgggcaggcaccggctattctacccttggacccagaggtcgactcggaccgatg

SEQ ID NO: 14761 - DNA, 203 bp, Homo sapiens
ggcgcgccagtcctcgctttgagtctgacacaactgtgttcactagcaacctcaaacagacaccatggtgcatctgactcctgaggaccggctctccgttactgaccggctctgcaaggtgaaccggctctaagttggtgaccggctcttgggcaggcaccggctcttctacccttggacccagaggtcgactcggaccgatg

SEQ ID NO: 14762 - DNA, 203 bp, Homo sapiens
ggcgcgccagtcctcgcactgaatctgacacaactgtgttcactagcaacctcaaacagacaccatggtgcatctgactcctgaggaccggctgtccgttactgaccggctgtgcaaggtgaaccggctgtaagttggtgaccggctgttgggcaggcaccggctgttctacccttggacccagaggtcgactcggaccgatg

SEQ ID NO: 14763 - DNA, 203 bp, Homo sapiens
ggcgcgccagtcctcgctgacaaactgacacaactgtgttcactagcaacctcaaacagacaccatggtgcatctgactcctgaggaccggctttccgttactgaccggctttgcaaggtgaaccggctttaagttggtgaccggcttttgggcaggcaccggcttttctacccttggacccagaggtcgactcggaccgatg

SEQ ID NO: 14764 - DNA, 203 bp, Homo sapiens
ggcgcgccagtcctcgctaccgttctgacacaactgtgttcactagcaacctcaaacagacaccatggtgcatctgactcctgaggaccgtccgtccgttactgaccgtccgtgcaaggtgaaccgtccgtaagttggtgaccgtccgttgggcaggcaccgtccgttctacccttggacccagaggtcgactcggaccgatg

SEQ ID NO: 14765 - DNA, 203 bp, Homo sapiens
ggcgcgccagtcctgttagttcaactgacacaactgtgttcactagcaacctcaaacagacaccatggtgcatctgactcctgaggaccgttcgtccgttactgaccgttcgtgcaaggtgaaccgttcgtaagttggtgaccgttcgttgggcaggcaccgttcgttctacccttggacccagaggtcgactcggaccgatg

SEQ ID NO: 14766 - DNA, 203 bp, Homo sapiens
ggcgcgccagtccttaacgaggcactgacacaactgtgttcactagcaacctcaaacagacaccatggtgcatctgactcctgaggacctccctgccgttactgacctcccgggcaaggtgaacctccctgaagttggtgacctccccctgggcaggcacctcccggtctacccttggacccagaggtcgactcggaccgatg

SEQ ID NO: 14767 - DNA, 203 bp, Homo sapiens
ggcgcgccagtcctagcttcgttactgacacaactgtgttcactagcaacctcaaacagacaccatggtgcatctgactcctgaggaccttggcaaagttactgaccttggcaaaaaggtgaaccttggcaaagttggtgaccttggcaaaggcaggcaccttggcaaatacccttggacccagaggtcgactcggaccgatg

SEQ ID NO: 14768 - DNA, 203 bp, Homo sapiens
ggcgcgccagtccttcgttagttcctgacacaactgtgttcactagcaacctcaaacagacaccatggtgcatctgactcctgaggacggcgggtccgttactgacggcgggtgcaaggtgaacggcgggtaagttggtgacggcgggttgggcaggcacggcgggttctacccttggacccagaggtcgactcggaccgatg

SEQ ID NO: 14769 - DNA, 203 bp, Homo sapiens
ggcgcgccagtcctgtttaacgatctgacacaactgtgttcactagcaacctcaaacagacaccatggtgcatctgactcctgaggacgggccgtccgttactgacgggccgtgcaaggtgaacgggccgtaagttggtgacgggccgttgggcaggcacgggccgttctacccttggacccagaggtcgactcggaccgatg

SEQ ID NO: 14770 - DNA, 203 bp, Homo sapiens
ggcgcgccagtcctcttctcgttactgacacaactgtgttcactagcaacctcaaacagacaccatggtgcatctgactcctgaggactagccgtccgttactgactagccgtgcaaggtgaactagccgtaagttggtgactagccgttgggcaggcactagccgttctacccttggacccagaggtcgactcggaccgatg

SEQ ID NO: 14771 - DNA, 203 bp, Homo sapiens
ggcgcgccagtcctgttcgttacgctgacacaactgtgttcactagcaacctcaaacagacaccatggtgcatctgactcctgaggactcgccgtccgttactgactcgccgtgcaaggtgaactcgccgtaagttggtgactcgccgttgggcaggcactcgccgttctacccttggacccagaggtcgactcggaccgatg

SEQ ID NO: 14772 - DNA, 203 bp, Homo sapiens
ggcgcgccagtccttaacgagtggctgacacaactgtgttcactagcaacctcaaacagacaccatggtgcatctgactcctgaggactttaagtttcagctttgcaaccatactccccccggaacccaaagactttggtttgaggccctgggcaggctgctggtggtctacccttggacccagaggtcgactcggaccgatg

SEQ ID NO: 14773 - DNA, 203 bp, Homo sapiens
ggcgcgccagtcctaaatgcagaactgacacaactgtgttcactagcaacctcaaacagacaccatggtgcatctgactcctgaggagaacgtcaattcctttaccctgtggggcaaggtgaacgtggatgaagttggtggtgaggccctgggcaggctgctggtggtctaccccacggaatcgagaacgactcggaccgatg

SEQ ID NO: 14774 - DNA, 203 bp, Homo sapiens
ggcgcgccagtcctaatgcgtttgctgacacaactgtgttcactagcaacctcaaacagacaccatggtgcatctgactcctgaggagaacgtcaattcctttaccctgtggggcaaggtgaacgtggatgaagttggtggtgaggccctgggcaggctgctggtggtctaccccgtcaattcctttacgactcggaccgatg

SEQ ID NO: 14775 - DNA, 203 bp, Homo sapiens
ggcgcgccagtcctcgacctagtcctgacacaactgtgttcactagcaacctcaaacagacaccatggtgcatctgactcctgaggagaagaccggccgtactgccctgtggggcaaggtgaacgtggatgaagttggtggtgaggccctgggcaggctgctggtggtctacccttgttcttggcaaacgactcggaccgatg

SEQ ID NO: 14776 - DNA, 203 bp, Homo sapiens
ggcgcgccagtcctagacctagcactgacacaactgtgttcactagcaacctcaaacagacaccatggtgcatctgactcctgaggagaagccattcgcagtttcactgtaccggccgtgcgtactcagacatgcatggggtgaggccctgggcaggctgctggtggtctacccttggacccagaggtcgactcggaccgatg

SEQ ID NO: 14777 - DNA, 203 bp, Homo sapiens
ggcgcgccagtccttgattttcagctgacacaactgtgttcactagcaacctcaaacagacaccatggtgcatctgactcctgaggagaagcctggtggtgcccttccgtcaattcctttaagtttcagctttgcaagtggtgaggccctgggcaggctgctggtggtctacccttggacccagaggtcgactcggaccgatg

SEQ ID NO: 14778 - DNA, 203 bp, Homo sapiens
ggcgcgccagtccttatgattttcctgacacaactgtgttcactagcaacctcaaacagacaccatggtgcatctgactcctgaggagaaggccatgcaccaccacccacggaatcgagaaagagctatcaatctgtctggtgaggccctgggcaggctgctggtggtctacccttggacccagaggtcgactcggaccgatg

SEQ ID NO: 14779 - DNA, 203 bp, Homo sapiens
ggcgcgccagtcctcacgttaacactgacacaactgtgttcactagcaacctcaaacagacaccatggtgcatctgactcctgaggagaaggccatgcaccaccacccacggaatcgagaaagagctatcaatctgtgtggtgaggccctgggcaggctgctggtggtctacccttggacccagaggtcgactcggaccgatg

SEQ ID NO: 14780 - DNA, 203 bp, Homo sapiens
ggcgcgccagtcctcacgtttgccctgacacaactgtgttcactagcaacctcaaacagacaccatggtgcatctgactcctgaggagaagtcaccggccgttgccctgtggggcaaggtgaacgtggatgaagttggtggtgaggccctgggcaggctgctggtggtctacccttggaaccggccgtcgactcggaccgatg

SEQ ID NO: 14781 - DNA, 203 bp, Homo sapiens
ggcgcgccagtcctacaaatgccactgacacaactgtgttcactagcaacctcaaacagacaccatggtgcatctgactcctgaggagaagtcattcgcagtttcactgtaccggccgtgcgtactcagacatgcaggtggtgaggccctgggcaggctgctggtggtctacccttggacccagaggtcgactcggaccgatg

SEQ ID NO: 14782 - DNA, 203 bp, Homo sapiens
ggcgcgccagtcctaacatgcaagctgacacaactgtgttcactagcaacctcaaacagacaccatggtgcatctgactcctgaggagaagtccacggaatcgagaatgtggggcaaggtgaacgtggatgaagttggtggtgaggccctgggcaggctgctggtggtctacccttgttcttggcaaacgactcggaccgatg

SEQ ID NO: 14783 - DNA, 203 bp, Homo sapiens
ggcgcgccagtcctcgacatgcagctgacacaactgtgttcactagcaacctcaaacagacaccatggtgcatctgactcctgaggagaagtccatgcaccaccacccacggaatcgagaaagagctatcaatctgggtggtgaggccctgggcaggctgctggtggtctacccttggacccagaggtcgactcggaccgatg

SEQ ID NO: 14784 - DNA, 203 bp, Homo sapiens
ggcgcgccagtcctaacaccacgtctgacacaactgtgttcactagcaacctcaaacagacaccatggtgcatctgactcctgaggagaagtccgtcaattcctttatgtggggcaaggtgaacgtggatgaagttggtggtgaggccctgggcaggctgctggtggtctacccttgttcttggcaaacgactcggaccgatg

SEQ ID NO: 14785 - DNA, 203 bp, Homo sapiens
ggcgcgccagtcctttgcacgttcctgacacaactgtgttcactagcaacctcaaacagacaccatggtgcatctgactcctgaggagaagtctactcccactgccctgtggggcaaggtgaacgtggatgaagttggtggtgaggccctgggcaggctgctggtggtctacccttgttcttggcaaacgactcggaccgatg

SEQ ID NO: 14786 - DNA, 203 bp, Homo sapiens
ggcgcgccagtcctaacgtgcattctgacacaactgtgttcactagcaacctcaaacagacaccatggtgcatctgactcctgaggagaagtctgaccggccgtccctgtggggcaaggtgaacgtggatgaagttggtggtgaggccctgggcaggctgctggtggtctaccccacggaatcgagaacgactcggaccgatg

SEQ ID NO: 14787 - DNA, 203 bp, Homo sapiens
ggcgcgccagtccttgtctaacgcctgacacaactgtgttcactagcaacctcaaacagacaccatggtgcatctgactcctgaggagaagtctgcattaatgaaaacattcttggcaaatgctttcgctctagttggtggtgaggccctgggcaggctgctggtggtctacccttggacccagaggtcgactcggaccgatg

SEQ ID NO: 14788 - DNA, 203 bp, Homo sapiens
ggcgcgccagtcctacggttaaacctgacacaactgtgttcactagcaacctcaaacagacaccatggtgcatctgactcctgaggagaagtctgcccgtcaattcctttagggcaaggtgaacgtggatgaagttggtggtgaggccctgggcaggctgctggtggtctaccccacggaatcgagaacgactcggaccgatg

SEQ ID NO: 14789 - DNA, 203 bp, Homo sapiens
ggcgcgccagtcctcaggctttagctgacacaactgtgttcactagcaacctcaaacagacaccatggtgcatctgactcctgaggagaagtctgcccgtcaattcctttagggcaaggtgaacgtggatgaagttggtggtgaggccctgggcaggctgctggtggtctaccccgtcaattcctttacgactcggaccgatg

SEQ ID NO: 14790 - DNA, 203 bp, Homo sapiens
ggcgcgccagtcctacgtaaagccctgacacaactgtgttcactagcaacctcaaacagacaccatggtgcatctgactcctgaggagaagtctgcccgtcaattcctttagggcaaggtgaacgtggatgaagttggtggtgaggccctgggcaggctgctggtggtctacccttggacccagaggtcgactcggaccgatg

SEQ ID NO: 14791 - DNA, 203 bp, Homo sapiens
ggcgcgccagtcctaacgcagctgctgacacaactgtgttcactagcaacctcaaacagacaccatggtgcatctgactcctgaggagaagtctgcccgtcaattcctttagggcaaggtgaacgtggatgaagttggtggtgaggccctgggcaggctgctggtggtctacccttggacctactccccgactcggaccgatg

SEQ ID NO: 14792 - DNA, 203 bp, Homo sapiens
ggcgcgccagtcctcgtcctgcgtctgacacaactgtgttcactagcaacctcaaacagacaccatggtgcatctgactcctgaggagaagtctgccgaccaccacccacggaatcgagaaagagctatcgaagttggtggtgaggccctgggcaggctgctggtggtctacccttggacccagaggtcgactcggaccgatg

SEQ ID NO: 14793 - DNA, 203 bp, Homo sapiens
ggcgcgccagtccttgacatactcctgacacaactgtgttcactagcaacctcaaacagacaccatggtgcatctgactcctgaggagaagtctgccgagctttgcaaccatactccccccggaacccaagaagttggtggtgaggccctgggcaggctgctggtggtctacccttggacccagaggtcgactcggaccgatg

SEQ ID NO: 14794 - DNA, 203 bp, Homo sapiens
ggcgcgccagtccttagaggctagctgacacaactgtgttcactagcaacctcaaacagacaccatggtgcatctgactcctgaggagaagtctgccgcccggaagctgcccggcgggtcatgggaataagaagttggtggtgaggccctgggcaggctgctggtggtctacccttggacccagaggtcgactcggaccgatg

SEQ ID NO: 14795 - DNA, 203 bp, Homo sapiens
ggcgcgccagtcctgaccagtacactgacacaactgtgttcactagcaacctcaaacagacaccatggtgcatctgactcctgaggagaagtctgccgccggcgggttgtggggcaaggtgaacgtggatgaagttggtggtgaggccctgggcaggctgctggtggtctacccttgttcttggcaaacgactcggaccgatg

SEQ ID NO: 14796 - DNA, 203 bp, Homo sapiens
ggcgcgccagtcctattttgcagcctgacacaactgtgttcactagcaacctcaaacagacaccatggtgcatctgactcctgaggagaagtctgccggtgcccttccgtcaattcctttaagtttcagctaagttggtggtgaggccctgggcaggctgctggtggtctacccttggacccagaggtcgactcggaccgatg

SEQ ID NO: 14797 - DNA, 203 bp, Homo sapiens
ggcgcgccagtcctttaagcgtatctgacacaactgtgttcactagcaacctcaaacagacaccatggtgcatctgactcctgaggagaagtctgccgtagtttcactgtaccggccgtgcgtactcagtgaagttggtggtgaggccctgggcaggctgctggtggtctacccttggacccagaggtcgactcggaccgatg

SEQ ID NO: 14798 - DNA, 203 bp, Homo sapiens
ggcgcgccagtcctgcctgtgacactgacacaactgtgttcactagcaacctcaaacagacaccatggtgcatctgactcctgaggagaagtctgccgttacaccggccgtgggcaaggtgaacgtggatgaagttggtggtgaggccctgggcaggctgctggtggtctacccttggacctactccccgactcggaccgatg

SEQ ID NO: 14799 - DNA, 203 bp, Homo sapiens
ggcgcgccagtcctaatgtcacatctgacacaactgtgttcactagcaacctcaaacagacaccatggtgcatctgactcctgaggagaagtctgccgttacccggcgggtgggcaaggtgaacgtggatgaagttggtggtgaggccctgggcaggctgctggtggtctaccccacggaatcgagaacgactcggaccgatg

SEQ ID NO: 14800 - DNA, 203 bp, Homo sapiens
ggcgcgccagtcctcacacaggtcctgacacaactgtgttcactagcaacctcaaacagacaccatggtgcatctgactcctgaggagaagtctgccgttacccggcgggtgggcaaggtgaacgtggatgaagttggtggtgaggccctgggcaggctgctggtggtctacccttggacctactccccgactcggaccgatg

SEQ ID NO: 14801 - DNA, 203 bp, Homo sapiens
ggcgcgccagtcctccacacagctctgacacaactgtgttcactagcaacctcaaacagacaccatggtgcatctgactcctgaggagaagtctgccgttacccttccgtcaattcctttaagtttcgatgaagttggtggtgaggccctgggcaggctgctggtggtctacccttggacccagaggtcgactcggaccgatg

SEQ ID NO: 14802 - DNA, 203 bp, Homo sapiens
ggcgcgccagtcctaccttgtgtgctgacacaactgtgttcactagcaacctcaaacagacaccatggtgcatctgactcctgaggagaagtctgccgttaccggccgttggggcaaggtgaacgtggatgaagttggtggtgaggccctgggcaggctgctggtggtctacccttggaaccggccgtcgactcggaccgatg

SEQ ID NO: 14803 - DNA, 203 bp, Homo sapiens
ggcgcgccagtcctactgtgtgacctgacacaactgtgttcactagcaacctcaaacagacaccatggtgcatctgactcctgaggagaagtctgccgttaccgtcaattcctttaaggtgaacgtggatgaagttggtggtgaggccctgggcaggctgctggtggtctacccttggaaccggccgtcgactcggaccgatg

SEQ ID NO: 14804 - DNA, 203 bp, Homo sapiens
ggcgcgccagtccttatgtgtgatctgacacaactgtgttcactagcaacctcaaacagacaccatggtgcatctgactcctgaggagaagtctgccgttaccgtcaattcctttaaggtgaacgtggatgaagttggtggtgaggccctgggcaggctgctggtggtctacccttggaccggcgggtcgactcggaccgatg

SEQ ID NO: 14805 - DNA, 203 bp, Homo sapiens
ggcgcgccagtcctcagacgtacactgacacaactgtgttcactagcaacctcaaacagacaccatggtgcatctgactcctgaggagaagtctgccgttactactccctggggcaaggtgaacgtggatgaagttggtggtgaggccctgggcaggctgctggtggtctacccttggaaccggccgtcgactcggaccgatg

SEQ ID NO: 14806 - DNA, 203 bp, Homo sapiens
ggcgcgccagtcctagtagacgtactgacacaactgtgttcactagcaacctcaaacagacaccatggtgcatctgactcctgaggagaagtctgccgttactcacccacggaatcgagaaagagtggatgaagttggtggtgaggccctgggcaggctgctggtggtctacccttggacccagaggtcgactcggaccgatg

SEQ ID NO: 14807 - DNA, 203 bp, Homo sapiens
ggcgcgccagtcctacgtctacgtctgacacaactgtgttcactagcaacctcaaacagacaccatggtgcatctgactcctgaggagaagtctgccgttactcttccgtcaattcctttaagtttggatgaagttggtggtgaggccctgggcaggctgctggtggtctacccttggacccagaggtcgactcggaccgatg

SEQ ID NO: 14808 - DNA, 203 bp, Homo sapiens
ggcgcgccagtcctcgctacgtctctgacacaactgtgttcactagcaacctcaaacagacaccatggtgcatctgactcctgaggagaagtctgccgttactgaccggccgtgcaaggtgaaccggccgtaagttggtgaccggccgttgggcaggcaccggccgttctacccttaccggccgtggtcgactcggaccgatg

SEQ ID NO: 14809 - DNA, 203 bp, Homo sapiens
ggcgcgccagtccttcacagacgtctgacacaactgtgttcactagcaacctcaaacagacaccatggtgcatctgactcctgaggagaagtctgccgttactgaccggccgtgcaaggtgaaccggccgtaagttggtgaccggccgttgggcaggcaccggccgttctacccttggacccagaggtcgactcggaccgatg

SEQ ID NO: 14810 - DNA, 203 bp, Homo sapiens
ggcgcgccagtcctctaagacgtactgacacaactgtgttcactagcaacctcaaacagacaccatggtgcatctgactcctgaggagaagtctgccgttactgaccggccgtgcaaggtgaaccggccgtaagttggtgaccggccgttgggcaggctgctggtggtctacccttaccggccgtggtcgactcggaccgatg

SEQ ID NO: 14811 - DNA, 203 bp, Homo sapiens
ggcgcgccagtcctagacgttgttctgacacaactgtgttcactagcaacctcaaacagacaccatggtgcatctgactcctgaggagaagtctgccgttactgaccggccgtgcaaggtgaaccggccgtaagttggtgaccggccgttgggcaggctgctggtggtctacccttggacccagaggtcgactcggaccgatg

SEQ ID NO: 14812 - DNA, 203 bp, Homo sapiens
ggcgcgccagtcctaagagacgttctgacacaactgtgttcactagcaacctcaaacagacaccatggtgcatctgactcctgaggagaagtctgccgttactgaccggccgtgcaaggtgaaccggccgtaagttggtggtgaggccctgggcaggcaccggccgttctacccttaccggccgtggtcgactcggaccgatg

SEQ ID NO: 14813 - DNA, 203 bp, Homo sapiens
ggcgcgccagtccttgaacgtcttctgacacaactgtgttcactagcaacctcaaacagacaccatggtgcatctgactcctgaggagaagtctgccgttactgaccggccgtgcaaggtgaaccggccgtaagttggtggtgaggccctgggcaggcaccggccgttctacccttggacccagaggtcgactcggaccgatg

SEQ ID NO: 14814 - DNA, 203 bp, Homo sapiens
ggcgcgccagtcctaacgtctggactgacacaactgtgttcactagcaacctcaaacagacaccatggtgcatctgactcctgaggagaagtctgccgttactgaccggccgtgcaaggtgaaccggccgtaagttggtggtgaggccctgggcaggctgctggtggtctacccttggacccagaggtcgactcggaccgatg

SEQ ID NO: 14815 - DNA, 203 bp, Homo sapiens
ggcgcgccagtcctgacacagtccctgacacaactgtgttcactagcaacctcaaacagacaccatggtgcatctgactcctgaggagaagtctgccgttactgaccggccgtgcaaggtgaacgtggatgaagttggtgaccggccgttgggcaggcaccggccgttctacccttaccggccgtggtcgactcggaccgatg

SEQ ID NO: 14816 - DNA, 203 bp, Homo sapiens
ggcgcgccagtcctagttttgaaactgacacaactgtgttcactagcaacctcaaacagacaccatggtgcatctgactcctgaggagaagtctgccgttactgaccggccgtgcaaggtgaacgtggatgaagttggtgaccggccgttgggcaggcaccggccgttctacccttggacccagaggtcgactcggaccgatg

SEQ ID NO: 14817 - DNA, 203 bp, Homo sapiens
ggcgcgccagtcctttgaagcgacctgacacaactgtgttcactagcaacctcaaacagacaccatggtgcatctgactcctgaggagaagtctgccgttactgaccggccgtgcaaggtgaacgtggatgaagttggtggtgaggccctgggcaggcaccggccgttctacccttggacccagaggtcgactcggaccgatg

SEQ ID NO: 14818 - DNA, 203 bp, Homo sapiens
ggcgcgccagtcctactgtcgccactgacacaactgtgttcactagcaacctcaaacagacaccatggtgcatctgactcctgaggagaagtctgccgttactgacggccggtgcaaggtgaacggccggtaagttggtgacggccggttgggcaggcacggccggttctacccttggacccagaggtcgactcggaccgatg

SEQ ID NO: 14819 - DNA, 203 bp, Homo sapiens
ggcgcgccagtcctgcgacttggtctgacacaactgtgttcactagcaacctcaaacagacaccatggtgcatctgactcctgaggagaagtctgccgttactgcacggaatcgagaagtgaacgtggatgaagttggtgcacggaatcgagaaaggccacggaatcgagaaccttggacccagaggtcgactcggaccgatg

SEQ ID NO: 14820 - DNA, 203 bp, Homo sapiens
ggcgcgccagtcctagagtcgcctctgacacaactgtgttcactagcaacctcaaacagacaccatggtgcatctgactcctgaggagaagtctgccgttactgcacggaatcgagaagtgaacgtggatgaagttggtgcacggaatcgagaaaggctgctggtggtctacccttggacccagaggtcgactcggaccgatg

SEQ ID NO: 14821 - DNA, 203 bp, Homo sapiens
ggcgcgccagtccttaagtcgctactgacacaactgtgttcactagcaacctcaaacagacaccatggtgcatctgactcctgaggagaagtctgccgttactgcacggaatcgagaagtgacacggaatcgagaaggtgcacggaatcgagaaaggccacggaatcgagaaccttggacccagaggtcgactcggaccgatg

SEQ ID NO: 14822 - DNA, 203 bp, Homo sapiens
ggcgcgccagtcctaaggcgactactgacacaactgtgttcactagcaacctcaaacagacaccatggtgcatctgactcctgaggagaagtctgccgttactgcacggaatcgagaagtgacacggaatcgagaaggtggtgaggccctgggcaggctgctggtggtctacccttggacccagaggtcgactcggaccgatg

SEQ ID NO: 14823 - DNA, 203 bp, Homo sapiens
ggcgcgccagtcctatgaagtcgcctgacacaactgtgttcactagcaacctcaaacagacaccatggtgcatctgactcctgaggagaagtctgccgttactgcactgtaccggccgtgcgtcgtggatgaagttggtggtgaggccctgggcaggctgctggtggtctacccttggacccagaggtcgactcggaccgatg

SEQ ID NO: 14824 - DNA, 203 bp, Homo sapiens
ggcgcgccagtcctcgagcgacagctgacacaactgtgttcactagcaacctcaaacagacaccatggtgcatctgactcctgaggagaagtctgccgttactgccccacggaatcgagaaaacgtggatgaagttggtggtgaggccctgggcaggctgctggtggtctacccttgttcttggcaaacgactcggaccgatg

SEQ ID NO: 14825 - DNA, 203 bp, Homo sapiens
ggcgcgccagtccttgaatgtcgcctgacacaactgtgttcactagcaacctcaaacagacaccatggtgcatctgactcctgaggagaagtctgccgttactgccccattcttggcaaataacgtggatgaagttggtggtgaggccctgggcaggctgctggtggtctacccttggacccagaggtcgactcggaccgatg

SEQ ID NO: 14826 - DNA, 203 bp, Homo sapiens
ggcgcgccagtcctggcgaccatactgacacaactgtgttcactagcaacctcaaacagacaccatggtgcatctgactcctgaggagaagtctgccgttactgccccgtcaattcctttaaacgtggatgaagttggtggtgaggccctgggcaggctgctggtggtctacccttgttcttggcaaacgactcggaccgatg

SEQ ID NO: 14827 - DNA, 203 bp, Homo sapiens
ggcgcgccagtcctgtgtcgctcactgacacaactgtgttcactagcaacctcaaacagacaccatggtgcatctgactcctgaggagaagtctgccgttactgccctgaccggccgtgtgaacgtggatgaagttggtggtgaggccctgggcaggctgctggtggtctaccccacggaatcgagaacgactcggaccgatg

SEQ ID NO: 14828 - DNA, 203 bp, Homo sapiens
ggcgcgccagtcctaggcgaccacctgacacaactgtgttcactagcaacctcaaacagacaccatggtgcatctgactcctgaggagaagtctgccgttactgccctgaccggccgtgtgaacgtggatgaagttggtggtgaggccctgggcaggctgctggtggtctaccccgtcaattcctttacgactcggaccgatg

SEQ ID NO: 14829 - DNA, 203 bp, Homo sapiens
ggcgcgccagtcctatcgaccaccctgacacaactgtgttcactagcaacctcaaacagacaccatggtgcatctgactcctgaggagaagtctgccgttactgccctgcatactcccctgaacgtggatgaagttggtggtgaggccctgggcaggctgctggtggtctacccttggacccagaggtcgactcggaccgatg

SEQ ID NO: 14830 - DNA, 203 bp, Homo sapiens
ggcgcgccagtcctaagtggtcgactgacacaactgtgttcactagcaacctcaaacagacaccatggtgcatctgactcctgaggagaagtctgccgttactgccctgcccggcgggtcatacgtggatgaagttggtggtgaggccctgggcaggctgctggtggtctacccttggacccagaggtcgactcggaccgatg

SEQ ID NO: 14831 - DNA, 203 bp, Homo sapiens
ggcgcgccagtcctggtcgactaactgacacaactgtgttcactagcaacctcaaacagacaccatggtgcatctgactcctgaggagaagtctgccgttactgccctgcccggcgggtcgaacgtggatgaagttggtggtgaggccctgggcaggctgctggtggtctacccttggacccagaggtcgactcggaccgatg

SEQ ID NO: 14832 - DNA, 203 bp, Homo sapiens
ggcgcgccagtcctctggtcgatcctgacacaactgtgttcactagcaacctcaaacagacaccatggtgcatctgactcctgaggagaagtctgccgttactgccctgcccggcgggttgaacgtggatgaagttggtggtgaggccctgggcaggctgctggtggtctacccttggacccagaggtcgactcggaccgatg

SEQ ID NO: 14833 - DNA, 203 bp, Homo sapiens
ggcgcgccagtccttcacctagagctgacacaactgtgttcactagcaacctcaaacagacaccatggtgcatctgactcctgaggagaagtctgccgttactgccctgcggaatcgagtgaacgtggatgaagttggtggtgaggccctgggcaggctgctggtggtctacccttggacccagaggtcgactcggaccgatg

SEQ ID NO: 14834 - DNA, 203 bp, Homo sapiens
ggcgcgccagtcctaactagaaaactgacacaactgtgttcactagcaacctcaaacagacaccatggtgcatctgactcctgaggagaagtctgccgttactgccctgcgtcaattcctttacgtggatgaagttggtggtgaggccctgggcaggctgctggtggtctacccttggaccggcgggtcgactcggaccgatg

SEQ ID NO: 14835 - DNA, 203 bp, Homo sapiens
ggcgcgccagtcctgtactagaatctgacacaactgtgttcactagcaacctcaaacagacaccatggtgcatctgactcctgaggagaagtctgccgttactgccctgtaccggccgtgcgacgtggatgaagttggtggtgaggccctgggcaggctgctggtggtctacccttggacccagaggtcgactcggaccgatg

SEQ ID NO: 14836 - DNA, 203 bp, Homo sapiens
ggcgcgccagtcctagcgactagactgacacaactgtgttcactagcaacctcaaacagacaccatggtgcatctgactcctgaggagaagtctgccgttactgccctgtactcccaggtgaacgtggatgaagttggtggtgaggccctgggcaggctgctggtggtctacccttggaaccggccgtcgactcggaccgatg

SEQ ID NO: 14837 - DNA, 203 bp, Homo sapiens
ggcgcgccagtccttacttctagtctgacacaactgtgttcactagcaacctcaaacagacaccatggtgcatctgactcctgaggagaagtctgccgttactgccctgtgcgtcaattcctttatggatgaagttggtggtgaggccctgggcaggctgctggtggtctaccccgtcaattcctttacgactcggaccgatg

SEQ ID NO: 14838 - DNA, 203 bp, Homo sapiens
ggcgcgccagtccttactctaggcctgacacaactgtgttcactagcaacctcaaacagacaccatggtgcatctgactcctgaggagaagtctgccgttactgccctgtgcgtcaattcctttatggatgaagttggtggtgaggccctgggcaggctgctggtggtctacccttggacccagaggtcgactcggaccgatg

SEQ ID NO: 14839 - DNA, 203 bp, Homo sapiens
ggcgcgccagtccttctagttacgctgacacaactgtgttcactagcaacctcaaacagacaccatggtgcatctgactcctgaggagaagtctgccgttactgccctgtgcttggcggtgaacgtggatgaagttggtggtgaggccctgggcaggctgctggtggtctacccttggacccagaggtcgactcggaccgatg

SEQ ID NO: 14840 - DNA, 203 bp, Homo sapiens
ggcgcgccagtccttctaggtcaactgacacaactgtgttcactagcaacctcaaacagacaccatggtgcatctgactcctgaggagaagtctgccgttactgccctgtggaccggccgtaacgtggatgaagttggtggtgaggccctgggcaggctgctggtggtctacccttgttcttggcaaacgactcggaccgatg

SEQ ID NO: 14841 - DNA, 203 bp, Homo sapiens
ggcgcgccagtccttcaggtgagtctgacacaactgtgttcactagcaacctcaaacagacaccatggtgcatctgactcctgaggagaagtctgccgttactgccctgtggggaccggccgtcgtggatgaagttggtggtgaggccctgggcaggctgctggtggtctacccttggaccggcgggtcgactcggaccgatg

SEQ ID NO: 14842 - DNA, 203 bp, Homo sapiens
ggcgcgccagtcctatcaggtctactgacacaactgtgttcactagcaacctcaaacagacaccatggtgcatctgactcctgaggagaagtctgccgttactgccctgtggggcaaccggccgttggatgaagttggtggtgaggccctgggcaggctgctggtggtctaccccgtcaattcctttacgactcggaccgatg

SEQ ID NO: 14843 - DNA, 203 bp, Homo sapiens
ggcgcgccagtcctaaacctgatcctgacacaactgtgttcactagcaacctcaaacagacaccatggtgcatctgactcctgaggagaagtctgccgttactgccctgtggggcaaccggccgttggatgaagttggtggtgaggccctgggcaggctgctggtggtctacccttggacccagaggtcgactcggaccgatg

SEQ ID NO: 14844 - DNA, 203 bp, Homo sapiens
ggcgcgccagtcctacctgaagaactgacacaactgtgttcactagcaacctcaaacagacaccatggtgcatctgactcctgaggagaagtctgccgttactgccctgtggggcaaccggccgttggatgaagttggtggtgaggccctgggcaggctgctggtggtctacccttggacctactccccgactcggaccgatg

SEQ ID NO: 14845 - DNA, 203 bp, Homo sapiens
ggcgcgccagtcctggtagaacgtctgacacaactgtgttcactagcaacctcaaacagacaccatggtgcatctgactcctgaggagaagtctgccgttactgccctgtggggcaaggaccggccgtatgaagttggtggtgaggccctgggcaggctgctggtggtctacccttgttcttggcaaacgactcggaccgatg

SEQ ID NO: 14846 - DNA, 203 bp, Homo sapiens
ggcgcgccagtcctcgttctagcactgacacaactgtgttcactagcaacctcaaacagacaccatggtgcatctgactcctgaggagaagtctgccgttactgccctgtggggcaaggccggcgggtatgaagttggtggtgaggccctgggcaggctgctggtggtctacccttgttcttggcaaacgactcggaccgatg

SEQ ID NO: 14847 - DNA, 203 bp, Homo sapiens
ggcgcgccagtccttaaagcgttcctgacacaactgtgttcactagcaacctcaaacagacaccatggtgcatctgactcctgaggagaagtctgccgttactgccctgtggggcaaggtgaaaccggccgtagttggtggtgaggccctgggcaggctgctggtggtctaccccacggaatcgagaacgactcggaccgatg

SEQ ID NO: 14848 - DNA, 203 bp, Homo sapiens
ggcgcgccagtcctactgcagaacctgacacaactgtgttcactagcaacctcaaacagacaccatggtgcatctgactcctgaggagaagtctgccgttactgccctgtggggcaaggtgaacacggaatcgagaagtggtgaggccctgggcaggctgctggtggtctacccttggaaccggccgtcgactcggaccgatg

SEQ ID NO: 14849 - DNA, 203 bp, Homo sapiens
ggcgcgccagtcctcccgaccgtgctgacacaactgtgttcactagcaacctcaaacagacaccatggtgcatctgactcctgaggagaagtctgccgttactgccctgtggggcaaggtgaaccggccgtaagttggtgaccggccgttgggcaggctgctggtggtctacccttaccggccgtggtcgactcggaccgatg

SEQ ID NO: 14850 - DNA, 203 bp, Homo sapiens
ggcgcgccagtccttcgtctcgggctgacacaactgtgttcactagcaacctcaaacagacaccatggtgcatctgactcctgaggagaagtctgccgttactgccctgtggggcaaggtgaaccggccgtaagttggtgaccggccgttgggcaggctgctggtggtctacccttggacccagaggtcgactcggaccgatg

SEQ ID NO: 14851 - DNA, 203 bp, Homo sapiens
ggcgcgccagtcctcccgaggtgactgacacaactgtgttcactagcaacctcaaacagacaccatggtgcatctgactcctgaggagaagtctgccgttactgccctgtggggcaaggtgaaccggccgtaagttggtggtgaggccctgggcaggcaccggccgttctacccttggacccagaggtcgactcggaccgatg

SEQ ID NO: 14852 - DNA, 203 bp, Homo sapiens
ggcgcgccagtcctcccgattcgtctgacacaactgtgttcactagcaacctcaaacagacaccatggtgcatctgactcctgaggagaagtctgccgttactgccctgtggggcaaggtgaaccggccgtaagttggtggtgaggccctgggcaggctgctggtggtctacccttaccggccgtggtcgactcggaccgatg

SEQ ID NO: 14853 - DNA, 203 bp, Homo sapiens
ggcgcgccagtccttagtcatttcctgacacaactgtgttcactagcaacctcaaacagacaccatggtgcatctgactcctgaggagaagtctgccgttactgccctgtggggcaaggtgaaccggcgggtagttggtggtgaggccctgggcaggctgctggtggtctacccttggacccagaggtcgactcggaccgatg

SEQ ID NO: 14854 - DNA, 203 bp, Homo sapiens
ggcgcgccagtcctaatgttgactctgacacaactgtgttcactagcaacctcaaacagacaccatggtgcatctgactcctgaggagaagtctgccgttactgccctgtggggcaaggtgaaccggcgggtagttggtggtgaggccctgggcaggctgctggtggtctacccttggacctactccccgactcggaccgatg

SEQ ID NO: 14855 - DNA, 203 bp, Homo sapiens
ggcgcgccagtcctgtgagttaagctgacacaactgtgttcactagcaacctcaaacagacaccatggtgcatctgactcctgaggagaagtctgccgttactgccctgtggggcaaggtgaacgcacggaatcgagaaggtgaggccctgggcaggctgctggtggtctacccttggacctactccccgactcggaccgatg

SEQ ID NO: 14856 - DNA, 203 bp, Homo sapiens
ggcgcgccagtcctctctgtcacgctgacacaactgtgttcactagcaacctcaaacagacaccatggtgcatctgactcctgaggagaagtctgccgttactgccctgtggggcaaggtgaacgcgtcaattcctttaggtgaggccctgggcaggctgctggtggtctaccccacggaatcgagaacgactcggaccgatg

SEQ ID NO: 14857 - DNA, 203 bp, Homo sapiens
ggcgcgccagtcctagagtgacccctgacacaactgtgttcactagcaacctcaaacagacaccatggtgcatctgactcctgaggagaagtctgccgttactgccctgtggggcaaggtgaacgtaccggccgttggtggtgaggccctgggcaggctgctggtggtctacccttgttcttggcaaacgactcggaccgatg

SEQ ID NO: 14858 - DNA, 203 bp, Homo sapiens
ggcgcgccagtcctgcctagacccctgacacaactgtgttcactagcaacctcaaacagacaccatggtgcatctgactcctgaggagaagtctgccgttactgccctgtggggcaaggtgaacgtactcccagttggtggtgaggccctgggcaggctgctggtggtctacccttggacccagaggtcgactcggaccgatg

SEQ ID NO: 14859 - DNA, 203 bp, Homo sapiens
ggcgcgccagtcctggcaggacccctgacacaactgtgttcactagcaacctcaaacagacaccatggtgcatctgactcctgaggagaagtctgccgttactgccctgtggggcaaggtgaacgtggaccggccgtgtggtgaggccctgggcaggctgctggtggtctacccttggaccggcgggtcgactcggaccgatg

SEQ ID NO: 14860 - DNA, 203 bp, Homo sapiens
ggcgcgccagtcctgggtccactactgacacaactgtgttcactagcaacctcaaacagacaccatggtgcatctgactcctgaggagaagtctgccgttactgccctgtggggcaaggtgaacgtggataccggccgtggtgaggccctgggcaggctgctggtggtctacccttggacctactccccgactcggaccgatg

SEQ ID NO: 14861 - DNA, 203 bp, Homo sapiens
ggcgcgccagtcctgggtctcgttctgacacaactgtgttcactagcaacctcaaacagacaccatggtgcatctgactcctgaggagaagtctgccgttactgccctgtggggcaaggtgaacgtggatccggcgggtggtgaggccctgggcaggctgctggtggtctaccccgtcaattcctttacgactcggaccgatg

SEQ ID NO: 14862 - DNA, 203 bp, Homo sapiens
ggcgcgccagtcctttgacttgcgctgacacaactgtgttcactagcaacctcaaacagacaccatggtgcatctgactcctgaggagaagtctgccgttactgccctgtggggcaaggtgaacgtggatgaagtccggcgggtggccctgggcaggctgctggtggtctacccttggaccggcgggtcgactcggaccgatg

SEQ ID NO: 14863 - DNA, 203 bp, Homo sapiens
ggcgcgccagtccttaagtcagagctgacacaactgtgttcactagcaacctcaaacagacaccatggtgcatctgactcctgaggagaagtctgccgttactgccctgtggggcaaggtgaacgtggatgaagttactcccgaggccctgggcaggctgctggtggtctacccttgttcttggcaaacgactcggaccgatg

SEQ ID NO: 14864 - DNA, 203 bp, Homo sapiens
ggcgcgccagtcctcgtgacttagctgacacaactgtgttcactagcaacctcaaacagacaccatggtgcatctgactcctgaggagaagtctgccgttactgccctgtggggcaaggtgaacgtggatgaagttgcacggaatcgagaaggcaggctgctggtggtctacccttggaaccggccgtcgactcggaccgatg

SEQ ID NO: 14865 - DNA, 203 bp, Homo sapiens
ggcgcgccagtcctaagtcaggccctgacacaactgtgttcactagcaacctcaaacagacaccatggtgcatctgactcctgaggagaagtctgccgttactgccctgtggggcaaggtgaacgtggatgaagttgcacggaatcgagaaggcaggctgctggtggtctacccttggaccggcgggtcgactcggaccgatg

SEQ ID NO: 14866 - DNA, 203 bp, Homo sapiens
ggcgcgccagtccttatgacttctctgacacaactgtgttcactagcaacctcaaacagacaccatggtgcatctgactcctgaggagaagtctgccgttactgccctgtggggcaaggtgaacgtggatgaagttgccggcgggtccctgggcaggctgctggtggtctaccccgtcaattcctttacgactcggaccgatg

SEQ ID NO: 14867 - DNA, 203 bp, Homo sapiens
ggcgcgccagtcctcttaagtcaactgacacaactgtgttcactagcaacctcaaacagacaccatggtgcatctgactcctgaggagaagtctgccgttactgccctgtggggcaaggtgaacgtggatgaagttgccggcgggtccctgggcaggctgctggtggtctacccttggacccagaggtcgactcggaccgatg

SEQ ID NO: 14868 - DNA, 203 bp, Homo sapiens
ggcgcgccagtcctcagaatcttcctgacacaactgtgttcactagcaacctcaaacagacaccatggtgcatctgactcctgaggagaagtctgccgttactgccctgtggggcaaggtgaacgtggatgaagttgcgtcaattcctttaggcaggctgctggtggtctacccttggaccggcgggtcgactcggaccgatg

SEQ ID NO: 14869 - DNA, 203 bp, Homo sapiens
ggcgcgccagtcctctgctgactactgacacaactgtgttcactagcaacctcaaacagacaccatggtgcatctgactcctgaggagaagtctgccgttactgccctgtggggcaaggtgaacgtggatgaagttggtcgtcaattcctttacaggctgctggtggtctaccccacggaatcgagaacgactcggaccgatg

SEQ ID NO: 14870 - DNA, 203 bp, Homo sapiens
ggcgcgccagtcctcaagtattctctgacacaactgtgttcactagcaacctcaaacagacaccatggtgcatctgactcctgaggagaagtctgccgttactgccctgtggggcaaggtgaacgtggatgaagttggtgaccggccgttgggcaggcaccggccgttctacccttaccggccgtggtcgactcggaccgatg

SEQ ID NO: 14871 - DNA, 203 bp, Homo sapiens
ggcgcgccagtcctgctaagtatgctgacacaactgtgttcactagcaacctcaaacagacaccatggtgcatctgactcctgaggagaagtctgccgttactgccctgtggggcaaggtgaacgtggatgaagttggtgaccggccgttgggcaggcaccggccgttctacccttggacccagaggtcgactcggaccgatg

SEQ ID NO: 14872 - DNA, 203 bp, Homo sapiens
ggcgcgccagtcctcatactttcgctgacacaactgtgttcactagcaacctcaaacagacaccatggtgcatctgactcctgaggagaagtctgccgttactgccctgtggggcaaggtgaacgtggatgaagttggtgaccggccgttgggcaggctgctggtggtctacccttgttcttggcaaacgactcggaccgatg

SEQ ID NO: 14873 - DNA, 203 bp, Homo sapiens
ggcgcgccagtcctcatacttggtctgacacaactgtgttcactagcaacctcaaacagacaccatggtgcatctgactcctgaggagaagtctgccgttactgccctgtggggcaaggtgaacgtggatgaagttggtgcacggaatcgagaaaggccacggaatcgagaaccttggacccagaggtcgactcggaccgatg

SEQ ID NO: 14874 - DNA, 203 bp, Homo sapiens
ggcgcgccagtcctacgatactttctgacacaactgtgttcactagcaacctcaaacagacaccatggtgcatctgactcctgaggagaagtctgccgttactgccctgtggggcaaggtgaacgtggatgaagttggtgcacggaatcgagaaaggctgctggtggtctacccttggacccagaggtcgactcggaccgatg

SEQ ID NO: 14875 - DNA, 203 bp, Homo sapiens
ggcgcgccagtcctgtttgtatccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14876 - DNA, 203 bp, Homo sapiens
ggcgcgccagtcctatctgaaaccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14877 - DNA, 203 bp, Homo sapiens
ggcgcgccagtcctgatacttaccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14878 - DNA, 203 bp, Homo sapiens
ggcgcgccagtcctaacagttaccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14879 - DNA, 203 bp, Homo sapiens
ggcgcgccagtcctttactagaccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14880 - DNA, 203 bp, Homo sapiens
ggcgcgccagtcctaattctgtccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14881 - DNA, 203 bp, Homo sapiens
ggcgcgccagtcctggtcaagtatctgacacaactgtgttcactagcaacctcaaacagacaccatggtgcatctgactcctgaggagaagtctgccgttactgccctgtggggcaaggtgaacgtggatgaagttggtggggagtacctgggcaggcgggagtaggtctacccttggacccagaggtcgactcggaccgatg

SEQ ID NO: 14882 - DNA, 203 bp, Homo sapiens
ggcgcgccagtcctggttgtaagactgacacaactgtgttcactagcaacctcaaacagacaccatggtgcatctgactcctgaggagaagtctgccgttactgccctgtggggcaaggtgaacgtggatgaagttggtggtcacggaatcgagaagctgctggtggtctacccttgttcttggcaaacgactcggaccgatg

SEQ ID NO: 14883 - DNA, 203 bp, Homo sapiens
ggcgcgccagtcctggtgaagattctgacacaactgtgttcactagcaacctcaaacagacaccatggtgcatctgactcctgaggagaagtctgccgttactgccctgtggggcaaggtgaacgtggatgaagttggtggtcgtcaattcctttagctgctggtggtctacccttgttcttggcaaacgactcggaccgatg

SEQ ID NO: 14884 - DNA, 203 bp, Homo sapiens
ggcgcgccagtccttcttgatctactgacacaactgtgttcactagcaacctcaaacagacaccatggtgcatctgactcctgaggagaagtctgccgttactgccctgtggggcaaggtgaacgtggatgaagttggtggtgaaccggccgtcaggctgctggtggtctaccccacggaatcgagaacgactcggaccgatg

SEQ ID NO: 14885 - DNA, 203 bp, Homo sapiens
ggcgcgccagtcctatgtgatctactgacacaactgtgttcactagcaacctcaaacagacaccatggtgcatctgactcctgaggagaagtctgccgttactgccctgtggggcaaggtgaacgtggatgaagttggtggtgaaccggccgtcaggctgctggtggtctacccttggacctactccccgactcggaccgatg

SEQ ID NO: 14886 - DNA, 203 bp, Homo sapiens
ggcgcgccagtcctggcttcacccctgacacaactgtgttcactagcaacctcaaacagacaccatggtgcatctgactcctgaggagaagtctgccgttactgccctgtggggcaaggtgaacgtggatgaagttggtggtgacacggaatcgagaatgctggtggtctacccttggaaccggccgtcgactcggaccgatg

SEQ ID NO: 14887 - DNA, 203 bp, Homo sapiens
ggcgcgccagtcctgttcacccacctgacacaactgtgttcactagcaacctcaaacagacaccatggtgcatctgactcctgaggagaagtctgccgttactgccctgtggggcaaggtgaacgtggatgaagttggtggtgacacggaatcgagaatgctggtggtctacccttggaccggcgggtcgactcggaccgatg

SEQ ID NO: 14888 - DNA, 203 bp, Homo sapiens
ggcgcgccagtcctaacctagcagctgacacaactgtgttcactagcaacctcaaacagacaccatggtgcatctgactcctgaggagaagtctgccgttactgccctgtggggcaaggtgaacgtggatgaagttggtggtgaccggcgggtcaggctgctggtggtctacccttggacccagaggtcgactcggaccgatg

SEQ ID NO: 14889 - DNA, 203 bp, Homo sapiens
ggcgcgccagtccttaaccgagccctgacacaactgtgttcactagcaacctcaaacagacaccatggtgcatctgactcctgaggagaagtctgccgttactgccctgtggggcaaggtgaacgtggatgaagttggtggtgacgtcaattcctttatgctggtggtctacccttggaccggcgggtcgactcggaccgatg

SEQ ID NO: 14890 - DNA, 203 bp, Homo sapiens
ggcgcgccagtcctcgacgtcctgctgacacaactgtgttcactagcaacctcaaacagacaccatggtgcatctgactcctgaggagaagtctgccgttactgccctgtggggcaaggtgaacgtggatgaagttggtggtgaggcccccggcgggttgctggtggtctacccttggaaccggccgtcgactcggaccgatg

SEQ ID NO: 14891 - DNA, 203 bp, Homo sapiens
ggcgcgccagtcctggacgtttcgctgacacaactgtgttcactagcaacctcaaacagacaccatggtgcatctgactcctgaggagaagtctgccgttactgccctgtggggcaaggtgaacgtggatgaagttggtggtgaggccctactcccgctgctggtggtctacccttgttcttggcaaacgactcggaccgatg

SEQ ID NO: 14892 - DNA, 203 bp, Homo sapiens
ggcgcgccagtcctggacgttctactgacacaactgtgttcactagcaacctcaaacagacaccatggtgcatctgactcctgaggagaagtctgccgttactgccctgtggggcaaggtgaacgtggatgaagttggtggtgaggccctgaccggccgtctggtggtctaccccgtcaattcctttacgactcggaccgatg

SEQ ID NO: 14893 - DNA, 203 bp, Homo sapiens
ggcgcgccagtcctctggtagtaactgacacaactgtgttcactagcaacctcaaacagacaccatggtgcatctgactcctgaggagaagtctgccgttactgccctgtggggcaaggtgaacgtggatgaagttggtggtgaggccctgcacggaatcgagaaggtctacccttggaaccggccgtcgactcggaccgatg

SEQ ID NO: 14894 - DNA, 203 bp, Homo sapiens
ggcgcgccagtcctagaggtagtactgacacaactgtgttcactagcaacctcaaacagacaccatggtgcatctgactcctgaggagaagtctgccgttactgccctgtggggcaaggtgaacgtggatgaagttggtggtgaggccctgcacggaatcgagaaggtctacccttggaccggcgggtcgactcggaccgatg

SEQ ID NO: 14895 - DNA, 203 bp, Homo sapiens
ggcgcgccagtcctcgtgaatgaactgacacaactgtgttcactagcaacctcaaacagacaccatggtgcatctgactcctgaggagaagtctgccgttactgccctgtggggcaaggtgaacgtggatgaagttggtggtgaggccctgccggcgggtctggtggtctacccttggacctactccccgactcggaccgatg

SEQ ID NO: 14896 - DNA, 203 bp, Homo sapiens
ggcgcgccagtccttgtctcgtgcctgacacaactgtgttcactagcaacctcaaacagacaccatggtgcatctgactcctgaggagaagtctgccgttactgccctgtggggcaaggtgaacgtggatgaagttggtggtgaggccctgggcaccggccgtgtggtctacccttgttcttggcaaacgactcggaccgatg

SEQ ID NO: 14897 - DNA, 203 bp, Homo sapiens
ggcgcgccagtcctaggctgcgaactgacacaactgtgttcactagcaacctcaaacagacaccatggtgcatctgactcctgaggagaagtctgccgttactgccctgtggggcaaggtgaacgtggatgaagttggtggtgaggccctgggcaggcacccgccggtctacccttggacccagaggtcgactcggaccgatg

SEQ ID NO: 14898 - DNA, 203 bp, Homo sapiens
ggcgcgccagtcctaccaagcgaactgacacaactgtgttcactagcaacctcaaacagacaccatggtgcatctgactcctgaggagaagtctgccgttactgccctgtggggcaaggtgaacgtggatgaagttggtggtgaggccctgggcaggcaccggccgttctaccccacggaatcgagaacgactcggaccgatg

SEQ ID NO: 14899 - DNA, 203 bp, Homo sapiens
ggcgcgccagtcctaatgcgaatcctgacacaactgtgttcactagcaacctcaaacagacaccatggtgcatctgactcctgaggagaagtctgccgttactgccctgtggggcaaggtgaacgtggatgaagttggtggtgaggccctgggcaggcaccggccgttctacccttggacccagaggtcgactcggaccgatg

SEQ ID NO: 14900 - DNA, 203 bp, Homo sapiens
ggcgcgccagtcctcaggcgaactctgacacaactgtgttcactagcaacctcaaacagacaccatggtgcatctgactcctgaggagaagtctgccgttactgccctgtggggcaaggtgaacgtggatgaagttggtggtgaggccctgggcaggccacggaatcgagaaccttggaccggcgggtcgactcggaccgatg

SEQ ID NO: 14901 - DNA, 203 bp, Homo sapiens
ggcgcgccagtccttggcgaagtcctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctaccccacggaatcgagaacgactcggaccgatg

SEQ ID NO: 14902 - DNA, 203 bp, Homo sapiens
ggcgcgccagtcctaaaagcgaagctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14903 - DNA, 203 bp, Homo sapiens
ggcgcgccagtcctctcttcgccactgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14904 - DNA, 203 bp, Homo sapiens
ggcgcgccagtcctacgctttcgcctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14905 - DNA, 203 bp, Homo sapiens
ggcgcgccagtcctcttcgctgtgctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14906 - DNA, 203 bp, Homo sapiens
ggcgcgccagtcctcgttcgctgcctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14907 - DNA, 203 bp, Homo sapiens
ggcgcgccagtcctaggattcgctctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14908 - DNA, 203 bp, Homo sapiens
ggcgcgccagtcctatttcgctcgctgacacaactgtgttcactagcaacctcaaacagacaccatggtgcatctgactcctgaggagaagtctgccgttactgccctgtggggcaaggtgaacgtggatgaagttggtggtgaggccctgggcaggccgtcaattcctttaccttggacccagaggtcgactcggaccgatg

SEQ ID NO: 14909 - DNA, 203 bp, Homo sapiens
ggcgcgccagtcctaaattcgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctactcccggtctacccttggacccagaggtcgactcggaccgatg

SEQ ID NO: 14910 - DNA, 203 bp, Homo sapiens
ggcgcgccagtcctggatttcgctctgacacaactgtgttcactagcaacctcaaacagacaccatggtgcatctgactcctgaggagaagtctgccgttactgccctgtggggcaaggtgaacgtggatgaagttggtggtgaggccctgggcaggctactcccggtctacccttggaccggcgggtcgactcggaccgatg

SEQ ID NO: 14911 - DNA, 203 bp, Homo sapiens
ggcgcgccagtcctcttcgctagtctgacacaactgtgttcactagcaacctcaaacagacaccatggtgcatctgactcctgaggagaagtctgccgttactgccctgtggggcaaggtgaacgtggatgaagttggtggtgaggccctgggcaggctactcccggtctaccctttactcccgaggtcgactcggaccgatg

SEQ ID NO: 14912 - DNA, 203 bp, Homo sapiens
ggcgcgccagtcctttgtcatgggctgacacaactgtgttcactagcaacctcaaacagacaccatggtgcatctgactcctgaggagaagtctgccgttactgccctgtggggcaaggtgaacgtggatgaagttggtggtgaggccctgggcaggctgcacggaatcgagaattggacctactccccgactcggaccgatg

SEQ ID NO: 14913 - DNA, 203 bp, Homo sapiens
ggcgcgccagtccttgtaggtgccctgacacaactgtgttcactagcaacctcaaacagacaccatggtgcatctgactcctgaggagaagtctgccgttactgccctgtggggcaaggtgaacgtggatgaagttggtggtgaggccctgggcaggctgcccggcgggtacccttgttcttggcaaacgactcggaccgatg

SEQ ID NO: 14914 - DNA, 203 bp, Homo sapiens
ggcgcgccagtcctgtgacgttctctgacacaactgtgttcactagcaacctcaaacagacaccatggtgcatctgactcctgaggagaagtctgccgttactgccctgtggggcaaggtgaacgtggatgaagttggtggtgaggccctgggcaggctgcgtcaattcctttacacggaatcgagaacgactcggaccgatg

SEQ ID NO: 14915 - DNA, 203 bp, Homo sapiens
ggcgcgccagtcctaccttacgcactgacacaactgtgttcactagcaacctcaaacagacaccatggtgcatctgactcctgaggagaagtctgccgttactgccctgtggggcaaggtgaacgtggatgaagttggtggtgaggccctgggcaggctgctgaccggccgtccttggaaccggccgtcgactcggaccgatg

SEQ ID NO: 14916 - DNA, 203 bp, Homo sapiens
ggcgcgccagtcctcttacgctctctgacacaactgtgttcactagcaacctcaaacagacaccatggtgcatctgactcctgaggagaagtctgccgttactgccctgtggggcaaggtgaacgtggatgaagttggtggtgaggccctgggcaggctgctgcacggaatcgagaattcttggcaaacgactcggaccgatg

SEQ ID NO: 14917 - DNA, 203 bp, Homo sapiens
ggcgcgccagtccttgctgtgttcctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtcacggaatcgagaaccggcgggtcgactcggaccgatg

SEQ ID NO: 14918 - DNA, 203 bp, Homo sapiens
ggcgcgccagtccttatcgtgttactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtccggcgggtttggacccagaggtcgactcggaccgatg

SEQ ID NO: 14919 - DNA, 203 bp, Homo sapiens
ggcgcgccagtcctaacacgatcgctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtcgtcaattcctttaccggcgggtcgactcggaccgatg

SEQ ID NO: 14920 - DNA, 203 bp, Homo sapiens
ggcgcgccagtcctgacctaagaactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggcgtcaattcctttatactccccgactcggaccgatg

SEQ ID NO: 14921 - DNA, 203 bp, Homo sapiens
ggcgcgccagtccttcagcctaccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtactcccttggacctactccccgactcggaccgatg

SEQ ID NO: 14922 - DNA, 203 bp, Homo sapiens
ggcgcgccagtcctctttcagcctctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14923 - DNA, 203 bp, Homo sapiens
ggcgcgccagtcctgtaagtcatgctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccctactccctactccccgactcggaccgatg

SEQ ID NO: 14924 - DNA, 203 bp, Homo sapiens
ggcgcgccagtcctagaacctgtgctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14925 - DNA, 203 bp, Homo sapiens
ggcgcgccagtcctttgaggttcactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14926 - DNA, 203 bp, Homo sapiens
ggcgcgccagtcctgaccgaaacactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14927 - DNA, 203 bp, Homo sapiens
ggcgcgccagtcctcgtgtacccactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14928 - DNA, 203 bp, Homo sapiens
ggcgcgccagtcctgtcaacacgtctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14929 - DNA, 203 bp, Homo sapiens
ggcgcgccagtcctccagtgttgactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14930 - DNA, 203 bp, Homo sapiens
ggcgcgccagtccttcaacacttactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14931 - DNA, 203 bp, Homo sapiens
ggcgcgccagtcctttgtaaacccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14932 - DNA, 203 bp, Homo sapiens
ggcgcgccagtccttgtggtagaactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14933 - DNA, 203 bp, Homo sapiens
ggcgcgccagtcctgctggactttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctactactcccaccggccgtcgactcggaccgatg

SEQ ID NO: 14934 - DNA, 203 bp, Homo sapiens
ggcgcgccagtcctagttggtcccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctccggcgggtaccggccgtcgactcggaccgatg

SEQ ID NO: 14935 - DNA, 203 bp, Homo sapiens
ggcgcgccagtccttagaagtcccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtttcttggcaaaaccggccgtcgactcggaccgatg

SEQ ID NO: 14936 - DNA, 203 bp, Homo sapiens
ggcgcgccagtccttcccaaccgtctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggttactcccccttggaaccggccgtcgactcggaccgatg

SEQ ID NO: 14937 - DNA, 203 bp, Homo sapiens
ggcgcgccagtcctatcccaaggactgacacaactgtgttcactagcaacctcaaacagacaccatggtgcatctgactcctgaggagaagtctgccgttactgccctgtggggcaaggtgaacgtggatgaagttggtggtgaggccctgggcaggctgctgttcttggcaaattggacccagaggtcgactcggaccgatg

SEQ ID NO: 14938 - DNA, 203 bp, Homo sapiens
ggcgcgccagtcctgcatgatcccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctgttcttggcaaattggacctactccccgactcggaccgatg

SEQ ID NO: 14939 - DNA, 203 bp, Homo sapiens
ggcgcgccagtcctgggatcctaactgacacaactgtgttcactagcaacctcaaacagacaccatggtgcatctgactcctgaggagaagtctgccgttactgccctgtggggcaaggtgaacgtggatgaagttggtggtgaggccctgggcaggctgtactccctctaccccgtcaattcctttacgactcggaccgatg

SEQ ID NO: 14940 - DNA, 203 bp, Homo sapiens
ggcgcgccagtcctttgggacctcctgacacaactgtgttcactagcaacctcaaacagacaccatggtgcatctgactcctgaggagaagtctgccgttactgccctgtggggcaaggtgaacgtggatgaagttggtggtgaggccctgggcaggcttctcgattccgtgccttggacccagaggtcgactcggaccgatg

SEQ ID NO: 14941 - DNA, 203 bp, Homo sapiens
ggcgcgccagtcctatttgggaccctgacacaactgtgttcactagcaacctcaaacagacaccatggtgcatctgactcctgaggagaagtctgccgttactgccctgtggggcaaggtgaacgtggatgaagttggtggtgaggccctgggcagttcttggcaaatctacccttggacccagaggtcgactcggaccgatg

SEQ ID NO: 14942 - DNA, 203 bp, Homo sapiens
ggcgcgccagtcctgggatactcgctgacacaactgtgttcactagcaacctcaaacagacaccatggtgcatctgactcctgaggagaagtctgccgttactgccctgtggggcaaggtgaacgtggatgaagttggtggtgaggccctgggcccggcgggtgtggtctacccttgttcttggcaaacgactcggaccgatg

SEQ ID NO: 14943 - DNA, 203 bp, Homo sapiens
ggcgcgccagtcctagagcgttgtctgacacaactgtgttcactagcaacctcaaacagacaccatggtgcatctgactcctgaggagaagtctgccgttactgccctgtggggcaaggtgaacgtggatgaagttggtggtgaggccctgggcgtcaattcctttatctacccttggacccagaggtcgactcggaccgatg

SEQ ID NO: 14944 - DNA, 203 bp, Homo sapiens
ggcgcgccagtcctggcgttgaacctgacacaactgtgttcactagcaacctcaaacagacaccatggtgcatctgactcctgaggagaagtctgccgttactgccctgtggggcaaggtgaacgtggatgaagttggtggtgaggccctgggcttcttggcaaaggtctacccttggaaccggccgtcgactcggaccgatg

SEQ ID NO: 14945 - DNA, 203 bp, Homo sapiens
ggcgcgccagtccttgtcgtgagcctgacacaactgtgttcactagcaacctcaaacagacaccatggtgcatctgactcctgaggagaagtctgccgttactgccctgtggggcaaggtgaacgtggatgaagttggtggtgaggccctgggtactcccctggtggtctaccccgtcaattcctttacgactcggaccgatg

SEQ ID NO: 14946 - DNA, 203 bp, Homo sapiens
ggcgcgccagtcctacacgacgaactgacacaactgtgttcactagcaacctcaaacagacaccatggtgcatctgactcctgaggagaagtctgccgttactgccctgtggggcaaggtgaacgtggatgaagttggtggtgaggcccttcttggcaaactggtggtctaccccacggaatcgagaacgactcggaccgatg

SEQ ID NO: 14947 - DNA, 203 bp, Homo sapiens
ggcgcgccagtcctcacgactgggctgacacaactgtgttcactagcaacctcaaacagacaccatggtgcatctgactcctgaggagaagtctgccgttactgccctgtggggcaaggtgaacgtggatgaagttggtggtgaggcccttcttggcaaactggtggtctacccttggacctactccccgactcggaccgatg

SEQ ID NO: 14948 - DNA, 203 bp, Homo sapiens
ggcgcgccagtcctacctgtcgtgctgacacaactgtgttcactagcaacctcaaacagacaccatggtgcatctgactcctgaggagaagtctgccgttactgccctgtggggcaaggtgaacgtggatgaagttggtggtgaggcgtcaattcctttactggtggtctaccccgtcaattcctttacgactcggaccgatg

SEQ ID NO: 14949 - DNA, 203 bp, Homo sapiens
ggcgcgccagtccttgcggtctttctgacacaactgtgttcactagcaacctcaaacagacaccatggtgcatctgactcctgaggagaagtctgccgttactgccctgtggggcaaggtgaacgtggatgaagttggtggtgaggcttcttggcaaatgctggtggtctacccttggaccggcgggtcgactcggaccgatg

SEQ ID NO: 14950 - DNA, 203 bp, Homo sapiens
ggcgcgccagtccttcgcggtctactgacacaactgtgttcactagcaacctcaaacagacaccatggtgcatctgactcctgaggagaagtctgccgttactgccctgtggggcaaggtgaacgtggatgaagttggtggtgaggtactccccaggctgctggtggtctaccccgtcaattcctttacgactcggaccgatg

SEQ ID NO: 14951 - DNA, 203 bp, Homo sapiens
ggcgcgccagtccttgcggttgcactgacacaactgtgttcactagcaacctcaaacagacaccatggtgcatctgactcctgaggagaagtctgccgttactgccctgtggggcaaggtgaacgtggatgaagttggtggtgagttcttggcaaagctgctggtggtctacccttgttcttggcaaacgactcggaccgatg

SEQ ID NO: 14952 - DNA, 203 bp, Homo sapiens
ggcgcgccagtcctgcggttaggtctgacacaactgtgttcactagcaacctcaaacagacaccatggtgcatctgactcctgaggagaagtctgccgttactgccctgtggggcaaggtgaacgtggatgaagttggtggtgatactcccggcaggctgctggtggtctacccttggaaccggccgtcgactcggaccgatg

SEQ ID NO: 14953 - DNA, 203 bp, Homo sapiens
ggcgcgccagtcctgcggtttgccctgacacaactgtgttcactagcaacctcaaacagacaccatggtgcatctgactcctgaggagaagtctgccgttactgccctgtggggcaaggtgaacgtggatgaagttggtggttactccctgggcaggctgctggtggtctacccttgttcttggcaaacgactcggaccgatg

SEQ ID NO: 14954 - DNA, 203 bp, Homo sapiens
ggcgcgccagtcctagttagcggtctgacacaactgtgttcactagcaacctcaaacagacaccatggtgcatctgactcctgaggagaagtctgccgttactgccctgtggggcaaggtgaacgtggatgaagttggtgtactccccctgggcaggctactcccggtctacccttggacccagaggtcgactcggaccgatg

SEQ ID NO: 14955 - DNA, 203 bp, Homo sapiens
ggcgcgccagtcctctgagcggtcctgacacaactgtgttcactagcaacctcaaacagacaccatggtgcatctgactcctgaggagaagtctgccgttactgccctgtggggcaaggtgaacgtggatgaagttggtgttcttggcaaaggcaggctgctggtggtctacccttggaaccggccgtcgactcggaccgatg

SEQ ID NO: 14956 - DNA, 203 bp, Homo sapiens
ggcgcgccagtcctcagcggtttcctgacacaactgtgttcactagcaacctcaaacagacaccatggtgcatctgactcctgaggagaagtctgccgttactgccctgtggggcaaggtgaacgtggatgaagttggtgttcttggcaaaggcaggctgctggtggtctacccttggaccggcgggtcgactcggaccgatg

SEQ ID NO: 14957 - DNA, 203 bp, Homo sapiens
ggcgcgccagtccttagaccgcatctgacacaactgtgttcactagcaacctcaaacagacaccatggtgcatctgactcctgaggagaagtctgccgttactgccctgtggggcaaggtgaacgtggatgaagttggttactcccccctgggcaggctgctggtggtctaccccacggaatcgagaacgactcggaccgatg

SEQ ID NO: 14958 - DNA, 203 bp, Homo sapiens
ggcgcgccagtccttaccgcttgactgacacaactgtgttcactagcaacctcaaacagacaccatggtgcatctgactcctgaggagaagtctgccgttactgccctgtggggcaaggtgaacgtggatgaagttggttactcccccctgggcaggctgctggtggtctacccttggacccagaggtcgactcggaccgatg

SEQ ID NO: 14959 - DNA, 203 bp, Homo sapiens
ggcgcgccagtccttaccgcaactctgacacaactgtgttcactagcaacctcaaacagacaccatggtgcatctgactcctgaggagaagtctgccgttactgccctgtggggcaaggtgaacgtggatgaagttggttcttggcaaatgggcaggctgctggtggtctacccttgttcttggcaaacgactcggaccgatg

SEQ ID NO: 14960 - DNA, 203 bp, Homo sapiens
ggcgcgccagtcctataccgcttcctgacacaactgtgttcactagcaacctcaaacagacaccatggtgcatctgactcctgaggagaagtctgccgttactgccctgtggggcaaggtgaacgtggatgaagttgtactcccggccctgggcaggctgctggtggtctacccttggaccggcgggtcgactcggaccgatg

SEQ ID NO: 14961 - DNA, 203 bp, Homo sapiens
ggcgcgccagtcctcgcaaccgcactgacacaactgtgttcactagcaacctcaaacagacaccatggtgcatctgactcctgaggagaagtctgccgttactgccctgtggggcaaggtgaacgtggatgaagtttcttggcaaaccctgggcaggctgctggtggtctaccccgtcaattcctttacgactcggaccgatg

SEQ ID NO: 14962 - DNA, 203 bp, Homo sapiens
ggcgcgccagtcctagtcaccgcgctgacacaactgtgttcactagcaacctcaaacagacaccatggtgcatctgactcctgaggagaagtctgccgttactgccctgtggggcaaggtgaacgtggatgacacggaatcgagaaccctgggcaggctgctggtggtctaccccgtcaattcctttacgactcggaccgatg

SEQ ID NO: 14963 - DNA, 203 bp, Homo sapiens
ggcgcgccagtcctcgaccgctttctgacacaactgtgttcactagcaacctcaaacagacaccatggtgcatctgactcctgaggagaagtctgccgttactgccctgtggggcaaggtgaacgtggatgacacggaatcgagaaccctgggcaggctgctggtggtctacccttggacctactccccgactcggaccgatg

SEQ ID NO: 14964 - DNA, 203 bp, Homo sapiens
ggcgcgccagtcctgtaccgcacactgacacaactgtgttcactagcaacctcaaacagacaccatggtgcatctgactcctgaggagaagtctgccgttactgccctgtggggcaaggtgaacgtggatgatactcccggtgaggccctgggcaggctgctggtggtctaccccgtcaattcctttacgactcggaccgatg

SEQ ID NO: 14965 - DNA, 203 bp, Homo sapiens
ggcgcgccagtccttagtgaccgcctgacacaactgtgttcactagcaacctcaaacagacaccatggtgcatctgactcctgaggagaagtctgccgttactgccctgtggggcaaggtgaacgtggatgatactcccggtgaggccctgggcaggctgctggtggtctacccttggacctactccccgactcggaccgatg

SEQ ID NO: 14966 - DNA, 203 bp, Homo sapiens
ggcgcgccagtcctccattctgcactgacacaactgtgttcactagcaacctcaaacagacaccatggtgcatctgactcctgaggagaagtctgccgttactgccctgtggggcaaggtgaacgtggccggcgggtgtggtgaggccctgggcaggctgctggtggtctacccttggaccggcgggtcgactcggaccgatg

SEQ ID NO: 14967 - DNA, 203 bp, Homo sapiens
ggcgcgccagtcctccagaatgacctgacacaactgtgttcactagcaacctcaaacagacaccatggtgcatctgactcctgaggagaagtctgccgttactgccctgtggggcaaggtgaacgtggtactccctggtggtgaggccctgggcaggctgctggtggtctacccttgttcttggcaaacgactcggaccgatg

SEQ ID NO: 14968 - DNA, 203 bp, Homo sapiens
ggcgcgccagtcctgtacacacagctgacacaactgtgttcactagcaacctcaaacagacaccatggtgcatctgactcctgaggagaagtctgccgttactgccctgtggggcaaggtgaacgtggttcttggcaaaggtgaggccctgggcaggctgctggtggtctacccttggacctactccccgactcggaccgatg

SEQ ID NO: 14969 - DNA, 203 bp, Homo sapiens
ggcgcgccagtccttttgaattcgctgacacaactgtgttcactagcaacctcaaacagacaccatggtgcatctgactcctgaggagaagtctgccgttactgccctgtggggcaaggtgaacgtttcttggcaaagtggtgaggccctgggcaggctgctggtggtctacccttggaaccggccgtcgactcggaccgatg

SEQ ID NO: 14970 - DNA, 203 bp, Homo sapiens
ggcgcgccagtccttaaagtctacctgacacaactgtgttcactagcaacctcaaacagacaccatggtgcatctgactcctgaggagaagtctgccgttactgccctgtggggcaaggtgacacggaatcgagaaggtgcacggaatcgagaaaggccacggaatcgagaaccttggacccagaggtcgactcggaccgatg

SEQ ID NO: 14971 - DNA, 203 bp, Homo sapiens
ggcgcgccagtcctgtcaaagtctctgacacaactgtgttcactagcaacctcaaacagacaccatggtgcatctgactcctgaggagaagtctgccgttactgccctgtggggcaaggtgacacggaatcgagaaggtgcacggaatcgagaaaggctgctggtggtctacccttggacccagaggtcgactcggaccgatg

SEQ ID NO: 14972 - DNA, 203 bp, Homo sapiens
ggcgcgccagtcctgctgaagtctctgacacaactgtgttcactagcaacctcaaacagacaccatggtgcatctgactcctgaggagaagtctgccgttactgccctgtggggcaaggtgacacggaatcgagaaggtggtgaggccctgggcaggctgctggtggtctacccttggacccagaggtcgactcggaccgatg

SEQ ID NO: 14973 - DNA, 203 bp, Homo sapiens
ggcgcgccagtcctcaagtctacactgacacaactgtgttcactagcaacctcaaacagacaccatggtgcatctgactcctgaggagaagtctgccgttactgccctgtggggcaaggtgaccggccgtgaagttggtggtgaggccctgggcaggctgctggtggtctacccttggaccggcgggtcgactcggaccgatg

SEQ ID NO: 14974 - DNA, 203 bp, Homo sapiens
ggcgcgccagtcctagctagacttctgacacaactgtgttcactagcaacctcaaacagacaccatggtgcatctgactcctgaggagaagtctgccgttactgccctgtggggcaaggtgaccggcgggtaagttggtgccggcgggttgggcaggcccggcgggttctacccttccggcgggtggtcgactcggaccgatg

SEQ ID NO: 14975 - DNA, 203 bp, Homo sapiens
ggcgcgccagtcctgggtacgcttctgacacaactgtgttcactagcaacctcaaacagacaccatggtgcatctgactcctgaggagaagtctgccgttactgccctgtggggcaaggtgaccggcgggtaagttggtgccggcgggttgggcaggcccggcgggttctacccttccggcgggtggtcgactcggaccgatg

SEQ ID NO: 14976 - DNA, 203 bp, Homo sapiens
ggcgcgccagtccttgagtacgccctgacacaactgtgttcactagcaacctcaaacagacaccatggtgcatctgactcctgaggagaagtctgccgttactgccctgtggggcaaggtgaccggcgggtaagttggtgccggcgggttgggcaggctgctggtggtctacccttccggcgggtggtcgactcggaccgatg

SEQ ID NO: 14977 - DNA, 203 bp, Homo sapiens
ggcgcgccagtccttagagtgtgactgacacaactgtgttcactagcaacctcaaacagacaccatggtgcatctgactcctgaggagaagtctgccgttactgccctgtggggcaaggtgaccggcgggtaagttggtggtgaggccctgggcaggcccggcgggttctacccttccggcgggtggtcgactcggaccgatg

SEQ ID NO: 14978 - DNA, 203 bp, Homo sapiens
ggcgcgccagtcctattgcggtggctgacacaactgtgttcactagcaacctcaaacagacaccatggtgcatctgactcctgaggagaagtctgccgttactgccctgtggggcaaggtgatactccctgaagttggtgtactccccctgggcaggctactcccggtctacccttggacccagaggtcgactcggaccgatg

SEQ ID NO: 14979 - DNA, 203 bp, Homo sapiens
ggcgcgccagtcctaattgaacgtctgacacaactgtgttcactagcaacctcaaacagacaccatggtgcatctgactcctgaggagaagtctgccgttactgccctgtggggcaaggtgatactccctgaagttggtgtactccccctgggcaggctgctggtggtctacccttggacccagaggtcgactcggaccgatg

SEQ ID NO: 14980 - DNA, 203 bp, Homo sapiens
ggcgcgccagtcctgctcattgacctgacacaactgtgttcactagcaacctcaaacagacaccatggtgcatctgactcctgaggagaagtctgccgttactgccctgtggggcaaggtgattcttggcaaagttggtggtgaggccctgggcaggctgctggtggtctacccttggacccagaggtcgactcggaccgatg

SEQ ID NO: 14981 - DNA, 203 bp, Homo sapiens
ggcgcgccagtcctcaattctcgtctgacacaactgtgttcactagcaacctcaaacagacaccatggtgcatctgactcctgaggagaagtctgccgttactgccctgtggggcaaggtgcacggaatcgagaatggtggtgaggccctgggcaggctgctggtggtctacccttgttcttggcaaacgactcggaccgatg

SEQ ID NO: 14982 - DNA, 203 bp, Homo sapiens
ggcgcgccagtcctttcattgcagctgacacaactgtgttcactagcaacctcaaacagacaccatggtgcatctgactcctgaggagaagtctgccgttactgccctgtggggcaaggtgcgtcaattcctttatggtggtgaggccctgggcaggctgctggtggtctacccttgttcttggcaaacgactcggaccgatg

SEQ ID NO: 14983 - DNA, 203 bp, Homo sapiens
ggcgcgccagtcctggtgatcaatctgacacaactgtgttcactagcaacctcaaacagacaccatggtgcatctgactcctgaggagaagtctgccgttactgccctgtggggcaaggtgtactcccatgaagttggtggtgaggccctgggcaggctgctggtggtctacccttgttcttggcaaacgactcggaccgatg

SEQ ID NO: 14984 - DNA, 203 bp, Homo sapiens
ggcgcgccagtcctatcagaattgctgacacaactgtgttcactagcaacctcaaacagacaccatggtgcatctgactcctgaggagaagtctgccgttactgccctgtggggcaaggtgttcttggcaaaagttggtggtgaggccctgggcaggctgctggtggtctaccccgtcaattcctttacgactcggaccgatg

SEQ ID NO: 14985 - DNA, 203 bp, Homo sapiens
ggcgcgccagtcctggtcaattcgctgacacaactgtgttcactagcaacctcaaacagacaccatggtgcatctgactcctgaggagaagtctgccgttactgccctgtggggcaagtactccctggatgaagttggtggtgaggccctgggcaggctgctggtggtctaccccgtcaattcctttacgactcggaccgatg

SEQ ID NO: 14986 - DNA, 203 bp, Homo sapiens
ggcgcgccagtcctacttcaattcctgacacaactgtgttcactagcaacctcaaacagacaccatggtgcatctgactcctgaggagaagtctgccgttactgccctgtggggcaagtactccctggatgaagttggtggtgaggccctgggcaggctgctggtggtctacccttggacccagaggtcgactcggaccgatg

SEQ ID NO: 14987 - DNA, 203 bp, Homo sapiens
ggcgcgccagtcctgaggattgatctgacacaactgtgttcactagcaacctcaaacagacaccatggtgcatctgactcctgaggagaagtctgccgttactgccctgtggggcaattcttggcaaaatgaagttggtggtgaggccctgggcaggctgctggtggtctacccttgttcttggcaaacgactcggaccgatg

SEQ ID NO: 14988 - DNA, 203 bp, Homo sapiens
ggcgcgccagtcctacaatctaagctgacacaactgtgttcactagcaacctcaaacagacaccatggtgcatctgactcctgaggagaagtctgccgttactgccctgtggggcacacggaatcgagaagaagttggtggtgaggccctgggcaggctgctggtggtctacccttggaaccggccgtcgactcggaccgatg

SEQ ID NO: 14989 - DNA, 203 bp, Homo sapiens
ggcgcgccagtcctccacattgatctgacacaactgtgttcactagcaacctcaaacagacaccatggtgcatctgactcctgaggagaagtctgccgttactgccctgtggggcacacggaatcgagaagaagttggtggtgaggccctgggcaggctgctggtggtctacccttggaccggcgggtcgactcggaccgatg

SEQ ID NO: 14990 - DNA, 203 bp, Homo sapiens
ggcgcgccagtcctctcagcaatgctgacacaactgtgttcactagcaacctcaaacagacaccatggtgcatctgactcctgaggagaagtctgccgttactgccctgtggggcacgtcaattcctttagaagttggtggtgaggccctgggcaggctgctggtggtctacccttggaccggcgggtcgactcggaccgatg

SEQ ID NO: 14991 - DNA, 203 bp, Homo sapiens
ggcgcgccagtcctaacgatcaatctgacacaactgtgttcactagcaacctcaaacagacaccatggtgcatctgactcctgaggagaagtctgccgttactgccctgtggttcttggcaaacgtggatgaagttggtggtgaggccctgggcaggctgctggtggtctacccttggaccggcgggtcgactcggaccgatg

SEQ ID NO: 14992 - DNA, 203 bp, Homo sapiens
ggcgcgccagtccttctgattgctctgacacaactgtgttcactagcaacctcaaacagacaccatggtgcatctgactcctgaggagaagtctgccgttactgccctgtgtactcccgtgaacgtggatgaagttggtggtgaggccctgggcaggctgctggtggtctaccccacggaatcgagaacgactcggaccgatg

SEQ ID NO: 14993 - DNA, 203 bp, Homo sapiens
ggcgcgccagtccttcgctcaatgctgacacaactgtgttcactagcaacctcaaacagacaccatggtgcatctgactcctgaggagaagtctgccgttactgccctgtgtactcccgtgaacgtggatgaagttggtggtgaggccctgggcaggctgctggtggtctaccccgtcaattcctttacgactcggaccgatg

SEQ ID NO: 14994 - DNA, 203 bp, Homo sapiens
ggcgcgccagtcctttcattgattctgacacaactgtgttcactagcaacctcaaacagacaccatggtgcatctgactcctgaggagaagtctgccgttactgccctgtgtactcccgtgaacgtggatgaagttggtggtgaggccctgggcaggctgctggtggtctacccttggacccagaggtcgactcggaccgatg

SEQ ID NO: 14995 - DNA, 203 bp, Homo sapiens
ggcgcgccagtcctactgtattgcctgacacaactgtgttcactagcaacctcaaacagacaccatggtgcatctgactcctgaggagaagtctgccgttactgccctgtgtactccggtgaacgtggatgaagttggtggtgaggccctgggcaggctgctggtggtctacccttggacccagaggtcgactcggaccgatg

SEQ ID NO: 14996 - DNA, 203 bp, Homo sapiens
ggcgcgccagtcctcagagcaattctgacacaactgtgttcactagcaacctcaaacagacaccatggtgcatctgactcctgaggagaagtctgccgttactgcccttcttggcaaagtgaacgtggatgaagttggtggtgaggccctgggcaggctgctggtggtctaccccacggaatcgagaacgactcggaccgatg

SEQ ID NO: 14997 - DNA, 203 bp, Homo sapiens
ggcgcgccagtcctcgcaatactcctgacacaactgtgttcactagcaacctcaaacagacaccatggtgcatctgactcctgaggagaagtctgccgttactgccggcgggtgcaaggtgaacgtggatgaagttggtggtgaggccctgggcaggcccggcgggttctacccttccggcgggtggtcgactcggaccgatg

SEQ ID NO: 14998 - DNA, 203 bp, Homo sapiens
ggcgcgccagtcctgatcgattgtctgacacaactgtgttcactagcaacctcaaacagacaccatggtgcatctgactcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 14999 - DNA, 203 bp, Homo sapiens
ggcgcgccagtcctacattgaggtctgacacaactgtgttcactagcaacctcaaacagacaccatggtgcatctgactcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 15000 - DNA, 203 bp, Homo sapiens
ggcgcgccagtcctattgatcacactgacacaactgtgttcactagcaacctcaaacagacaccatggtgcatctgactcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 15001 - DNA, 203 bp, Homo sapiens
ggcgcgccagtcctcagcattgttctgacacaactgtgttcactagcaacctcaaacagacaccatggtgcatctgactcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 15002 - DNA, 203 bp, Homo sapiens
ggcgcgccagtccttattgcatttctgacacaactgtgttcactagcaacctcaaacagacaccatggtgcatctgactcctgaggagaagtctgccgttactgccggcgggtgcaaggtgaccggcgggtaagttggtgccggcgggttgggcaggctgctggtggtctacccttggacccagaggtcgactcggaccgatg

SEQ ID NO: 15003 - DNA, 203 bp, Homo sapiens
ggcgcgccagtcctacttgcaatgctgacacaactgtgttcactagcaacctcaaacagacaccatggtgcatctgactcctgaggagaagtctgccgttactgcgtcaattcctttagtgaacgtggatgaagttggtgcgtcaattcctttaaggctgctggtggtctacccttggacccagaggtcgactcggaccgatg

SEQ ID NO: 15004 - DNA, 203 bp, Homo sapiens
ggcgcgccagtcctggtattgccactgacacaactgtgttcactagcaacctcaaacagacaccatggtgcatctgactcctgaggagaagtctgccgttactgcgtcaattcctttagtgaacgtggatgaagttggtggtgaggccctgggcaggctgctggtggtctaccccgtcaattcctttacgactcggaccgatg

SEQ ID NO: 15005 - DNA, 203 bp, Homo sapiens
ggcgcgccagtcctttacacattgctgacacaactgtgttcactagcaacctcaaacagacaccatggtgcatctgactcctgaggagaagtctgccgttactgcgtcaattcctttagtgaacgtggatgaagttggtggtgaggccctgggcaggctgctggtggtctacccttggacccagaggtcgactcggaccgatg

SEQ ID NO: 15006 - DNA, 203 bp, Homo sapiens
ggcgcgccagtcctgggtcaattcctgacacaactgtgttcactagcaacctcaaacagacaccatggtgcatctgactcctgaggagaagtctgccgttactgcgtcaattcctttagtgacgtcaattcctttaggtggtgaggccctgggcaggctgctggtggtctacccttggacccagaggtcgactcggaccgatg

SEQ ID NO: 15007 - DNA, 203 bp, Homo sapiens
ggcgcgccagtccttgcattgagactgacacaactgtgttcactagcaacctcaaacagacaccatggtgcatctgactcctgaggagaagtctgccgttactgtactcccgggcaaggtgaacgtggatgaagttggtggtgaggccctgggcaggctactcccggtctacccttggacccagaggtcgactcggaccgatg

SEQ ID NO: 15008 - DNA, 203 bp, Homo sapiens
ggcgcgccagtccttcaatttgaactgacacaactgtgttcactagcaacctcaaacagacaccatggtgcatctgactcctgaggagaagtctgccgttactgtactcccgggcaaggtgaacgtggatgaagttggtggtgaggccctgggcaggctactcccggtctaccctttactcccgaggtcgactcggaccgatg

SEQ ID NO: 15009 - DNA, 203 bp, Homo sapiens
ggcgcgccagtcctaacagcaatactgacacaactgtgttcactagcaacctcaaacagacaccatggtgcatctgactcctgaggagaagtctgccgttactgtactcccgggcaaggtgaacgtggatgaagttggtggtgaggccctgggcaggctgctggtggtctaccccacggaatcgagaacgactcggaccgatg

SEQ ID NO: 15010 - DNA, 203 bp, Homo sapiens
ggcgcgccagtcctgcaatctcttctgacacaactgtgttcactagcaacctcaaacagacaccatggtgcatctgactcctgaggagaagtctgccgttactgtactcccgggcaaggtgaacgtggatgaagttggtggtgaggccctgggcaggctgctggtggtctacccttggacctactccccgactcggaccgatg

SEQ ID NO: 15011 - DNA, 203 bp, Homo sapiens
ggcgcgccagtcctcaatcgttgcctgacacaactgtgttcactagcaacctcaaacagacaccatggtgcatctgactcctgaggagaagtctgccgttactgtactcccgggcaaggtgaacgtggatgaagttggtgtactccccctgggcaggctactcccggtctaccctttactcccgaggtcgactcggaccgatg

SEQ ID NO: 15012 - DNA, 203 bp, Homo sapiens
ggcgcgccagtcctattgcaacgcctgacacaactgtgttcactagcaacctcaaacagacaccatggtgcatctgactcctgaggagaagtctgccgttactgtactcccgggcaaggtgatactccctgaagttggtggtgaggccctgggcaggctactcccggtctaccctttactcccgaggtcgactcggaccgatg

SEQ ID NO: 15013 - DNA, 203 bp, Homo sapiens
ggcgcgccagtccttagtccattgctgacacaactgtgttcactagcaacctcaaacagacaccatggtgcatctgactcctgaggagaagtctgccgttactgtactcccgggcaaggtgatactccctgaagttggtgtactccccctgggcaggctactcccggtctaccctttactcccgaggtcgactcggaccgatg

SEQ ID NO: 15014 - DNA, 203 bp, Homo sapiens
ggcgcgccagtcctcctgattgtcctgacacaactgtgttcactagcaacctcaaacagacaccatggtgcatctgactcctgaggagaagtctgccgttactgtactcccgggcaaggtgatactccctgaagttggtgtactccccctgggcaggctgctggtggtctaccctttactcccgaggtcgactcggaccgatg

SEQ ID NO: 15015 - DNA, 203 bp, Homo sapiens
ggcgcgccagtcctgtcgtaagagctgacacaactgtgttcactagcaacctcaaacagacaccatggtgcatctgactcctgaggagaagtctgccgttactgttcttggcaaaaaggtgattcttggcaaagttggtgttcttggcaaaggcaggctgctggtggtctacccttggacccagaggtcgactcggaccgatg

SEQ ID NO: 15016 - DNA, 203 bp, Homo sapiens
ggcgcgccagtcctgtattcgtaactgacacaactgtgttcactagcaacctcaaacagacaccatggtgcatctgactcctgaggagaagtctgccgttactgttcttggcaaaaaggtgattcttggcaaagttggtgttcttggcaaaggcaggcttcttggcaaatacccttggacccagaggtcgactcggaccgatg

SEQ ID NO: 15017 - DNA, 203 bp, Homo sapiens
ggcgcgccagtcctttcgtaacccctgacacaactgtgttcactagcaacctcaaacagacaccatggtgcatctgactcctgaggagaagtctgccgttactgtttgccaagaaaaggtgatttgccaagaagttggtgtttgccaagaaggcaggctttgccaagaatacccttggacccagaggtcgactcggaccgatg

SEQ ID NO: 15018 - DNA, 203 bp, Homo sapiens
ggcgcgccagtcctacgttcgtaactgacacaactgtgttcactagcaacctcaaacagacaccatggtgcatctgactcctgaggagaagtctgccgttacttcactgtaccggccgtgcgtactggatgaagttggtggtgaggccctgggcaggctgctggtggtctacccttggacccagaggtcgactcggaccgatg

SEQ ID NO: 15019 - DNA, 203 bp, Homo sapiens
ggcgcgccagtcctgggtcgtaaactgacacaactgtgttcactagcaacctcaaacagacaccatggtgcatctgactcctgaggagaagtctgccgttacttgcaaccatactccccccggaatggatgaagttggtggtgaggccctgggcaggctgctggtggtctacccttggacccagaggtcgactcggaccgatg

SEQ ID NO: 15020 - DNA, 203 bp, Homo sapiens
ggcgcgccagtcctcttacgacgactgacacaactgtgttcactagcaacctcaaacagacaccatggtgcatctgactcctgaggagaagtctgccgttcgtcaattcctttacaaggtgaacgtggatgaagttggtggtgaggccctgggcaggctgctggtggtctacccttgttcttggcaaacgactcggaccgatg

SEQ ID NO: 15021 - DNA, 203 bp, Homo sapiens
ggcgcgccagtcctagtatcgacgctgacacaactgtgttcactagcaacctcaaacagacaccatggtgcatctgactcctgaggagaagtctgccgttgcccttccgtcaattcctttaagtttcaatgaagttggtggtgaggccctgggcaggctgctggtggtctacccttggacccagaggtcgactcggaccgatg

SEQ ID NO: 15022 - DNA, 203 bp, Homo sapiens
ggcgcgccagtcctacgtcgactcctgacacaactgtgttcactagcaacctcaaacagacaccatggtgcatctgactcctgaggagaagtctgccgtttactccctgtggggcaaggtgaacgtggatgaagttggtggtgaggccctgggcaggctgctggtggtctacccttgttcttggcaaacgactcggaccgatg

SEQ ID NO: 15023 - DNA, 203 bp, Homo sapiens
ggcgcgccagtcctaagcaaggttctgacacaactgtgttcactagcaacctcaaacagacaccatggtgcatctgactcctgaggagaagtctgcctactcccccctgtggggcaaggtgaacgtggatgaagttggtggtgaggccctgggcaggctgctggtggtctaccccacggaatcgagaacgactcggaccgatg

SEQ ID NO: 15024 - DNA, 203 bp, Homo sapiens
ggcgcgccagtcctacagaagcaactgacacaactgtgttcactagcaacctcaaacagacaccatggtgcatctgactcctgaggagaagtctgcctcccggaagctgcccggcgggtcatgggaataacaagttggtggtgaggccctgggcaggctgctggtggtctacccttggacccagaggtcgactcggaccgatg

SEQ ID NO: 15025 - DNA, 203 bp, Homo sapiens
ggcgcgccagtcctccaagcaatcctgacacaactgtgttcactagcaacctcaaacagacaccatggtgcatctgactcctgaggagaagtctgcgcaccaccacccacggaatcgagaaagagctatcaaagttggtggtgaggccctgggcaggctgctggtggtctacccttggacccagaggtcgactcggaccgatg

SEQ ID NO: 15026 - DNA, 203 bp, Homo sapiens
ggcgcgccagtccttattgcttggctgacacaactgtgttcactagcaacctcaaacagacaccatggtgcatctgactcctgaggagaagtctgctcagctttgcaaccatactccccccggaacccaaagagttggtggtgaggccctgggcaggctgctggtggtctacccttggacccagaggtcgactcggaccgatg

SEQ ID NO: 15027 - DNA, 203 bp, Homo sapiens
ggcgcgccagtcctaatttgcttactgacacaactgtgttcactagcaacctcaaacagacaccatggtgcatctgactcctgaggagaagtctgctggtgcccttccgtcaattcctttaagtttcagcttagttggtggtgaggccctgggcaggctgctggtggtctacccttggacccagaggtcgactcggaccgatg

SEQ ID NO: 15028 - DNA, 203 bp, Homo sapiens
ggcgcgccagtcctccttgcttcactgacacaactgtgttcactagcaacctcaaacagacaccatggtgcatctgactcctgaggagaagtctgcttcccggaagctgcccggcgggtcatgggaataacgagttggtggtgaggccctgggcaggctgctggtggtctacccttggacccagaggtcgactcggaccgatg

SEQ ID NO: 15029 - DNA, 203 bp, Homo sapiens
ggcgcgccagtcctatgattgcttctgacacaactgtgttcactagcaacctcaaacagacaccatggtgcatctgactcctgaggagaagtctgcttcttggcaaatgtggggcaaggtgaacgtggatgaagttggtggtgaggccctgggcaggctgctggtggtctacccttgttcttggcaaacgactcggaccgatg

SEQ ID NO: 15030 - DNA, 203 bp, Homo sapiens
ggcgcgccagtcctaagaaatggactgacacaactgtgttcactagcaacctcaaacagacaccatggtgcatctgactcctgaggagaagtcttcttggcaaaccctgtggggcaaggtgaacgtggatgaagttggtggtgaggccctgggcaggctgctggtggtctaccccacggaatcgagaacgactcggaccgatg

SEQ ID NO: 15031 - DNA, 203 bp, Homo sapiens
ggcgcgccagtccttgtactgcccctgacacaactgtgttcactagcaacctcaaacagacaccatggtgcatctgactcctgaggagaagtcttttcagctttgcaaccatactccccccggaacccaaagacttggtggtgaggccctgggcaggctgctggtggtctacccttggacccagaggtcgactcggaccgatg

SEQ ID NO: 15032 - DNA, 203 bp, Homo sapiens
ggcgcgccagtcctgggctcagcactgacacaactgtgttcactagcaacctcaaacagacaccatggtgcatctgactcctgaggagaatactcccgttactgccctgtggggcaaggtgaacgtggatgaagttggtggtgaggccctgggcaggctgctggtggtctaccccgtcaattcctttacgactcggaccgatg

SEQ ID NO: 15033 - DNA, 203 bp, Homo sapiens
ggcgcgccagtcctgggctacgtcctgacacaactgtgttcactagcaacctcaaacagacaccatggtgcatctgactcctgaggagaatcctggtggtgcccttccgtcaattcctttaagtttcagctttgcaactggtgaggccctgggcaggctgctggtggtctacccttggacccagaggtcgactcggaccgatg

SEQ ID NO: 15034 - DNA, 203 bp, Homo sapiens
ggcgcgccagtcctgggcagcactctgacacaactgtgttcactagcaacctcaaacagacaccatggtgcatctgactcctgaggagaattcttgattaatgaaaacattcttggcaaatgctttcgctctggtccgtggtgaggccctgggcaggctgctggtggtctacccttggacccagaggtcgactcggaccgatg

SEQ ID NO: 15035 - DNA, 203 bp, Homo sapiens
ggcgcgccagtcctaccacgttgtctgacacaactgtgttcactagcaacctcaaacagacaccatggtgcatctgactcctgaggagaccggccgtgttactgccctgtggggcaaggtgaacgtggatgaagttggtggtgaggccctgggcaggctgctggtggtctacccttggacccagaggtcgactcggaccgatg

SEQ ID NO: 15036 - DNA, 203 bp, Homo sapiens
ggcgcgccagtcctctgaaactctctgacacaactgtgttcactagcaacctcaaacagacaccatggtgcatctgactcctgaggagactcctggtggtgcccttccgtcaattcctttaagtttcagctttgcaaccagtgaggccctgggcaggctgctggtggtctacccttggacccagaggtcgactcggaccgatg

SEQ ID NO: 15037 - DNA, 203 bp, Homo sapiens
ggcgcgccagtcctatccacgaagctgacacaactgtgttcactagcaacctcaaacagacaccatggtgcatctgactcctgaggagactttggtttcccggaagctgcccggcgggtcatgggaataacgccgccgcatcgaggccctgggcaggctgctggtggtctacccttggacccagaggtcgactcggaccgatg

SEQ ID NO: 15038 - DNA, 203 bp, Homo sapiens
ggcgcgccagtccttccacgaagactgacacaactgtgttcactagcaacctcaaacagacaccatggtgcatctgactcctgaggagattaagtttcagctttgcaaccatactccccccggaacccaaagactttggggtgaggccctgggcaggctgctggtggtctacccttggacccagaggtcgactcggaccgatg

SEQ ID NO: 15039 - DNA, 203 bp, Homo sapiens
ggcgcgccagtcctagttcgtgttctgacacaactgtgttcactagcaacctcaaacagacaccatggtgcatctgactcctgaggagcacggaatcgagaatgccctgtggggcaaggtgaacgtggatgaagttggtggtgaggccctgggcaggctgctggtggtctacccttggaccggcgggtcgactcggaccgatg

SEQ ID NO: 15040 - DNA, 203 bp, Homo sapiens
ggcgcgccagtcctacgcactgcgctgacacaactgtgttcactagcaacctcaaacagacaccatggtgcatctgactcctgaggagctccctgccgttactgagctcccgggcaaggtgaagctccctgaagttggtgagctccccctgggcaggcagctcccggtctacccttggacccagaggtcgactcggaccgatg

SEQ ID NO: 15041 - DNA, 203 bp, Homo sapiens
ggcgcgccagtcctcttgctgcatctgacacaactgtgttcactagcaacctcaaacagacaccatggtgcatctgactcctgaggagggcgggtccgttactgagggcgggtgcaaggtgaagggcgggtaagttggtgagggcgggttgggcaggcagggcgggttctacccttggacccagaggtcgactcggaccgatg

SEQ ID NO: 15042 - DNA, 203 bp, Homo sapiens
ggcgcgccagtcctcttgttacacctgacacaactgtgttcactagcaacctcaaacagacaccatggtgcatctgactcctgaggagtactcccccgttactgccctgtggggcaaggtgaacgtggatgaagttggtggtgaggccctgggcaggctgctggtggtctacccttggaccggcgggtcgactcggaccgatg

SEQ ID NO: 15043 - DNA, 203 bp, Homo sapiens
ggcgcgccagtcctagtgtaagagctgacacaactgtgttcactagcaacctcaaacagacaccatggtgcatctgactcctgaggagtcaattcctttaactgagtcaattcctttagtgaagtcaattcctttaggtgagtcaattcctttaaggcagtcaattcctttaccttggacccagaggtcgactcggaccgatg

SEQ ID NO: 15044 - DNA, 203 bp, Homo sapiens
ggcgcgccagtcctcgagcgtatgctgacacaactgtgttcactagcaacctcaaacagacaccatggtgcatctgactcctgaggatcggccgtccgttactgatcggccgtgcaaggtgaatcggccgtaagttggtgatcggccgttgggcaggcatcggccgttctacccttggacccagaggtcgactcggaccgatg

SEQ ID NO: 15045 - DNA, 203 bp, Homo sapiens
ggcgcgccagtcctttcatacgctctgacacaactgtgttcactagcaacctcaaacagacaccatggtgcatctgactcctgaggatcgttcttgattaatgaaaacattcttggcaaatgctttcgctctggtccgtcttgaggccctgggcaggctgctggtggtctacccttggacccagaggtcgactcggaccgatg

SEQ ID NO: 15046 - DNA, 203 bp, Homo sapiens
ggcgcgccagtcctacagtacgggctgacacaactgtgttcactagcaacctcaaacagacaccatggtgcatctgactcctgaggattcaattcctttaactgattcaattcctttagtgaattcaattcctttaggtgattcaattcctttaaggcattcaattcctttaccttggacccagaggtcgactcggaccgatg

SEQ ID NO: 15047 - DNA, 203 bp, Homo sapiens
ggcgcgccagtcctcaccaacgggctgacacaactgtgttcactagcaacctcaaacagacaccatggtgcatctgactcctgaggcaacgaatcgagaaactgcaacgaatcgagaagtgacaacgaatcgagaaggtgcaacgaatcgagaaaggccaacgaatcgagaaccttggacccagaggtcgactcggaccgatg

SEQ ID NO: 15048 - DNA, 203 bp, Homo sapiens
ggcgcgccagtcctcccgtttggactgacacaactgtgttcactagcaacctcaaacagacaccatggtgcatctgactcctgaggcacagaatcgagaaactgcacagaatcgagaagtgacacagaatcgagaaggtgcacagaatcgagaaaggccacagaatcgagaaccttggacccagaggtcgactcggaccgatg

SEQ ID NO: 15049 - DNA, 203 bp, Homo sapiens
ggcgcgccagtcctagtcgacgggctgacacaactgtgttcactagcaacctcaaacagacaccatggtgcatctgactcctgaggcacgaaatcgagaaactgcacgaaatcgagaagtgacacgaaatcgagaaggtgcacgaaatcgagaaaggccacgaaatcgagaaccttggacccagaggtcgactcggaccgatg

SEQ ID NO: 15050 - DNA, 203 bp, Homo sapiens
ggcgcgccagtcctcccgttaaagctgacacaactgtgttcactagcaacctcaaacagacaccatggtgcatctgactcctgaggcacgatatcgagaaactgcacgatatcgagaagtgacacgatatcgagaaggtgcacgatatcgagaaaggccacgatatcgagaaccttggacccagaggtcgactcggaccgatg

SEQ ID NO: 15051 - DNA, 203 bp, Homo sapiens
ggcgcgccagtcctgcttctaactctgacacaactgtgttcactagcaacctcaaacagacaccatggtgcatctgactcctgaggcacggaaccgagaaactgcacggaaccgagaagtgacacggaaccgagaaggtgcacggaaccgagaaaggccacggaaccgagaaccttggacccagaggtcgactcggaccgatg

SEQ ID NO: 15052 - DNA, 203 bp, Homo sapiens
ggcgcgccagtcctttagaatggtctgacacaactgtgttcactagcaacctcaaacagacaccatggtgcatctgactcctgaggcacggaatcaagaaactgcacggaatcaagaagtgacacggaatcaagaaggtgcacggaatcaagaaaggccacggaatcaagaaccttggacccagaggtcgactcggaccgatg

SEQ ID NO: 15053 - DNA, 203 bp, Homo sapiens
ggcgcgccagtcctcgccttagaactgacacaactgtgttcactagcaacctcaaacagacaccatggtgcatctgactcctgaggcacggaatcgagaaactgcacggaatcgagaagtgaacgtggatgaagttggtgcacggaatcgagaaaggccacggaatcgagaaccttggacccagaggtcgactcggaccgatg

SEQ ID NO: 15054 - DNA, 203 bp, Homo sapiens
ggcgcgccagtcctttagaaacacctgacacaactgtgttcactagcaacctcaaacagacaccatggtgcatctgactcctgaggcacggaatcgagaaactgcacggaatcgagaagtgacacggaatcgagaaggtgcacggaatcgagaaaggccacggaatcgagaaccttggacccagaggtcgactcggaccgatg

SEQ ID NO: 15055 - DNA, 203 bp, Homo sapiens
ggcgcgccagtcctagtgtgtacgctgacacaactgtgttcactagcaacctcaaacagacaccatggtgcatctgactcctgaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 15056 - DNA, 203 bp, Homo sapiens
ggcgcgccagtcctagtgcacgtcctgacacaactgtgttcactagcaacctcaaacagacaccatggtgcatctgactcctgaggcacggaatcgagaaactgccctgtggggcaaggtgaacgtggatgaagttggtgcacggaatcgagaaaggccacggaatcgagaaccttggacccagaggtcgactcggaccgatg

SEQ ID NO: 15057 - DNA, 203 bp, Homo sapiens
ggcgcgccagtcctaaacaaggccctgacacaactgtgttcactagcaacctcaaacagacaccatggtgcatctgactcctgaggcacggaatcgagaaactgccctgtggggcaaggtgacacggaatcgagaaggtgcacggaatcgagaaaggctgctggtggtctacccttggacccagaggtcgactcggaccgatg

SEQ ID NO: 15058 - DNA, 203 bp, Homo sapiens
ggcgcgccagtcctatcatgcagtctgacacaactgtgttcactagcaacctcaaacagacaccatggtgcatctgactcctgaggcacggaatcgagagactgcacggaatcgagaggtgacacggaatcgagagggtgcacggaatcgagagaggccacggaatcgagagccttggacccagaggtcgactcggaccgatg

SEQ ID NO: 15059 - DNA, 203 bp, Homo sapiens
ggcgcgccagtcctgtaaagactgctgacacaactgtgttcactagcaacctcaaacagacaccatggtgcatctgactcctgaggcacggaatcgagctactgcacggaatcgagctgtgacacggaatcgagctggtgcacggaatcgagctaggccacggaatcgagctccttggacccagaggtcgactcggaccgatg

SEQ ID NO: 15060 - DNA, 203 bp, Homo sapiens
ggcgcgccagtcctggcctgggacctgacacaactgtgttcactagcaacctcaaacagacaccatggtgcatctgactcctgaggcacggaatcgaggcactgcacggaatcgaggcgtgacacggaatcgaggcggtgcacggaatcgaggcaggccacggaatcgaggcccttggacccagaggtcgactcggaccgatg

SEQ ID NO: 15061 - DNA, 203 bp, Homo sapiens
ggcgcgccagtcctatacgtgcttctgacacaactgtgttcactagcaacctcaaacagacaccatggtgcatctgactcctgaggcacggaatcgaggtactgcacggaatcgaggtgtgacacggaatcgaggtggtgcacggaatcgaggtaggccacggaatcgaggtccttggacccagaggtcgactcggaccgatg

SEQ ID NO: 15062 - DNA, 203 bp, Homo sapiens
ggcgcgccagtcctgtaaatgactctgacacaactgtgttcactagcaacctcaaacagacaccatggtgcatctgactcctgaggcacggaatcgcgaaactgcacggaatcgcgaagtgacacggaatcgcgaaggtgcacggaatcgcgaaaggccacggaatcgcgaaccttggacccagaggtcgactcggaccgatg

SEQ ID NO: 15063 - DNA, 203 bp, Homo sapiens
ggcgcgccagtccttaaatctctgctgacacaactgtgttcactagcaacctcaaacagacaccatggtgcatctgactcctgaggcacggaatcgggaaactgcacggaatcgggaagtgacacggaatcgggaaggtgcacggaatcgggaaaggccacggaatcgggaaccttggacccagaggtcgactcggaccgatg

SEQ ID NO: 15064 - DNA, 203 bp, Homo sapiens
ggcgcgccagtcctagatttaggactgacacaactgtgttcactagcaacctcaaacagacaccatggtgcatctgactcctgaggcacggaatcgtgaaactgcacggaatcgtgaagtgacacggaatcgtgaaggtgcacggaatcgtgaaaggccacggaatcgtgaaccttggacccagaggtcgactcggaccgatg

SEQ ID NO: 15065 - DNA, 203 bp, Homo sapiens
ggcgcgccagtcctcatttacttcctgacacaactgtgttcactagcaacctcaaacagacaccatggtgcatctgactcctgaggcacggaatggagaaactgcacggaatggagaagtgacacggaatggagaaggtgcacggaatggagaaaggccacggaatggagaaccttggacccagaggtcgactcggaccgatg

SEQ ID NO: 15066 - DNA, 203 bp, Homo sapiens
ggcgcgccagtcctctctaaatcgctgacacaactgtgttcactagcaacctcaaacagacaccatggtgcatctgactcctgaggcacggaattaagaaactgcacggaattaagaagtgacacggaattaagaaggtgcacggaattaagaaaggccacggaattaagaaccttggacccagaggtcgactcggaccgatg

SEQ ID NO: 15067 - DNA, 203 bp, Homo sapiens
ggcgcgccagtcctaatttaggacctgacacaactgtgttcactagcaacctcaaacagacaccatggtgcatctgactcctgaggcacggaattgagaaactgcacggaattgagaagtgacacggaattgagaaggtgcacggaattgagaaaggccacggaattgagaaccttggacccagaggtcgactcggaccgatg

SEQ ID NO: 15068 - DNA, 203 bp, Homo sapiens
ggcgcgccagtcctgaaagtgattctgacacaactgtgttcactagcaacctcaaacagacaccatggtgcatctgactcctgaggcacggccgtccgttactgcacggccgtgcaaggtgacacggccgtaagttggtgcacggccgttgggcaggccacggccgttctacccttggacccagaggtcgactcggaccgatg

SEQ ID NO: 15069 - DNA, 203 bp, Homo sapiens
ggcgcgccagtcctcgttcaagatctgacacaactgtgttcactagcaacctcaaacagacaccatggtgcatctgactcctgaggcacgggatcgagaaactgcacgggatcgagaagtgacacgggatcgagaaggtgcacgggatcgagaaaggccacgggatcgagaaccttggacccagaggtcgactcggaccgatg

SEQ ID NO: 15070 - DNA, 203 bp, Homo sapiens
ggcgcgccagtcctagatttggttctgacacaactgtgttcactagcaacctcaaacagacaccatggtgcatctgactcctgaggcactccctgccgttactgcactcccgggcaaggtgacactccctgaagttggtgcactccccctgggcaggccactcccggtctacccttggacccagaggtcgactcggaccgatg

SEQ ID NO: 15071 - DNA, 203 bp, Homo sapiens
ggcgcgccagtccttttaaccaacctgacacaactgtgttcactagcaacctcaaacagacaccatggtgcatctgactcctgaggcagagaatcgagaaactgcagagaatcgagaagtgacagagaatcgagaaggtgcagagaatcgagaaaggccagagaatcgagaaccttggacccagaggtcgactcggaccgatg

SEQ ID NO: 15072 - DNA, 203 bp, Homo sapiens
ggcgcgccagtcctccaaccaagtctgacacaactgtgttcactagcaacctcaaacagacaccatggtgcatctgactcctgaggcagcgaatcgagaaactgcagcgaatcgagaagtgacagcgaatcgagaaggtgcagcgaatcgagaaaggccagcgaatcgagaaccttggacccagaggtcgactcggaccgatg

SEQ ID NO: 15073 - DNA, 203 bp, Homo sapiens
ggcgcgccagtccttctgcgagcgctgacacaactgtgttcactagcaacctcaaacagacaccatggtgcatctgactcctgaggcatggaatcgagaaactgcatggaatcgagaagtgacatggaatcgagaaggtgcatggaatcgagaaaggccatggaatcgagaaccttggacccagaggtcgactcggaccgatg

SEQ ID NO: 15074 - DNA, 203 bp, Homo sapiens
ggcgcgccagtccttgcgaggacgctgacacaactgtgttcactagcaacctcaaacagacaccatggtgcatctgactcctgaggcattgaatcgagaaactgcattgaatcgagaagtgacattgaatcgagaaggtgcattgaatcgagaaaggccattgaatcgagaaccttggacccagaggtcgactcggaccgatg

SEQ ID NO: 15075 - DNA, 203 bp, Homo sapiens
ggcgcgccagtccttctttgcgagctgacacaactgtgttcactagcaacctcaaacagacaccatggtgcatctgactcctgaggccatcgggtccgttactgccatcgggtgcaaggtgaccatcgggtaagttggtgccatcgggttgggcaggcccatcgggttctacccttggacccagaggtcgactcggaccgatg

SEQ ID NO: 15076 - DNA, 203 bp, Homo sapiens
ggcgcgccagtcctggcgagctaactgacacaactgtgttcactagcaacctcaaacagacaccatggtgcatctgactcctgaggccctccctgccgttactgccctcccgggcaaggtgaccctccctgaagttggtgccctccccctgggcaggcccctcccggtctacccttggacccagaggtcgactcggaccgatg

SEQ ID NO: 15077 - DNA, 203 bp, Homo sapiens
ggcgcgccagtcctaagagcgagtctgacacaactgtgttcactagcaacctcaaacagacaccatggtgcatctgactcctgaggccctcgggtccgttactgccctcgggtgcaaggtgaccctcgggtaagttggtgccctcgggttgggcaggcccctcgggttctacccttggacccagaggtcgactcggaccgatg

SEQ ID NO: 15078 - DNA, 203 bp, Homo sapiens
ggcgcgccagtcctgcctgcgagcctgacacaactgtgttcactagcaacctcaaacagacaccatggtgcatctgactcctgaggccgacgggtccgttactgccgacgggtgcaaggtgaccgacgggtaagttggtgccgacgggttgggcaggcccgacgggttctacccttggacccagaggtcgactcggaccgatg

SEQ ID NO: 15079 - DNA, 203 bp, Homo sapiens
ggcgcgccagtcctgtgctgcgagctgacacaactgtgttcactagcaacctcaaacagacaccatggtgcatctgactcctgaggccggaaggtccgttactgccggaaggtgcaaggtgaccggaaggtaagttggtgccggaaggttgggcaggcccggaaggttctacccttggacccagaggtcgactcggaccgatg

SEQ ID NO: 15080 - DNA, 203 bp, Homo sapiens
ggcgcgccagtcctctcgcaaactctgacacaactgtgttcactagcaacctcaaacagacaccatggtgcatctgactcctgaggccggatggtccgttactgccggatggtgcaaggtgaccggatggtaagttggtgccggatggttgggcaggcccggatggttctacccttggacccagaggtcgactcggaccgatg

SEQ ID NO: 15081 - DNA, 203 bp, Homo sapiens
ggcgcgccagtcctgtgacctcgcctgacacaactgtgttcactagcaacctcaaacagacaccatggtgcatctgactcctgaggccggcaggtccgttactgccggcaggtgcaaggtgaccggcaggtaagttggtgccggcaggttgggcaggcccggcaggttctacccttggacccagaggtcgactcggaccgatg

SEQ ID NO: 15082 - DNA, 203 bp, Homo sapiens
ggcgcgccagtccttcactcgcatctgacacaactgtgttcactagcaacctcaaacagacaccatggtgcatctgactcctgaggccggcgcatccgttactgccggcgcatgcaaggtgaccggcgcataagttggtgccggcgcattgggcaggcccggcgcattctacccttggacccagaggtcgactcggaccgatg

SEQ ID NO: 15083 - DNA, 203 bp, Homo sapiens
ggcgcgccagtcctaggcctcgccctgacacaactgtgttcactagcaacctcaaacagacaccatggtgcatctgactcctgaggccggcgcctccgttactgccggcgcctgcaaggtgaccggcgcctaagttggtgccggcgccttgggcaggcccggcgccttctacccttggacccagaggtcgactcggaccgatg

SEQ ID NO: 15084 - DNA, 203 bp, Homo sapiens
ggcgcgccagtcctcctctcgctcctgacacaactgtgttcactagcaacctcaaacagacaccatggtgcatctgactcctgaggccggcgcgtccgttactgccggcgcgtgcaaggtgaccggcgcgtaagttggtgccggcgcgttgggcaggcccggcgcgttctacccttggacccagaggtcgactcggaccgatg

SEQ ID NO: 15085 - DNA, 203 bp, Homo sapiens
ggcgcgccagtcctcccgtctcgcctgacacaactgtgttcactagcaacctcaaacagacaccatggtgcatctgactcctgaggccggcggaaccgttactgccggcggaagcaaggtgaccggcggaaaagttggtgccggcggaatgggcaggcccggcggaatctacccttggacccagaggtcgactcggaccgatg

SEQ ID NO: 15086 - DNA, 203 bp, Homo sapiens
ggcgcgccagtcctctactcgcagctgacacaactgtgttcactagcaacctcaaacagacaccatggtgcatctgactcctgaggccggcggccccgttactgccggcggccgcaaggtgaccggcggccaagttggtgccggcggcctgggcaggcccggcggcctctacccttggacccagaggtcgactcggaccgatg

SEQ ID NO: 15087 - DNA, 203 bp, Homo sapiens
ggcgcgccagtcctcccagacgacctgacacaactgtgttcactagcaacctcaaacagacaccatggtgcatctgactcctgaggccggcgggtccgttactgccctgtggggcaaggtgaacgtggatgaagttggtggtgaggccctgggcaggctgctggtggtctacccttggaaccggccgtcgactcggaccgatg

SEQ ID NO: 15088 - DNA, 203 bp, Homo sapiens
ggcgcgccagtcctcccagagccactgacacaactgtgttcactagcaacctcaaacagacaccatggtgcatctgactcctgaggccggcgggtccgttactgccctgtggggcaaggtgaccggcgggtaagttggtgccggcgggttgggcaggcccggcgggttctacccttggacccagaggtcgactcggaccgatg

SEQ ID NO: 15089 - DNA, 203 bp, Homo sapiens
ggcgcgccagtcctcggtgaccagctgacacaactgtgttcactagcaacctcaaacagacaccatggtgcatctgactcctgaggccggcgggtccgttactgccctgtggggcaaggtgaccggcgggtaagttggtggtgaggccctgggcaggctgctggtggtctacccttccggcgggtggtcgactcggaccgatg

SEQ ID NO: 15090 - DNA, 203 bp, Homo sapiens
ggcgcgccagtcctcggcggttgtctgacacaactgtgttcactagcaacctcaaacagacaccatggtgcatctgactcctgaggccggcgggtccgttactgccctgtggggcaaggtgaccggcgggtaagttggtggtgaggccctgggcaggctgctggtggtctacccttggacccagaggtcgactcggaccgatg

SEQ ID NO: 15091 - DNA, 203 bp, Homo sapiens
ggcgcgccagtcctcggtctgcccctgacacaactgtgttcactagcaacctcaaacagacaccatggtgcatctgactcctgaggccggcgggtccgttactgccggcgggtgcaaggtgaacgtggatgaagttggtggtgaggccctgggcaggcccggcgggttctacccttggacccagaggtcgactcggaccgatg

SEQ ID NO: 15092 - DNA, 203 bp, Homo sapiens
ggcgcgccagtcctgcaaggaccgctgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15093 - DNA, 203 bp, Homo sapiens
ggcgcgccagtcctgtacgtagcgctgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15094 - DNA, 203 bp, Homo sapiens
ggcgcgccagtccttgttaagtgactgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15095 - DNA, 203 bp, Homo sapiens
ggcgcgccagtccttttaaggatactgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15096 - DNA, 203 bp, Homo sapiens
ggcgcgccagtcctgtttaagacactgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15097 - DNA, 203 bp, Homo sapiens
ggcgcgccagtcctcgacttaaagctgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15098 - DNA, 203 bp, Homo sapiens
ggcgcgccagtcctcttaaagtttctgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15099 - DNA, 203 bp, Homo sapiens
ggcgcgccagtcctatgctgcagactgacacaactgtgttcactagcaacctcaaacagacaccatggtgcatctgactcctgaggccggcggtaccgttactgccggcggtagcaaggtgaccggcggtaaagttggtgccggcggtatgggcaggcccggcggtatctacccttggacccagaggtcgactcggaccgatg

SEQ ID NO: 15100 - DNA, 203 bp, Homo sapiens
ggcgcgccagtcctgaatgtccaactgacacaactgtgttcactagcaacctcaaacagacaccatggtgcatctgactcctgaggccggcggtcccgttactgccggcggtcgcaaggtgaccggcggtcaagttggtgccggcggtctgggcaggcccggcggtctctacccttggacccagaggtcgactcggaccgatg

SEQ ID NO: 15101 - DNA, 203 bp, Homo sapiens
ggcgcgccagtcctcacgaaaggtctgacacaactgtgttcactagcaacctcaaacagacaccatggtgcatctgactcctgaggccggcgtctccgttactgccggcgtctgcaaggtgaccggcgtctaagttggtgccggcgtcttgggcaggcccggcgtcttctacccttggacccagaggtcgactcggaccgatg

SEQ ID NO: 15102 - DNA, 203 bp, Homo sapiens
ggcgcgccagtcctaatcacgaaactgacacaactgtgttcactagcaacctcaaacagacaccatggtgcatctgactcctgaggccggcgtgtccgttactgccggcgtgtgcaaggtgaccggcgtgtaagttggtgccggcgtgttgggcaggcccggcgtgttctacccttggacccagaggtcgactcggaccgatg

SEQ ID NO: 15103 - DNA, 203 bp, Homo sapiens
ggcgcgccagtcctgactttcgtgctgacacaactgtgttcactagcaacctcaaacagacaccatggtgcatctgactcctgaggccggcgtttccgttactgccggcgtttgcaaggtgaccggcgtttaagttggtgccggcgttttgggcaggcccggcgttttctacccttggacccagaggtcgactcggaccgatg

SEQ ID NO: 15104 - DNA, 203 bp, Homo sapiens
ggcgcgccagtcctcgatttcgtgctgacacaactgtgttcactagcaacctcaaacagacaccatggtgcatctgactcctgaggccggctggtccgttactgccggctggtgcaaggtgaccggctggtaagttggtgccggctggttgggcaggcccggctggttctacccttggacccagaggtcgactcggaccgatg

SEQ ID NO: 15105 - DNA, 203 bp, Homo sapiens
ggcgcgccagtcctacctggatcactgacacaactgtgttcactagcaacctcaaacagacaccatggtgcatctgactcctgaggccggggggtccgttactgccggggggtgcaaggtgaccggggggtaagttggtgccggggggttgggcaggcccggggggttctacccttggacccagaggtcgactcggaccgatg

SEQ ID NO: 15106 - DNA, 203 bp, Homo sapiens
ggcgcgccagtcctcttacatgtcctgacacaactgtgttcactagcaacctcaaacagacaccatggtgcatctgactcctgaggcctacgggtccgttactgcctacgggtgcaaggtgacctacgggtaagttggtgcctacgggttgggcaggccctacgggttctacccttggacccagaggtcgactcggaccgatg

SEQ ID NO: 15107 - DNA, 203 bp, Homo sapiens
ggcgcgccagtccttcttacatgcctgacacaactgtgttcactagcaacctcaaacagacaccatggtgcatctgactcctgaggcctcaattcctttaactgcctcaattcctttagtgacctcaattcctttaggtgcctcaattcctttaaggccctcaattcctttaccttggacccagaggtcgactcggaccgatg

SEQ ID NO: 15108 - DNA, 203 bp, Homo sapiens
ggcgcgccagtcctttacagatcactgacacaactgtgttcactagcaacctcaaacagacaccatggtgcatctgactcctgaggcctgcgggtccgttactgcctgcgggtgcaaggtgacctgcgggtaagttggtgcctgcgggttgggcaggccctgcgggttctacccttggacccagaggtcgactcggaccgatg

SEQ ID NO: 15109 - DNA, 203 bp, Homo sapiens
ggcgcgccagtccttctacagatcctgacacaactgtgttcactagcaacctcaaacagacaccatggtgcatctgactcctgaggccttcgggtccgttactgccttcgggtgcaaggtgaccttcgggtaagttggtgccttcgggttgggcaggcccttcgggttctacccttggacccagaggtcgactcggaccgatg

SEQ ID NO: 15110 - DNA, 203 bp, Homo sapiens
ggcgcgccagtcctagcattgcccctgacacaactgtgttcactagcaacctcaaacagacaccatggtgcatctgactcctgaggcgacaattcctttaactgcgacaattcctttagtgacgacaattcctttaggtgcgacaattcctttaaggccgacaattcctttaccttggacccagaggtcgactcggaccgatg

SEQ ID NO: 15111 - DNA, 203 bp, Homo sapiens
ggcgcgccagtcctgaagtactgtctgacacaactgtgttcactagcaacctcaaacagacaccatggtgcatctgactcctgaggcgcggaatcgagaaactgcgcggaatcgagaagtgacgcggaatcgagaaggtgcgcggaatcgagaaaggccgcggaatcgagaaccttggacccagaggtcgactcggaccgatg

SEQ ID NO: 15112 - DNA, 203 bp, Homo sapiens
ggcgcgccagtccttaggtgtagtctgacacaactgtgttcactagcaacctcaaacagacaccatggtgcatctgactcctgaggcgctccctgccgttactgcgctcccgggcaaggtgacgctccctgaagttggtgcgctccccctgggcaggccgctcccggtctacccttggacccagaggtcgactcggaccgatg

SEQ ID NO: 15113 - DNA, 203 bp, Homo sapiens
ggcgcgccagtcctgcttacacctctgacacaactgtgttcactagcaacctcaaacagacaccatggtgcatctgactcctgaggcgcttggcaaagttactgcgcttggcaaaaaggtgacgcttggcaaagttggtgcgcttggcaaaggcaggccgcttggcaaatacccttggacccagaggtcgactcggaccgatg

SEQ ID NO: 15114 - DNA, 203 bp, Homo sapiens
ggcgcgccagtcctgcatatgtggctgacacaactgtgttcactagcaacctcaaacagacaccatggtgcatctgactcctgaggcgtcaaagcctttaactgcgtcaaagcctttagtgacgtcaaagcctttaggtgcgtcaaagcctttaaggccgtcaaagcctttaccttggacccagaggtcgactcggaccgatg

SEQ ID NO: 15115 - DNA, 203 bp, Homo sapiens
ggcgcgccagtcctgatatcttacctgacacaactgtgttcactagcaacctcaaacagacaccatggtgcatctgactcctgaggcgtcaaatcctttaactgcgtcaaatcctttagtgacgtcaaatcctttaggtgcgtcaaatcctttaaggccgtcaaatcctttaccttggacccagaggtcgactcggaccgatg

SEQ ID NO: 15116 - DNA, 203 bp, Homo sapiens
ggcgcgccagtcctggcagaatatctgacacaactgtgttcactagcaacctcaaacagacaccatggtgcatctgactcctgaggcgtcaacacctttaactgcgtcaacacctttagtgacgtcaacacctttaggtgcgtcaacacctttaaggccgtcaacacctttaccttggacccagaggtcgactcggaccgatg

SEQ ID NO: 15117 - DNA, 203 bp, Homo sapiens
ggcgcgccagtcctatatcgtgccctgacacaactgtgttcactagcaacctcaaacagacaccatggtgcatctgactcctgaggcgtcaacccctttaactgcgtcaacccctttagtgacgtcaacccctttaggtgcgtcaacccctttaaggccgtcaacccctttaccttggacccagaggtcgactcggaccgatg

SEQ ID NO: 15118 - DNA, 203 bp, Homo sapiens
ggcgcgccagtcctgaatattgccctgacacaactgtgttcactagcaacctcaaacagacaccatggtgcatctgactcctgaggcgtcaacgcctttaactgcgtcaacgcctttagtgacgtcaacgcctttaggtgcgtcaacgcctttaaggccgtcaacgcctttaccttggacccagaggtcgactcggaccgatg

SEQ ID NO: 15119 - DNA, 203 bp, Homo sapiens
ggcgcgccagtccttgcatatcccctgacacaactgtgttcactagcaacctcaaacagacaccatggtgcatctgactcctgaggcgtcaagacctttaactgcgtcaagacctttagtgacgtcaagacctttaggtgcgtcaagacctttaaggccgtcaagacctttaccttggacccagaggtcgactcggaccgatg

SEQ ID NO: 15120 - DNA, 203 bp, Homo sapiens
ggcgcgccagtccttacaatatgcctgacacaactgtgttcactagcaacctcaaacagacaccatggtgcatctgactcctgaggcgtcaaggcctttaactgcgtcaaggcctttagtgacgtcaaggcctttaggtgcgtcaaggcctttaaggccgtcaaggcctttaccttggacccagaggtcgactcggaccgatg

SEQ ID NO: 15121 - DNA, 203 bp, Homo sapiens
ggcgcgccagtcctgatatgcgaactgacacaactgtgttcactagcaacctcaaacagacaccatggtgcatctgactcctgaggcgtcaatacctttaactgcgtcaatacctttagtgacgtcaatacctttaggtgcgtcaatacctttaaggccgtcaatacctttaccttggacccagaggtcgactcggaccgatg

SEQ ID NO: 15122 - DNA, 203 bp, Homo sapiens
ggcgcgccagtccttctcatattgctgacacaactgtgttcactagcaacctcaaacagacaccatggtgcatctgactcctgaggcgtcaatccctttaactgcgtcaatccctttagtgacgtcaatccctttaggtgcgtcaatccctttaaggccgtcaatccctttaccttggacccagaggtcgactcggaccgatg

SEQ ID NO: 15123 - DNA, 203 bp, Homo sapiens
ggcgcgccagtcctaggatattgtctgacacaactgtgttcactagcaacctcaaacagacaccatggtgcatctgactcctgaggcgtcaattccgataactgcgtcaattccgatagtgacgtcaattccgataggtgcgtcaattccgataaggccgtcaattccgataccttggacccagaggtcgactcggaccgatg

SEQ ID NO: 15124 - DNA, 203 bp, Homo sapiens
ggcgcgccagtcctaccgcatatcctgacacaactgtgttcactagcaacctcaaacagacaccatggtgcatctgactcctgaggcgtcaattccgttaactgcgtcaattccgttagtgacgtcaattccgttaggtgcgtcaattccgttaaggccgtcaattccgttaccttggacccagaggtcgactcggaccgatg

SEQ ID NO: 15125 - DNA, 203 bp, Homo sapiens
ggcgcgccagtcctcgatattcacctgacacaactgtgttcactagcaacctcaaacagacaccatggtgcatctgactcctgaggcgtcaattccttaaactgcgtcaattccttaagtgacgtcaattccttaaggtgcgtcaattccttaaaggccgtcaattccttaaccttggacccagaggtcgactcggaccgatg

SEQ ID NO: 15126 - DNA, 203 bp, Homo sapiens
ggcgcgccagtcctatatcttaacctgacacaactgtgttcactagcaacctcaaacagacaccatggtgcatctgactcctgaggcgtcaattccttacactgcgtcaattccttacgtgacgtcaattccttacggtgcgtcaattccttacaggccgtcaattccttacccttggacccagaggtcgactcggaccgatg

SEQ ID NO: 15127 - DNA, 203 bp, Homo sapiens
ggcgcgccagtcctgggatatccactgacacaactgtgttcactagcaacctcaaacagacaccatggtgcatctgactcctgaggcgtcaattccttgcactgcgtcaattccttgcgtgacgtcaattccttgcggtgcgtcaattccttgcaggccgtcaattccttgcccttggacccagaggtcgactcggaccgatg

SEQ ID NO: 15128 - DNA, 203 bp, Homo sapiens
ggcgcgccagtccttacacatattctgacacaactgtgttcactagcaacctcaaacagacaccatggtgcatctgactcctgaggcgtcaattccttgtactgcgtcaattccttgtgtgacgtcaattccttgtggtgcgtcaattccttgtaggccgtcaattccttgtccttggacccagaggtcgactcggaccgatg

SEQ ID NO: 15129 - DNA, 203 bp, Homo sapiens
ggcgcgccagtcctctgcatatccctgacacaactgtgttcactagcaacctcaaacagacaccatggtgcatctgactcctgaggcgtcaattcctttaactgccctgtggggcaaggtgaacgtggatgaagttggtgcgtcaattcctttaaggccgtcaattcctttaccttggacccagaggtcgactcggaccgatg

SEQ ID NO: 15130 - DNA, 203 bp, Homo sapiens
ggcgcgccagtccttcgatatcgtctgacacaactgtgttcactagcaacctcaaacagacaccatggtgcatctgactcctgaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 15131 - DNA, 203 bp, Homo sapiens
ggcgcgccagtcctatatctacttctgacacaactgtgttcactagcaacctcaaacagacaccatggtgcatctgactcctgaggcgtcaattcctttaactgccctgtggggcaaggtgacgtcaattcctttaggtggtgaggccctgggcaggctgctggtggtctacccttggacccagaggtcgactcggaccgatg

SEQ ID NO: 15132 - DNA, 203 bp, Homo sapiens
ggcgcgccagtcctatatgttctcctgacacaactgtgttcactagcaacctcaaacagacaccatggtgcatctgactcctgaggcgtcaattcctttaactgcgtcaattcctttagtgaacgtggatgaagttggtgcgtcaattcctttaaggccgtcaattcctttaccttggacccagaggtcgactcggaccgatg

SEQ ID NO: 15133 - DNA, 203 bp, Homo sapiens
ggcgcgccagtcctcggcactggactgacacaactgtgttcactagcaacctcaaacagacaccatggtgcatctgactcctgaggcgtcaattcctttcactgcgtcaattcctttcgtgacgtcaattcctttcggtgcgtcaattcctttcaggccgtcaattcctttcccttggacccagaggtcgactcggaccgatg

SEQ ID NO: 15134 - DNA, 203 bp, Homo sapiens
ggcgcgccagtcctcggcagtcccctgacacaactgtgttcactagcaacctcaaacagacaccatggtgcatctgactcctgaggcgtcaattccttttactgcgtcaattccttttgtgacgtcaattccttttggtgcgtcaattccttttaggccgtcaattccttttccttggacccagaggtcgactcggaccgatg

SEQ ID NO: 15135 - DNA, 203 bp, Homo sapiens
ggcgcgccagtcctcgtaacaggtctgacacaactgtgttcactagcaacctcaaacagacaccatggtgcatctgactcctgaggcgtcaattcgtttaactgcgtcaattcgtttagtgacgtcaattcgtttaggtgcgtcaattcgtttaaggccgtcaattcgtttaccttggacccagaggtcgactcggaccgatg

SEQ ID NO: 15136 - DNA, 203 bp, Homo sapiens
ggcgcgccagtcctagtcgatctgctgacacaactgtgttcactagcaacctcaaacagacaccatggtgcatctgactcctgaggcgtcaattgctttaactgcgtcaattgctttagtgacgtcaattgctttaggtgcgtcaattgctttaaggccgtcaattgctttaccttggacccagaggtcgactcggaccgatg

SEQ ID NO: 15137 - DNA, 203 bp, Homo sapiens
ggcgcgccagtcctaagtcgatctctgacacaactgtgttcactagcaacctcaaacagacaccatggtgcatctgactcctgaggcgtcaattggtttaactgcgtcaattggtttagtgacgtcaattggtttaggtgcgtcaattggtttaaggccgtcaattggtttaccttggacccagaggtcgactcggaccgatg

SEQ ID NO: 15138 - DNA, 203 bp, Homo sapiens
ggcgcgccagtcctcccgatcgacctgacacaactgtgttcactagcaacctcaaacagacaccatggtgcatctgactcctgaggcgtcaattgttttaactgcgtcaattgttttagtgacgtcaattgttttaggtgcgtcaattgttttaaggccgtcaattgttttaccttggacccagaggtcgactcggaccgatg

SEQ ID NO: 15139 - DNA, 203 bp, Homo sapiens
ggcgcgccagtccttgcgatattgctgacacaactgtgttcactagcaacctcaaacagacaccatggtgcatctgactcctgaggcgtcccttcctttaactgcgtcccttcctttagtgacgtcccttcctttaggtgcgtcccttcctttaaggccgtcccttcctttaccttggacccagaggtcgactcggaccgatg

SEQ ID NO: 15140 - DNA, 203 bp, Homo sapiens
ggcgcgccagtcctggtgcgatcgctgacacaactgtgttcactagcaacctcaaacagacaccatggtgcatctgactcctgaggcgtcctttcctttaactgcgtcctttcctttagtgacgtcctttcctttaggtgcgtcctttcctttaaggccgtcctttcctttaccttggacccagaggtcgactcggaccgatg

SEQ ID NO: 15141 - DNA, 203 bp, Homo sapiens
ggcgcgccagtcctaaaggcgattctgacacaactgtgttcactagcaacctcaaacagacaccatggtgcatctgactcctgaggcgtcgtttcctttaactgcgtcgtttcctttagtgacgtcgtttcctttaggtgcgtcgtttcctttaaggccgtcgtttcctttaccttggacccagaggtcgactcggaccgatg

SEQ ID NO: 15142 - DNA, 203 bp, Homo sapiens
ggcgcgccagtcctctagcgattgctgacacaactgtgttcactagcaacctcaaacagacaccatggtgcatctgactcctgaggcgtctattcctttaactgcgtctattcctttagtgacgtctattcctttaggtgcgtctattcctttaaggccgtctattcctttaccttggacccagaggtcgactcggaccgatg

SEQ ID NO: 15143 - DNA, 203 bp, Homo sapiens
ggcgcgccagtcctatcgctcgtgctgacacaactgtgttcactagcaacctcaaacagacaccatggtgcatctgactcctgaggcgttaattcctttaactgcgttaattcctttagtgacgttaattcctttaggtgcgttaattcctttaaggccgttaattcctttaccttggacccagaggtcgactcggaccgatg

SEQ ID NO: 15144 - DNA, 203 bp, Homo sapiens
ggcgcgccagtcctctgatcgccgctgacacaactgtgttcactagcaacctcaaacagacaccatggtgcatctgactcctgaggctcggccgtccgttactgctcggccgtgcaaggtgactcggccgtaagttggtgctcggccgttgggcaggcctcggccgttctacccttggacccagaggtcgactcggaccgatg

SEQ ID NO: 15145 - DNA, 203 bp, Homo sapiens
ggcgcgccagtccttgatcgcagactgacacaactgtgttcactagcaacctcaaacagacaccatggtgcatctgactcctgagggacggccgtccgttactggacggccgtgcaaggtgagacggccgtaagttggtggacggccgttgggcaggcgacggccgttctacccttggacccagaggtcgactcggaccgatg

SEQ ID NO: 15146 - DNA, 203 bp, Homo sapiens
ggcgcgccagtcctagcgtaggtgctgacacaactgtgttcactagcaacctcaaacagacaccatggtgcatctgactcctgagggatcaattcctttaactggatcaattcctttagtgagatcaattcctttaggtggatcaattcctttaaggcgatcaattcctttaccttggacccagaggtcgactcggaccgatg

SEQ ID NO: 15147 - DNA, 203 bp, Homo sapiens
ggcgcgccagtcctaactgcgtagctgacacaactgtgttcactagcaacctcaaacagacaccatggtgcatctgactcctgagggccggccgtccgttactggccggccgtgcaaggtgagccggccgtaagttggtggccggccgttgggcaggcgccggccgttctacccttggacccagaggtcgactcggaccgatg

SEQ ID NO: 15148 - DNA, 203 bp, Homo sapiens
ggcgcgccagtcctggcgtagcttctgacacaactgtgttcactagcaacctcaaacagacaccatggtgcatctgactcctgagggcggcgggtccgttactggcggcgggtgcaaggtgagcggcgggtaagttggtggcggcgggttgggcaggcgcggcgggttctacccttggacccagaggtcgactcggaccgatg

SEQ ID NO: 15149 - DNA, 203 bp, Homo sapiens
ggcgcgccagtccttgcgtagtaactgacacaactgtgttcactagcaacctcaaacagacaccatggtgcatctgactcctgaggggcggccgtccgttactgggcggccgtgcaaggtgaggcggccgtaagttggtgggcggccgttgggcaggcggcggccgttctacccttggacccagaggtcgactcggaccgatg

SEQ ID NO: 15150 - DNA, 203 bp, Homo sapiens
ggcgcgccagtcctcaaattcaacctgacacaactgtgttcactagcaacctcaaacagacaccatggtgcatctgactcctgagggtcggaatcgagaaactggtcggaatcgagaagtgagtcggaatcgagaaggtggtcggaatcgagaaaggcgtcggaatcgagaaccttggacccagaggtcgactcggaccgatg

SEQ ID NO: 15151 - DNA, 203 bp, Homo sapiens
ggcgcgccagtcctgcgtgttgtcctgacacaactgtgttcactagcaacctcaaacagacaccatggtgcatctgactcctgagggtcggccgtccgttactggtcggccgtgcaaggtgagtcggccgtaagttggtggtcggccgttgggcaggcgtcggccgttctacccttggacccagaggtcgactcggaccgatg

SEQ ID NO: 15152 - DNA, 203 bp, Homo sapiens
ggcgcgccagtcctgcgtgttagactgacacaactgtgttcactagcaacctcaaacagacaccatggtgcatctgactcctgagggtcttggcaaagttactggtcttggcaaaaaggtgagtcttggcaaagttggtggtcttggcaaaggcaggcgtcttggcaaatacccttggacccagaggtcgactcggaccgatg

SEQ ID NO: 15153 - DNA, 203 bp, Homo sapiens
ggcgcgccagtcctcctgggcgtcctgacacaactgtgttcactagcaacctcaaacagacaccatggtgcatctgactcctgaggtaccccctgccgttactgtacccccgggcaaggtgataccccctgaagttggtgtaccccccctgggcaggctacccccggtctacccttggacccagaggtcgactcggaccgatg

SEQ ID NO: 15154 - DNA, 203 bp, Homo sapiens
ggcgcgccagtccttcttgggccgctgacacaactgtgttcactagcaacctcaaacagacaccatggtgcatctgactcctgaggtacggccgtccgttactgtacggccgtgcaaggtgatacggccgtaagttggtgtacggccgttgggcaggctacggccgttctacccttggacccagaggtcgactcggaccgatg

SEQ ID NO: 15155 - DNA, 203 bp, Homo sapiens
ggcgcgccagtcctaagagcccaactgacacaactgtgttcactagcaacctcaaacagacaccatggtgcatctgactcctgaggtactcaatgccgttactgtactcaagggcaaggtgatactcaatgaagttggtgtactcaacctgggcaggctactcaaggtctacccttggacccagaggtcgactcggaccgatg

SEQ ID NO: 15156 - DNA, 203 bp, Homo sapiens
ggcgcgccagtcctcgttgggccactgacacaactgtgttcactagcaacctcaaacagacaccatggtgcatctgactcctgaggtactcagtgccgttactgtactcaggggcaaggtgatactcagtgaagttggtgtactcagcctgggcaggctactcagggtctacccttggacccagaggtcgactcggaccgatg

SEQ ID NO: 15157 - DNA, 203 bp, Homo sapiens
ggcgcgccagtcctttgcccatgactgacacaactgtgttcactagcaacctcaaacagacaccatggtgcatctgactcctgaggtactccatgccgttactgtactccagggcaaggtgatactccatgaagttggtgtactccacctgggcaggctactccaggtctacccttggacccagaggtcgactcggaccgatg

SEQ ID NO: 15158 - DNA, 203 bp, Homo sapiens
ggcgcgccagtcctgagcccatatctgacacaactgtgttcactagcaacctcaaacagacaccatggtgcatctgactcctgaggtactccctgccgttactgccctgtggggcaaggtgaacgtggatgaagttggtggtgaggccctgggcaggctactcccggtctaccctttactcccgaggtcgactcggaccgatg

SEQ ID NO: 15159 - DNA, 203 bp, Homo sapiens
ggcgcgccagtcctacgcccaaatctgacacaactgtgttcactagcaacctcaaacagacaccatggtgcatctgactcctgaggtactccctgccgttactgccctgtggggcaaggtgaacgtggatgaagttggtggtgaggccctgggcaggctgctggtggtctaccctttactcccgaggtcgactcggaccgatg

SEQ ID NO: 15160 - DNA, 203 bp, Homo sapiens
ggcgcgccagtccttgaactgggcctgacacaactgtgttcactagcaacctcaaacagacaccatggtgcatctgactcctgaggtactccctgccgttactgccctgtggggcaaggtgaacgtggatgaagttggtgtactccccctgggcaggctactcccggtctacccttggacccagaggtcgactcggaccgatg

SEQ ID NO: 15161 - DNA, 203 bp, Homo sapiens
ggcgcgccagtcctgctcagcccactgacacaactgtgttcactagcaacctcaaacagacaccatggtgcatctgactcctgaggtactccctgccgttactgccctgtggggcaaggtgaacgtggatgaagttggtgtactccccctgggcaggctgctggtggtctaccctttactcccgaggtcgactcggaccgatg

SEQ ID NO: 15162 - DNA, 203 bp, Homo sapiens
ggcgcgccagtcctactactgggcctgacacaactgtgttcactagcaacctcaaacagacaccatggtgcatctgactcctgaggtactccctgccgttactgccctgtggggcaaggtgatactccctgaagttggtggtgaggccctgggcaggctactcccggtctacccttggacccagaggtcgactcggaccgatg

SEQ ID NO: 15163 - DNA, 203 bp, Homo sapiens
ggcgcgccagtcctatatgcccagctgacacaactgtgttcactagcaacctcaaacagacaccatggtgcatctgactcctgaggtactccctgccgttactgccctgtggggcaaggtgatactccctgaagttggtggtgaggccctgggcaggctgctggtggtctacccttggacccagaggtcgactcggaccgatg

SEQ ID NO: 15164 - DNA, 203 bp, Homo sapiens
ggcgcgccagtccttgtttgcccactgacacaactgtgttcactagcaacctcaaacagacaccatggtgcatctgactcctgaggtactccctgccgttactgccctgtggggcaaggtgatactccctgaagttggtgtactccccctgggcaggctgctggtggtctacccttggacccagaggtcgactcggaccgatg

SEQ ID NO: 15165 - DNA, 203 bp, Homo sapiens
ggcgcgccagtccttcatgggcatctgacacaactgtgttcactagcaacctcaaacagacaccatggtgcatctgactcctgaggtactccctgccgttactgtactcccgggcaaggtgaacgtggatgaagttggtggtgaggccctgggcaggctactcccggtctaccctttactcccgaggtcgactcggaccgatg

SEQ ID NO: 15166 - DNA, 203 bp, Homo sapiens
ggcgcgccagtccttgaatgggcactgacacaactgtgttcactagcaacctcaaacagacaccatggtgcatctgactcctgaggtactccctgccgttactgtactcccgggcaaggtgaacgtggatgaagttggtgtactccccctgggcaggctactcccggtctacccttggacccagaggtcgactcggaccgatg

SEQ ID NO: 15167 - DNA, 203 bp, Homo sapiens
ggcgcgccagtcctgtagcccatgctgacacaactgtgttcactagcaacctcaaacagacaccatggtgcatctgactcctgaggtactccctgccgttactgtactcccgggcaaggtgaacgtggatgaagttggtgtactccccctgggcaggctactcccggtctaccctttactcccgaggtcgactcggaccgatg

SEQ ID NO: 15168 - DNA, 203 bp, Homo sapiens
ggcgcgccagtcctctgggcctgtctgacacaactgtgttcactagcaacctcaaacagacaccatggtgcatctgactcctgaggtactccctgccgttactgtactcccgggcaaggtgaacgtggatgaagttggtgtactccccctgggcaggctgctggtggtctacccttggacccagaggtcgactcggaccgatg

SEQ ID NO: 15169 - DNA, 203 bp, Homo sapiens
ggcgcgccagtcctgctgcccaagctgacacaactgtgttcactagcaacctcaaacagacaccatggtgcatctgactcctgaggtactccctgccgttactgtactcccgggcaaggtgaacgtggatgaagttggtgtactccccctgggcaggctgctggtggtctaccctttactcccgaggtcgactcggaccgatg

SEQ ID NO: 15170 - DNA, 203 bp, Homo sapiens
ggcgcgccagtcctactaagattcctgacacaactgtgttcactagcaacctcaaacagacaccatggtgcatctgactcctgaggtactccctgccgttactgtactcccgggcaaggtgatactccctgaagttggtggtgaggccctgggcaggctactcccggtctaccctttactcccgaggtcgactcggaccgatg

SEQ ID NO: 15171 - DNA, 203 bp, Homo sapiens
ggcgcgccagtcctcgactaaggcctgacacaactgtgttcactagcaacctcaaacagacaccatggtgcatctgactcctgaggtactccctgccgttactgtactcccgggcaaggtgatactccctgaagttggtgtactccccctgggcaggctactcccggtctacccttggacccagaggtcgactcggaccgatg

SEQ ID NO: 15172 - DNA, 203 bp, Homo sapiens
ggcgcgccagtcctgctactaagcctgacacaactgtgttcactagcaacctcaaacagacaccatggtgcatctgactcctgaggtactccctgccgttactgtactcccgggcaaggtgatactccctgaagttggtgtactccccctgggcaggctgctggtggtctacccttggacccagaggtcgactcggaccgatg

SEQ ID NO: 15173 - DNA, 203 bp, Homo sapiens
ggcgcgccagtcctcttagttgcgctgacacaactgtgttcactagcaacctcaaacagacaccatggtgcatctgactcctgaggtactccgtgccgttactgtactccggggcaaggtgatactccgtgaagttggtgtactccgcctgggcaggctactccgggtctacccttggacccagaggtcgactcggaccgatg

SEQ ID NO: 15174 - DNA, 203 bp, Homo sapiens
ggcgcgccagtcctttcttagtgactgacacaactgtgttcactagcaacctcaaacagacaccatggtgcatctgactcctgaggtactccttgccgttactgtactcctgggcaaggtgatactccttgaagttggtgtactcctcctgggcaggctactcctggtctacccttggacccagaggtcgactcggaccgatg

SEQ ID NO: 15175 - DNA, 203 bp, Homo sapiens
ggcgcgccagtcctcttagtgtatctgacacaactgtgttcactagcaacctcaaacagacaccatggtgcatctgactcctgaggtactctctgccgttactgtactctcgggcaaggtgatactctctgaagttggtgtactctccctgggcaggctactctcggtctacccttggacccagaggtcgactcggaccgatg

SEQ ID NO: 15176 - DNA, 203 bp, Homo sapiens
ggcgcgccagtcctagctttgacgctgacacaactgtgttcactagcaacctcaaacagacaccatggtgcatctgactcctgaggtactggctgccgttactgtactggcgggcaaggtgatactggctgaagttggtgtactggccctgggcaggctactggcggtctacccttggacccagaggtcgactcggaccgatg

SEQ ID NO: 15177 - DNA, 203 bp, Homo sapiens
ggcgcgccagtcctcttgcttttgctgacacaactgtgttcactagcaacctcaaacagacaccatggtgcatctgactcctgaggtacttactgccgttactgtacttacgggcaaggtgatacttactgaagttggtgtacttaccctgggcaggctacttacggtctacccttggacccagaggtcgactcggaccgatg

SEQ ID NO: 15178 - DNA, 203 bp, Homo sapiens
ggcgcgccagtcctcaaggtgtccctgacacaactgtgttcactagcaacctcaaacagacaccatggtgcatctgactcctgaggtacttcctgccgttactgtacttccgggcaaggtgatacttcctgaagttggtgtacttcccctgggcaggctacttccggtctacccttggacccagaggtcgactcggaccgatg

SEQ ID NO: 15179 - DNA, 203 bp, Homo sapiens
ggcgcgccagtcctgcgcttgcgactgacacaactgtgttcactagcaacctcaaacagacaccatggtgcatctgactcctgaggtactttctgccgttactgtactttcgggcaaggtgatactttctgaagttggtgtactttccctgggcaggctactttcggtctacccttggacccagaggtcgactcggaccgatg

SEQ ID NO: 15180 - DNA, 203 bp, Homo sapiens
ggcgcgccagtccttagaagcgctctgacacaactgtgttcactagcaacctcaaacagacaccatggtgcatctgactcctgaggtagcccctgccgttactgtagccccgggcaaggtgatagcccctgaagttggtgtagcccccctgggcaggctagccccggtctacccttggacccagaggtcgactcggaccgatg

SEQ ID NO: 15181 - DNA, 203 bp, Homo sapiens
ggcgcgccagtcctagtcaagcgcctgacacaactgtgttcactagcaacctcaaacagacaccatggtgcatctgactcctgaggtaggccctgccgttactgtaggcccgggcaaggtgataggccctgaagttggtgtaggccccctgggcaggctaggcccggtctacccttggacccagaggtcgactcggaccgatg

SEQ ID NO: 15182 - DNA, 203 bp, Homo sapiens
ggcgcgccagtcctcccgaagcgcctgacacaactgtgttcactagcaacctcaaacagacaccatggtgcatctgactcctgaggtagtccctgccgttactgtagtcccgggcaaggtgatagtccctgaagttggtgtagtccccctgggcaggctagtcccggtctacccttggacccagaggtcgactcggaccgatg

SEQ ID NO: 15183 - DNA, 203 bp, Homo sapiens
ggcgcgccagtcctttgcgatcttctgacacaactgtgttcactagcaacctcaaacagacaccatggtgcatctgactcctgaggtataccctgccgttactgtatacccgggcaaggtgatataccctgaagttggtgtataccccctgggcaggctatacccggtctacccttggacccagaggtcgactcggaccgatg

SEQ ID NO: 15184 - DNA, 203 bp, Homo sapiens
ggcgcgccagtcctcgagcctcaactgacacaactgtgttcactagcaacctcaaacagacaccatggtgcatctgactcctgaggtatcaattcctttaactgtatcaattcctttagtgatatcaattcctttaggtgtatcaattcctttaaggctatcaattcctttaccttggacccagaggtcgactcggaccgatg

SEQ ID NO: 15185 - DNA, 203 bp, Homo sapiens
ggcgcgccagtcctcctgacgtccctgacacaactgtgttcactagcaacctcaaacagacaccatggtgcatctgactcctgaggtatcccctgccgttactgtatccccgggcaaggtgatatcccctgaagttggtgtatcccccctgggcaggctatccccggtctacccttggacccagaggtcgactcggaccgatg

SEQ ID NO: 15186 - DNA, 203 bp, Homo sapiens
ggcgcgccagtccttatgaccatgctgacacaactgtgttcactagcaacctcaaacagacaccatggtgcatctgactcctgaggtatgccctgccgttactgtatgcccgggcaaggtgatatgccctgaagttggtgtatgccccctgggcaggctatgcccggtctacccttggacccagaggtcgactcggaccgatg

SEQ ID NO: 15187 - DNA, 203 bp, Homo sapiens
ggcgcgccagtcctttggacgtggctgacacaactgtgttcactagcaacctcaaacagacaccatggtgcatctgactcctgaggtccggccgtccgttactgtccggccgtgcaaggtgatccggccgtaagttggtgtccggccgttgggcaggctccggccgttctacccttggacccagaggtcgactcggaccgatg

SEQ ID NO: 15188 - DNA, 203 bp, Homo sapiens
ggcgcgccagtccttccacgtccactgacacaactgtgttcactagcaacctcaaacagacaccatggtgcatctgactcctgaggtcctccctgccgttactgtcctcccgggcaaggtgatcctccctgaagttggtgtcctccccctgggcaggctcctcccggtctacccttggacccagaggtcgactcggaccgatg

SEQ ID NO: 15189 - DNA, 203 bp, Homo sapiens
ggcgcgccagtccttcgtcggtacctgacacaactgtgttcactagcaacctcaaacagacaccatggtgcatctgactcctgaggtgcggaatcgagaaactgtgcggaatcgagaagtgatgcggaatcgagaaggtgtgcggaatcgagaaaggctgcggaatcgagaaccttggacccagaggtcgactcggaccgatg

SEQ ID NO: 15190 - DNA, 203 bp, Homo sapiens
ggcgcgccagtccttaccgatccactgacacaactgtgttcactagcaacctcaaacagacaccatggtgcatctgactcctgaggtgcttggcaaagttactgtgcttggcaaaaaggtgatgcttggcaaagttggtgtgcttggcaaaggcaggctgcttggcaaatacccttggacccagaggtcgactcggaccgatg

SEQ ID NO: 15191 - DNA, 203 bp, Homo sapiens
ggcgcgccagtcctgtaccgaaatctgacacaactgtgttcactagcaacctcaaacagacaccatggtgcatctgactcctgaggtgtcaattcctttaactgtgtcaattcctttagtgatgtcaattcctttaggtgtgtcaattcctttaaggctgtcaattcctttaccttggacccagaggtcgactcggaccgatg

SEQ ID NO: 15192 - DNA, 203 bp, Homo sapiens
ggcgcgccagtcctaataccgaacctgacacaactgtgttcactagcaacctcaaacagacaccatggtgcatctgactcctgaggttactggcaaagttactgttactggcaaaaaggtgattactggcaaagttggtgttactggcaaaggcaggcttactggcaaatacccttggacccagaggtcgactcggaccgatg

SEQ ID NO: 15193 - DNA, 203 bp, Homo sapiens
ggcgcgccagtcctcgtgcaccatctgacacaactgtgttcactagcaacctcaaacagacaccatggtgcatctgactcctgaggttcgtggcaaagttactgttcgtggcaaaaaggtgattcgtggcaaagttggtgttcgtggcaaaggcaggcttcgtggcaaatacccttggacccagaggtcgactcggaccgatg

SEQ ID NO: 15194 - DNA, 203 bp, Homo sapiens
ggcgcgccagtcctacgttgaacgctgacacaactgtgttcactagcaacctcaaacagacaccatggtgcatctgactcctgaggttctaagcaaagttactgttctaagcaaaaaggtgattctaagcaaagttggtgttctaagcaaaggcaggcttctaagcaaatacccttggacccagaggtcgactcggaccgatg

SEQ ID NO: 15195 - DNA, 203 bp, Homo sapiens
ggcgcgccagtccttgggtgtgaactgacacaactgtgttcactagcaacctcaaacagacaccatggtgcatctgactcctgaggttctatgcaaagttactgttctatgcaaaaaggtgattctatgcaaagttggtgttctatgcaaaggcaggcttctatgcaaatacccttggacccagaggtcgactcggaccgatg

SEQ ID NO: 15196 - DNA, 203 bp, Homo sapiens
ggcgcgccagtcctatgggtgtcgctgacacaactgtgttcactagcaacctcaaacagacaccatggtgcatctgactcctgaggttctcagcaaagttactgttctcagcaaaaaggtgattctcagcaaagttggtgttctcagcaaaggcaggcttctcagcaaatacccttggacccagaggtcgactcggaccgatg

SEQ ID NO: 15197 - DNA, 203 bp, Homo sapiens
ggcgcgccagtccttactgacgtactgacacaactgtgttcactagcaacctcaaacagacaccatggtgcatctgactcctgaggttctccctgccgttactgttctcccgggcaaggtgattctccctgaagttggtgttctccccctgggcaggcttctcccggtctacccttggacccagaggtcgactcggaccgatg

SEQ ID NO: 15198 - DNA, 203 bp, Homo sapiens
ggcgcgccagtcctgctacattttctgacacaactgtgttcactagcaacctcaaacagacaccatggtgcatctgactcctgaggttctccgcaaagttactgttctccgcaaaaaggtgattctccgcaaagttggtgttctccgcaaaggcaggcttctccgcaaatacccttggacccagaggtcgactcggaccgatg

SEQ ID NO: 15199 - DNA, 203 bp, Homo sapiens
ggcgcgccagtcctcagatccagcctgacacaactgtgttcactagcaacctcaaacagacaccatggtgcatctgactcctgaggttctcgattccgtgactgttctcgattccgtggtgattctcgattccgtgggtgttctcgattccgtgaggcttctcgattccgtgccttggacccagaggtcgactcggaccgatg

SEQ ID NO: 15200 - DNA, 203 bp, Homo sapiens
ggcgcgccagtcctgtgacagcaactgacacaactgtgttcactagcaacctcaaacagacaccatggtgcatctgactcctgaggttctgggcaaagttactgttctgggcaaaaaggtgattctgggcaaagttggtgttctgggcaaaggcaggcttctgggcaaatacccttggacccagaggtcgactcggaccgatg

SEQ ID NO: 15201 - DNA, 203 bp, Homo sapiens
ggcgcgccagtccttgtctggaccctgacacaactgtgttcactagcaacctcaaacagacaccatggtgcatctgactcctgaggttcttagcaaagttactgttcttagcaaaaaggtgattcttagcaaagttggtgttcttagcaaaggcaggcttcttagcaaatacccttggacccagaggtcgactcggaccgatg

SEQ ID NO: 15202 - DNA, 203 bp, Homo sapiens
ggcgcgccagtccttcgcccaggtctgacacaactgtgttcactagcaacctcaaacagacaccatggtgcatctgactcctgaggttcttcgcaaagttactgttcttcgcaaaaaggtgattcttcgcaaagttggtgttcttcgcaaaggcaggcttcttcgcaaatacccttggacccagaggtcgactcggaccgatg

SEQ ID NO: 15203 - DNA, 203 bp, Homo sapiens
ggcgcgccagtcctttcgcccaagctgacacaactgtgttcactagcaacctcaaacagacaccatggtgcatctgactcctgaggttcttgacaaagttactgttcttgacaaaaaggtgattcttgacaaagttggtgttcttgacaaaggcaggcttcttgacaaatacccttggacccagaggtcgactcggaccgatg

SEQ ID NO: 15204 - DNA, 203 bp, Homo sapiens
ggcgcgccagtcctcaggtcgcccctgacacaactgtgttcactagcaacctcaaacagacaccatggtgcatctgactcctgaggttcttgagaaagttactgttcttgagaaaaaggtgattcttgagaaagttggtgttcttgagaaaggcaggcttcttgagaaatacccttggacccagaggtcgactcggaccgatg

SEQ ID NO: 15205 - DNA, 203 bp, Homo sapiens
ggcgcgccagtccttgggcgatcactgacacaactgtgttcactagcaacctcaaacagacaccatggtgcatctgactcctgaggttcttgcgaaagttactgttcttgcgaaaaaggtgattcttgcgaaagttggtgttcttgcgaaaggcaggcttcttgcgaaatacccttggacccagaggtcgactcggaccgatg

SEQ ID NO: 15206 - DNA, 203 bp, Homo sapiens
ggcgcgccagtcctcgaccacaatctgacacaactgtgttcactagcaacctcaaacagacaccatggtgcatctgactcctgaggttcttggcaaagttactgccctgtggggcaaggtgaacgtggatgaagttggtggtgaggccctgggcaggctgctggtggtctaccccacggaatcgagaacgactcggaccgatg

SEQ ID NO: 15207 - DNA, 203 bp, Homo sapiens
ggcgcgccagtcctcaccacaatgctgacacaactgtgttcactagcaacctcaaacagacaccatggtgcatctgactcctgaggttcttggcaaagttactgccctgtggggcaaggtgaacgtggatgaagttggtggtgaggccctgggcaggctgctggtggtctaccccgtcaattcctttacgactcggaccgatg

SEQ ID NO: 15208 - DNA, 203 bp, Homo sapiens
ggcgcgccagtccttcacccgaaactgacacaactgtgttcactagcaacctcaaacagacaccatggtgcatctgactcctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15209 - DNA, 203 bp, Homo sapiens
ggcgcgccagtcctactacgggtactgacacaactgtgttcactagcaacctcaaacagacaccatggtgcatctgactcctgaggttcttggcaaagttactgccctgtggggcaaggtgaacgtggatgaagttggtggtgaggccctgggcaggctgctggtggtctacccttggacctactccccgactcggaccgatg

SEQ ID NO: 15210 - DNA, 203 bp, Homo sapiens
ggcgcgccagtcctaacgggttaactgacacaactgtgttcactagcaacctcaaacagacaccatggtgcatctgactcctgaggttcttggcaaagttactgccctgtggggcaaggtgattcttggcaaagttggtgttcttggcaaaggcaggctgctggtggtctacccttggacccagaggtcgactcggaccgatg

SEQ ID NO: 15211 - DNA, 203 bp, Homo sapiens
ggcgcgccagtcctacccgtcagcctgacacaactgtgttcactagcaacctcaaacagacaccatggtgcatctgactcctgaggttcttggcaaagttactgttcttggcaaaaaggtgaacgtggatgaagttggtggtgaggccctgggcaggcttcttggcaaatacccttggacccagaggtcgactcggaccgatg

SEQ ID NO: 15212 - DNA, 203 bp, Homo sapiens
ggcgcgccagtcctcgtcgggtttctgacacaactgtgttcactagcaacctcaaacagacaccatggtgcatctgactcctgaggttcttggcaaagttactgttcttggcaaaaaggtgattcttggcaaagttggtggtgaggccctgggcaggctgctggtggtctacccttggacccagaggtcgactcggaccgatg

SEQ ID NO: 15213 - DNA, 203 bp, Homo sapiens
ggcgcgccagtcctgaaacccgtgctgacacaactgtgttcactagcaacctcaaacagacaccatggtgcatctgactcctgaggttcttggcaaagttactgttcttggcaaaaaggtgattcttggcaaagttggtggtgaggccctgggcaggcttcttggcaaatacccttggacccagaggtcgactcggaccgatg

SEQ ID NO: 15214 - DNA, 203 bp, Homo sapiens
ggcgcgccagtcctgcgacccgtactgacacaactgtgttcactagcaacctcaaacagacaccatggtgcatctgactcctgaggttcttggcaaagttactgttcttggcaaaaaggtgattcttggcaaagttggtgttcttggcaaaggcaggctgctggtggtctacccttggacccagaggtcgactcggaccgatg

SEQ ID NO: 15215 - DNA, 203 bp, Homo sapiens
ggcgcgccagtcctccttcgggtgctgacacaactgtgttcactagcaacctcaaacagacaccatggtgcatctgactcctgaggttcttggcaaggttactgttcttggcaagaaggtgattcttggcaaggttggtgttcttggcaagggcaggcttcttggcaagtacccttggacccagaggtcgactcggaccgatg

SEQ ID NO: 15216 - DNA, 203 bp, Homo sapiens
ggcgcgccagtcctaaacgggtttctgacacaactgtgttcactagcaacctcaaacagacaccatggtgcatctgactcctgaggttcttggcacagttactgttcttggcacaaaggtgattcttggcacagttggtgttcttggcacaggcaggcttcttggcacatacccttggacccagaggtcgactcggaccgatg

SEQ ID NO: 15217 - DNA, 203 bp, Homo sapiens
ggcgcgccagtcctcacccgtactctgacacaactgtgttcactagcaacctcaaacagacaccatggtgcatctgactcctgaggttcttggcaccgttactgttcttggcaccaaggtgattcttggcaccgttggtgttcttggcaccggcaggcttcttggcacctacccttggacccagaggtcgactcggaccgatg

SEQ ID NO: 15218 - DNA, 203 bp, Homo sapiens
ggcgcgccagtcctgtaacgggtcctgacacaactgtgttcactagcaacctcaaacagacaccatggtgcatctgactcctgaggttcttggcactgttactgttcttggcactaaggtgattcttggcactgttggtgttcttggcactggcaggcttcttggcacttacccttggacccagaggtcgactcggaccgatg

SEQ ID NO: 15219 - DNA, 203 bp, Homo sapiens
ggcgcgccagtcctgtttcgggtactgacacaactgtgttcactagcaacctcaaacagacaccatggtgcatctgactcctgaggttcttggcagagttactgttcttggcagaaaggtgattcttggcagagttggtgttcttggcagaggcaggcttcttggcagatacccttggacccagaggtcgactcggaccgatg

SEQ ID NO: 15220 - DNA, 203 bp, Homo sapiens
ggcgcgccagtcctacccgaaatcctgacacaactgtgttcactagcaacctcaaacagacaccatggtgcatctgactcctgaggttcttggcagggttactgttcttggcaggaaggtgattcttggcagggttggtgttcttggcaggggcaggcttcttggcaggtacccttggacccagaggtcgactcggaccgatg

SEQ ID NO: 15221 - DNA, 203 bp, Homo sapiens
ggcgcgccagtcctttgatctggactgacacaactgtgttcactagcaacctcaaacagacaccatggtgcatctgactcctgaggttcttggcatagttactgttcttggcataaaggtgattcttggcatagttggtgttcttggcataggcaggcttcttggcatatacccttggacccagaggtcgactcggaccgatg

SEQ ID NO: 15222 - DNA, 203 bp, Homo sapiens
ggcgcgccagtcctcggtacgtagctgacacaactgtgttcactagcaacctcaaacagacaccatggtgcatctgactcctgaggttcttggccaagttactgttcttggccaaaaggtgattcttggccaagttggtgttcttggccaaggcaggcttcttggccaatacccttggacccagaggtcgactcggaccgatg

SEQ ID NO: 15223 - DNA, 203 bp, Homo sapiens
ggcgcgccagtcctcggcatacacctgacacaactgtgttcactagcaacctcaaacagacaccatggtgcatctgactcctgaggttcttggcccagttactgttcttggcccaaaggtgattcttggcccagttggtgttcttggcccaggcaggcttcttggcccatacccttggacccagaggtcgactcggaccgatg

SEQ ID NO: 15224 - DNA, 203 bp, Homo sapiens
ggcgcgccagtcctgtgtaagccgctgacacaactgtgttcactagcaacctcaaacagacaccatggtgcatctgactcctgaggttcttggcgcagttactgttcttggcgcaaaggtgattcttggcgcagttggtgttcttggcgcaggcaggcttcttggcgcatacccttggacccagaggtcgactcggaccgatg

SEQ ID NO: 15225 - DNA, 203 bp, Homo sapiens
ggcgcgccagtcctcggttgtccactgacacaactgtgttcactagcaacctcaaacagacaccatggtgcatctgactcctgaggttcttggcggagttactgttcttggcggaaaggtgattcttggcggagttggtgttcttggcggaggcaggcttcttggcggatacccttggacccagaggtcgactcggaccgatg

SEQ ID NO: 15226 - DNA, 203 bp, Homo sapiens
ggcgcgccagtcctcggctaaccactgacacaactgtgttcactagcaacctcaaacagacaccatggtgcatctgactcctgaggttcttggctcagttactgttcttggctcaaaggtgattcttggctcagttggtgttcttggctcaggcaggcttcttggctcatacccttggacccagaggtcgactcggaccgatg

SEQ ID NO: 15227 - DNA, 203 bp, Homo sapiens
ggcgcgccagtcctcggttggtctctgacacaactgtgttcactagcaacctcaaacagacaccatggtgcatctgactcctgaggttcttgggaaagttactgttcttgggaaaaaggtgattcttgggaaagttggtgttcttgggaaaggcaggcttcttgggaaatacccttggacccagaggtcgactcggaccgatg

SEQ ID NO: 15228 - DNA, 203 bp, Homo sapiens
ggcgcgccagtccttgcaacaccgctgacacaactgtgttcactagcaacctcaaacagacaccatggtgcatctgactcctgaggttcttggtaaagttactgttcttggtaaaaaggtgattcttggtaaagttggtgttcttggtaaaggcaggcttcttggtaaatacccttggacccagaggtcgactcggaccgatg

SEQ ID NO: 15229 - DNA, 203 bp, Homo sapiens
ggcgcgccagtcctcggcgtagtactgacacaactgtgttcactagcaacctcaaacagacaccatggtgcatctgactcctgaggttcttgttaaagttactgttcttgttaaaaaggtgattcttgttaaagttggtgttcttgttaaaggcaggcttcttgttaaatacccttggacccagaggtcgactcggaccgatg

SEQ ID NO: 15230 - DNA, 203 bp, Homo sapiens
ggcgcgccagtcctaaaaccgccgctgacacaactgtgttcactagcaacctcaaacagacaccatggtgcatctgactcctgaggtttatggcaaagttactgtttatggcaaaaaggtgatttatggcaaagttggtgtttatggcaaaggcaggctttatggcaaatacccttggacccagaggtcgactcggaccgatg

SEQ ID NO: 15231 - DNA, 203 bp, Homo sapiens
ggcgcgccagtcctttagacgtaactgacacaactgtgttcactagcaacctcaaacagacaccatggtgcatctgactcctgaggtttgccaagaagttactgtttgccaagaaaaggtgatttgccaagaagttggtgtttgccaagaaggcaggctttgccaagaatacccttggacccagaggtcgactcggaccgatg

SEQ ID NO: 15232 - DNA, 203 bp, Homo sapiens
ggcgcgccagtcctcgacgtaagactgacacaactgtgttcactagcaacctcaaacagacaccatggtgcatctgactcctgaggtttgtggcaaagttactgtttgtggcaaaaaggtgatttgtggcaaagttggtgtttgtggcaaaggcaggctttgtggcaaatacccttggacccagaggtcgactcggaccgatg

SEQ ID NO: 15233 - DNA, 203 bp, Homo sapiens
ggcgcgccagtcctcgtaggacatctgacacaactgtgttcactagcaacctcaaacagacaccatggtgcatctgactcctgattcctttaagtttcagctttgcaaccatactccccccggaacccaaagactttggtttcccgccctgggcaggctgctggtggtctacccttggacccagaggtcgactcggaccgatg

SEQ ID NO: 15234 - DNA, 203 bp, Homo sapiens
ggcgcgccagtcctccaagatcggctgacacaactgtgttcactagcaacctcaaacagacaccatggtgcatctgactcctgattcttggcaaaccgttactgccctgtggggcaaggtgaacgtggatgaagttggtggtgaggccctgggcaggctgctggtggtctacccttggaccggcgggtcgactcggaccgatg

SEQ ID NO: 15235 - DNA, 203 bp, Homo sapiens
ggcgcgccagtcctgcagtatcggctgacacaactgtgttcactagcaacctcaaacagacaccatggtgcatctgactcctgcacggaatcgagaagttactgccctgtggggcaaggtgaacgtggatgaagttggtggtgaggccctgggcaggctgctggtggtctacccttggacctactccccgactcggaccgatg

SEQ ID NO: 15236 - DNA, 203 bp, Homo sapiens
ggcgcgccagtcctcagcggtcggctgacacaactgtgttcactagcaacctcaaacagacaccatggtgcatctgactcctgcgtcaattcctttagttactgccctgtggggcaaggtgaacgtggatgaagttggtggtgaggccctgggcaggctgctggtggtctaccccgtcaattcctttacgactcggaccgatg

SEQ ID NO: 15237 - DNA, 203 bp, Homo sapiens
ggcgcgccagtcctgaatgatcggctgacacaactgtgttcactagcaacctcaaacagacaccatggtgcatctgactcctggctccactcctggtggtgcccttccgtcaattcctttaagtttcagctttgcaaccatactccccctgggcaggctgctggtggtctacccttggacccagaggtcgactcggaccgatg

SEQ ID NO: 15238 - DNA, 203 bp, Homo sapiens
ggcgcgccagtcctttactctcggctgacacaactgtgttcactagcaacctcaaacagacaccatggtgcatctgactcctggctccactcctggtggtgcccttccgtcaattcctttaagtttcagctttgcaaccatactcgccctgggcaggctgctggtggtctacccttggacccagaggtcgactcggaccgatg

SEQ ID NO: 15239 - DNA, 203 bp, Homo sapiens
ggcgcgccagtcctagaacgtcggctgacacaactgtgttcactagcaacctcaaacagacaccatggtgcatctgactcctgtactcccgtctgccgttactgccctgtggggcaaggtgaacgtggatgaagttggtggtgaggccctgggcaggctgctggtggtctaccccacggaatcgagaacgactcggaccgatg

SEQ ID NO: 15240 - DNA, 203 bp, Homo sapiens
ggcgcgccagtcctgacacctcggctgacacaactgtgttcactagcaacctcaaacagacaccatggtgcatctgactcctgtactcccgtctgccgttactgccctgtggggcaaggtgaacgtggatgaagttggtggtgaggccctgggcaggctgctggtggtctacccttggacccagaggtcgactcggaccgatg

SEQ ID NO: 15241 - DNA, 203 bp, Homo sapiens
ggcgcgccagtcctccgatcaacgctgacacaactgtgttcactagcaacctcaaacagacaccatggtgcatctgactttcttggcaaagtctgccgttactgccctgtggggcaaggtgaacgtggatgaagttggtggtgaggccctgggcaggctgctggtggtctaccccgtcaattcctttacgactcggaccgatg

SEQ ID NO: 15242 - DNA, 203 bp, Homo sapiens
ggcgcgccagtcctccgaagttgtctgacacaactgtgttcactagcaacctcaaacagacaccatggtgcatctgactttcttggcaaagtctgccgttactgccctgtggggcaaggtgaacgtggatgaagttggtggtgaggccctgggcaggctgctggtggtctacccttggacccagaggtcgactcggaccgatg

SEQ ID NO: 15243 - DNA, 203 bp, Homo sapiens
ggcgcgccagtcctccgacccgagctgacacaactgtgttcactagcaacctcaaacagacaccatggtgcatctgactttcttggcaaagtctgccgttactgccctgtggggcaaggtgaacgtggatgaagttggtggtgaggccctgggcaggctgctggtggtctacccttggacctactccccgactcggaccgatg

SEQ ID NO: 15244 - DNA, 203 bp, Homo sapiens
ggcgcgccagtcctgctggtgaacctgacacaactgtgttcactagcaacctcaaacagacaccatggtgcatctgcacggaatcgagaagtctgccgttactgccctgtggggcaaggtgaacgtggatgaagttggtggtgaggccctgggcaggctgctggtggtctaccccgtcaattcctttacgactcggaccgatg

SEQ ID NO: 15245 - DNA, 203 bp, Homo sapiens
ggcgcgccagtccttaaatccaggctgacacaactgtgttcactagcaacctcaaacagacaccatggtgcatctgcacggaatcgagaagtctgccgttactgccctgtggggcaaggtgaacgtggatgaagttggtggtgaggccctgggcaggctgctggtggtctacccttggacctactccccgactcggaccgatg

SEQ ID NO: 15246 - DNA, 203 bp, Homo sapiens
ggcgcgccagtcctactaggacgcctgacacaactgtgttcactagcaacctcaaacagacaccatggtgcatctgcgtcaattcctttagtctgccgttactgccctgtggggcaaggtgaacgtggatgaagttggtggtgaggccctgggcaggctgctggtggtctaccccacggaatcgagaacgactcggaccgatg

SEQ ID NO: 15247 - DNA, 203 bp, Homo sapiens
ggcgcgccagtcctactggacgcactgacacaactgtgttcactagcaacctcaaacagacaccatggtgcatctgcgtcaattcctttagtctgccgttactgccctgtggggcaaggtgaacgtggatgaagttggtggtgaggccctgggcaggctgctggtggtctaccccgtcaattcctttacgactcggaccgatg

SEQ ID NO: 15248 - DNA, 203 bp, Homo sapiens
ggcgcgccagtccttggacgctaactgacacaactgtgttcactagcaacctcaaacagacaccatggtgcatctgcgtcaattcctttagtctgccgttactgccctgtggggcaaggtgaacgtggatgaagttggtggtgaggccctgggcaggctgctggtggtctacccttggacccagaggtcgactcggaccgatg

SEQ ID NO: 15249 - DNA, 203 bp, Homo sapiens
ggcgcgccagtcctgcgtcccagactgacacaactgtgttcactagcaacctcaaacagacaccatggtgcatctgtactcccaggagaagtctgccgttactgccctgtggggcaaggtgaacgtggatgaagttggtggtgaggccctgggcaggctgctggtggtctacccttggacctactccccgactcggaccgatg

SEQ ID NO: 15250 - DNA, 203 bp, Homo sapiens
ggcgcgccagtcctggatccaagactgacacaactgtgttcactagcaacctcaaacagacaccatggtgcattaagccgcaggctccactcctggtggtgcccttccgtcaattcctttaagtttcagctttgcaaccatactccccccggaacccctgctggtggtctacccttggacccagaggtcgactcggaccgatg

SEQ ID NO: 15251 - DNA, 203 bp, Homo sapiens
ggcgcgccagtcctatacccgagcctgacacaactgtgttcactagcaacctcaaacagacaccatggtgcgcccttccgtcaattcctttaagtttcagctttgcaaccatactccccccggaacccaaagactttggtttcccggaagctgcccgctgctggtggtctacccttggacccagaggtcgactcggaccgatg

SEQ ID NO: 15252 - DNA, 203 bp, Homo sapiens
ggcgcgccagtccttcacgcttcgctgacacaactgtgttcactagcaacctcaaacagacaccatggtgtgcccttccgtcaattcctttaagtttcagctttgcaaccatactccccccggaacccaaagactttggtttcccggaagctgcccggcgctggtggtctacccttggacccagaggtcgactcggaccgatg

SEQ ID NO: 15253 - DNA, 203 bp, Homo sapiens
ggcgcgccagtcctatcacgcttgctgacacaactgtgttcactagcaacctcaaacagacaccatggtgttcttggcaaatgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15254 - DNA, 203 bp, Homo sapiens
ggcgcgccagtcctccgaggttcgctgacacaactgtgttcactagcaacctcaaacagacaccatggttcttggcaaacctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 15255 - DNA, 203 bp, Homo sapiens
ggcgcgccagtccttgtagaacacctgacacaactgtgttcactagcaacctcaaacagacaccatggttcttggcaaacctgaggagaagtctgccgttactgccctgtggggcaaggtgaacgtggatgaagttggtgttcttggcaaaggcaggcttcttggcaaatacccttggacccagaggtcgactcggaccgatg

SEQ ID NO: 15256 - DNA, 203 bp, Homo sapiens
ggcgcgccagtcctcagagatcacctgacacaactgtgttcactagcaacctcaaacagacaccatggttcttggcaaacctgaggagaagtctgccgttactgccctgtggggcaaggtgattcttggcaaagttggtggtgaggccctgggcaggctgctggtggtctacccttggacccagaggtcgactcggaccgatg

SEQ ID NO: 15257 - DNA, 203 bp, Homo sapiens
ggcgcgccagtcctgaaatgctcgctgacacaactgtgttcactagcaacctcaaacagacaccatggttcttggcaaacctgaggagaagtctgccgttactgccctgtggggcaaggtgattcttggcaaagttggtggtgaggccctgggcaggcttcttggcaaatacccttggacccagaggtcgactcggaccgatg

SEQ ID NO: 15258 - DNA, 203 bp, Homo sapiens
ggcgcgccagtcctacgaaatgctctgacacaactgtgttcactagcaacctcaaacagacaccatggttcttggcaaacctgaggagaagtctgccgttactgccctgtggggcaaggtgattcttggcaaagttggtgttcttggcaaaggcaggctgctggtggtctacccttggacccagaggtcgactcggaccgatg

SEQ ID NO: 15259 - DNA, 203 bp, Homo sapiens
ggcgcgccagtcctacagcccagcctgacacaactgtgttcactagcaacctcaaacagacaccatggttcttggcaaacctgaggagaagtctgccgttactgttcttggcaaaaaggtgattcttggcaaagttggtggtgaggccctgggcaggctgctggtggtctacccttggacccagaggtcgactcggaccgatg

SEQ ID NO: 15260 - DNA, 203 bp, Homo sapiens
ggcgcgccagtcctcacctaccctctgacacaactgtgttcactagcaacctcaaacagacaccatggttcttggcaaacctgaggagaagtctgccgttactgttcttggcaaaaaggtgattcttggcaaagttggtgttcttggcaaaggcaggcttcttggcaaatacccttggacccagaggtcgactcggaccgatg

SEQ ID NO: 15261 - DNA, 203 bp, Homo sapiens
ggcgcgccagtcctcaaccctgcactgacacaactgtgttcactagcaacctcaaacagacaccatggttcttggcaaacctgaggttcttggcaaagttactgccctgtggggcaaggtgattcttggcaaagttggtggtgaggccctgggcaggctgctggtggtctacccttggacccagaggtcgactcggaccgatg

SEQ ID NO: 15262 - DNA, 203 bp, Homo sapiens
ggcgcgccagtcctagggtgctgcctgacacaactgtgttcactagcaacctcaaacagacaccatggttcttggcaaacctgaggttcttggcaaagttactgttcttggcaaaaaggtgaacgtggatgaagttggtggtgaggccctgggcaggctgctggtggtctacccttggacccagaggtcgactcggaccgatg

SEQ ID NO: 15263 - DNA, 203 bp, Homo sapiens
ggcgcgccagtcctaactttagggctgacacaactgtgttcactagcaacctcaaacagacaccatggttcttggcaaacctgaggttcttggcaaagttactgttcttggcaaaaaggtgaacgtggatgaagttggtggtgaggccctgggcaggcttcttggcaaatacccttggacccagaggtcgactcggaccgatg

SEQ ID NO: 15264 - DNA, 203 bp, Homo sapiens
ggcgcgccagtcctccctaagttactgacacaactgtgttcactagcaacctcaaacagacaccatggttcttggcaaacctgaggttcttggcaaagttactgttcttggcaaaaaggtgattcttggcaaagttggtggtgaggccctgggcaggcttcttggcaaatacccttggacccagaggtcgactcggaccgatg

SEQ ID NO: 15265 - DNA, 203 bp, Homo sapiens
ggcgcgccagtccttgtctgagggctgacacaactgtgttcactagcaacctcaaacagacaccatgtactccccccggaacccaaagactttggtttcccggaagctgcccggcgggtcatgggaataacgccgccgcatcgccggtcggcatcgtttattggtggtctacccttggacccagaggtcgactcggaccgatg

SEQ ID NO: 15266 - DNA, 203 bp, Homo sapiens
ggcgcgccagtcctttgcgtagggctgacacaactgtgttcactagcaacctcaaacagacaccatgtactccctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15267 - DNA, 203 bp, Homo sapiens
ggcgcgccagtcctaagggtatctctgacacaactgtgttcactagcaacctcaaacagacaccatgtcaaattaagccgcaggctccactcctggtggtgcccttccgtcaattcctttaagtttcagctttgcaaccatactccccccggaacccaaagaggtggtctacccttggacccagaggtcgactcggaccgatg

SEQ ID NO: 15268 - DNA, 203 bp, Homo sapiens
ggcgcgccagtcctagagggtcatctgacacaactgtgttcactagcaacctcaaacagacaccatgtcaaattaagccgcaggctccactcctggtggtgcccttccgtcaattcctttaagtttcagctttgcaaccatactccccccggaacccaaagtggtggtctacccttggacccagaggtcgactcggaccgatg

SEQ ID NO: 15269 - DNA, 203 bp, Homo sapiens
ggcgcgccagtcctgcagagggttctgacacaactgtgttcactagcaacctcaaacagacaccatgtggtgcccttccgtcaattcctttaagtttcagctttgcaaccatactccccccggaacccaaagactttggtttcccggaagctgcccggcgggggtggtctacccttggacccagaggtcgactcggaccgatg

SEQ ID NO: 15270 - DNA, 203 bp, Homo sapiens
ggcgcgccagtcctccgagggtgcctgacacaactgtgttcactagcaacctcaaacagacacgtcaattcctttaactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15271 - DNA, 203 bp, Homo sapiens
ggcgcgccagtcctcagtcccttcctgacacaactgtgttcactagcaacctcaaacagacacgtcaattcctttaactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15272 - DNA, 203 bp, Homo sapiens
ggcgcgccagtccttagggttgtactgacacaactgtgttcactagcaacctcaaacagacacttcttggcaaatgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15273 - DNA, 203 bp, Homo sapiens
ggcgcgccagtcctggtcccttggctgacacaactgtgttcactagcaacctcaaacagacatactcccgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15274 - DNA, 203 bp, Homo sapiens
ggcgcgccagtccttagggactgactgacacaactgtgttcactagcaacctcaaacagacatactcccgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15275 - DNA, 203 bp, Homo sapiens
ggcgcgccagtcctggtctaccctctgacacaactgtgttcactagcaacctcaaacagaccaaccatactccccccggaacccaaagactttggtttcccggaagctgcccggcgggtcatgggaataacgccgccgcatcgccggtcggcatcgtttatggtcggtctacccttggacccagaggtcgactcggaccgatg

SEQ ID NO: 15276 - DNA, 203 bp, Homo sapiens
ggcgcgccagtccttgctagagggctgacacaactgtgttcactagcaacctcaaacagaccggcgggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15277 - DNA, 203 bp, Homo sapiens
ggcgcgccagtcctccctcgcacactgacacaactgtgttcactagcaacctcaaacagaccggcgggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15278 - DNA, 203 bp, Homo sapiens
ggcgcgccagtcctctaccgagggctgacacaactgtgttcactagcaacctcaaacagaccggcgggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15279 - DNA, 203 bp, Homo sapiens
ggcgcgccagtcctcccttaaagactgacacaactgtgttcactagcaacctcaaacagacgtcaattcctttatgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15280 - DNA, 203 bp, Homo sapiens
ggcgcgccagtcctccctagtaagctgacacaactgtgttcactagcaacctcaaacagacgttgagtcaaattaagccgcaggctccactcctggtggtgcccttccgtcaattcctttaagtttcagctttgcaaccatactccccccggaacccaaagactttgtctacccttggacccagaggtcgactcggaccgatg

SEQ ID NO: 15281 - DNA, 203 bp, Homo sapiens
ggcgcgccagtcctcagggtgcttctgacacaactgtgttcactagcaacctcaaacagagcaaccatactccccccggaacccaaagactttggtttcccggaagctgcccggcgggtcatgggaataacgccgccgcatcgccggtcggcatcgtttatggtcggactacccttggacccagaggtcgactcggaccgatg

SEQ ID NO: 15282 - DNA, 203 bp, Homo sapiens
ggcgcgccagtcctacgtagggatctgacacaactgtgttcactagcaacctcaaacaggcgaccaaaggaaccataactgatttaatgagccattcgcagtttcactgtaccggccgtgcgtactcagacatgcatggcttaatctttgagacaagcatatgctactgtacccttggacccagaggtcgactcggaccgatg

SEQ ID NO: 15283 - DNA, 203 bp, Homo sapiens
ggcgcgccagtcctgagaaaccctctgacacaactgtgttcactagcaacctcaaacattcttggcaaagcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15284 - DNA, 203 bp, Homo sapiens
ggcgcgccagtcctccctgttaggctgacacaactgtgttcactagcaacctcaaacattcttggcaaagcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15285 - DNA, 203 bp, Homo sapiens
ggcgcgccagtcctagggacagtcctgacacaactgtgttcactagcaacctcaaacattcttggcaaagcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15286 - DNA, 203 bp, Homo sapiens
ggcgcgccagtccttccctactgactgacacaactgtgttcactagcaacctcaaacccgtgttgagtcaaattaagccgcaggctccactcctggtggtgcccttccgtcaattcctttaagtttcagctttgcaaccatactccccccggaacccaaagactttggtttcccttggacccagaggtcgactcggaccgatg

SEQ ID NO: 15287 - DNA, 203 bp, Homo sapiens
ggcgcgccagtcctccctacgcatctgacacaactgtgttcactagcaacctcaaacgagcgaccaaaggaaccataactgatttaatgagccattcgcagtttcactgtaccggccgtgcgtactcagacatgcatggcttaatctttgagacaagcatatgctactggccccttggacccagaggtcgactcggaccgatg

SEQ ID NO: 15288 - DNA, 203 bp, Homo sapiens
ggcgcgccagtcctccctactacactgacacaactgtgttcactagcaacctcaaacggtatctgatcgtcttcgaacctccgactttcgttcttgattaatgaaaacattcttggcaaatgctttcgctctggtccgtcttgcgccggtccaagaatttcacctctagcgcccttggacccagaggtcgactcggaccgatg

SEQ ID NO: 15289 - DNA, 203 bp, Homo sapiens
ggcgcgccagtcctaagggtagagctgacacaactgtgttcactagcaacctcaacacggaatcgagaagcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15290 - DNA, 203 bp, Homo sapiens
ggcgcgccagtcctccctcttgtactgacacaactgtgttcactagcaacctcaacgtcaattcctttagcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15291 - DNA, 203 bp, Homo sapiens
ggcgcgccagtcctgtccctagtactgacacaactgtgttcactagcaacctcaagcgagcgaccaaaggaaccataactgatttaatgagccattcgcagtttcactgtaccggccgtgcgtactcagacatgcatggcttaatctttgagacaagcatatgctactggcagcttggacccagaggtcgactcggaccgatg

SEQ ID NO: 15292 - DNA, 203 bp, Homo sapiens
ggcgcgccagtcctcccttgttctctgacacaactgtgttcactagcaacctcaagctttgcaaccatactccccccggaacccaaagactttggtttcccggaagctgcccggcgggtcatgggaataacgccgccgcatcgccggtcggcatcgtttatggtcggaactaccttggacccagaggtcgactcggaccgatg

SEQ ID NO: 15293 - DNA, 203 bp, Homo sapiens
ggcgcgccagtcctatgtcccttgctgacacaactgtgttcactagcaacctcaatactcccccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15294 - DNA, 203 bp, Homo sapiens
ggcgcgccagtcctgtggtaccctctgacacaactgtgttcactagcaacctcaatcccgtgttgagtcaaattaagccgcaggctccactcctggtggtgcccttccgtcaattcctttaagtttcagctttgcaaccatactccccccggaacccaaagactttggtttcccttggacccagaggtcgactcggaccgatg

SEQ ID NO: 15295 - DNA, 203 bp, Homo sapiens
ggcgcgccagtcctaccgaagggtctgacacaactgtgttcactagcaacctcaccggccgtccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15296 - DNA, 203 bp, Homo sapiens
ggcgcgccagtcctcaccctctctctgacacaactgtgttcactagcaacctcaccggccgtccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15297 - DNA, 203 bp, Homo sapiens
ggcgcgccagtccttaaaccctgcctgacacaactgtgttcactagcaacctcagacggtatctgatcgtcttcgaacctccgactttcgttcttgattaatgaaaacattcttggcaaatgctttcgctctggtccgtcttgcgccggtccaagaatttcacctctagcggcgttggacccagaggtcgactcggaccgatg

SEQ ID NO: 15298 - DNA, 203 bp, Homo sapiens
ggcgcgccagtcctcagggtttgactgacacaactgtgttcactagcaacctcattcttggcaaatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 15299 - DNA, 203 bp, Homo sapiens
ggcgcgccagtcctacgtgtcgccctgacacaactgtgttcactagcaacctcccggcgggtccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15300 - DNA, 203 bp, Homo sapiens
ggcgcgccagtcctgcgtgtcccactgacacaactgtgttcactagcaacctcccggcgggtccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15301 - DNA, 203 bp, Homo sapiens
ggcgcgccagtcctgacacggtttctgacacaactgtgttcactagcaacctcggaattaaccagacaaatcgctccaccaactaagaacggccatgcaccaccacccacggaatcgagaaagagctatcaatctgtcaatcctgtccgtgtccgggccgggtgaggtttcccgtgggacccagaggtcgactcggaccgatg

SEQ ID NO: 15302 - DNA, 203 bp, Homo sapiens
ggcgcgccagtcctgcgctaccacctgacacaactgtgttcactagcaacctctttcccgtgttgagtcaaattaagccgcaggctccactcctggtggtgcccttccgtcaattcctttaagtttcagctttgcaaccatactccccccggaacccaaagactttggtttcccgtggacccagaggtcgactcggaccgatg

SEQ ID NO: 15303 - DNA, 203 bp, Homo sapiens
ggcgcgccagtccttgcgtagcgcctgacacaactgtgttcactagcaacctggagcgagcgaccaaaggaaccataactgatttaatgagccattcgcagtttcactgtaccggccgtgcgtactcagacatgcatggcttaatctttgagacaagcatatgctactggcaggatggacccagaggtcgactcggaccgatg

SEQ ID NO: 15304 - DNA, 203 bp, Homo sapiens
ggcgcgccagtccttgtagcgcttctgacacaactgtgttcactagcaacctgtttcccgtgttgagtcaaattaagccgcaggctccactcctggtggtgcccttccgtcaattcctttaagtttcagctttgcaaccatactccccccggaacccaaagactttggtttcccggggacccagaggtcgactcggaccgatg

SEQ ID NO: 15305 - DNA, 203 bp, Homo sapiens
ggcgcgccagtccttctgcatgaactgacacaactgtgttcactagcaaccttcttggcaaaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15306 - DNA, 203 bp, Homo sapiens
ggcgcgccagtcctattgtagttactgacacaactgtgttcactagcaaccttcttggcaaaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15307 - DNA, 203 bp, Homo sapiens
ggcgcgccagtcctattgtcgtgcctgacacaactgtgttcactagcaacgaggagcgagcgaccaaaggaaccataactgatttaatgagccattcgcagtttcactgtaccggccgtgcgtactcagacatgcatggcttaatctttgagacaagcatatgctactggcaggatcaacccagaggtcgactcggaccgatg

SEQ ID NO: 15308 - DNA, 203 bp, Homo sapiens
ggcgcgccagtcctggtcctaaccctgacacaactgtgttcactagcaactactcccagacaccatggtactcccgactcctgaggagaagtctgccgttactgccctgtggggcaaggtgaacgtggatgaagttggtgtactccccctgggcaggctactcccggtctaccctttactcccgaggtcgactcggaccgatg

SEQ ID NO: 15309 - DNA, 203 bp, Homo sapiens
ggcgcgccagtcctcgagatcgaactgacacaactgtgttcactagcaactactcccagacaccatggtactcccgactcctgaggagaagtctgccgttactgccctgtggggcaaggtgatactccctgaagttggtggtgaggccctgggcaggctactcccggtctacccttggacccagaggtcgactcggaccgatg

SEQ ID NO: 15310 - DNA, 203 bp, Homo sapiens
ggcgcgccagtcctgacgatctcgctgacacaactgtgttcactagcaactactcccagacaccatggtactcccgactcctgaggagaagtctgccgttactgccctgtggggcaaggtgatactccctgaagttggtggtgaggccctgggcaggctactcccggtctaccctttactcccgaggtcgactcggaccgatg

SEQ ID NO: 15311 - DNA, 203 bp, Homo sapiens
ggcgcgccagtcctgcaacgcaatctgacacaactgtgttcactagcaactactcccagacaccatggtactcccgactcctgaggagaagtctgccgttactgccctgtggggcaaggtgatactccctgaagttggtggtgaggccctgggcaggctgctggtggtctacccttggacccagaggtcgactcggaccgatg

SEQ ID NO: 15312 - DNA, 203 bp, Homo sapiens
ggcgcgccagtccttagattgcgtctgacacaactgtgttcactagcaactactcccagacaccatggtactcccgactcctgaggagaagtctgccgttactgtactcccgggcaaggtgaacgtggatgaagttggtggtgaggccctgggcaggctactcccggtctaccctttactcccgaggtcgactcggaccgatg

SEQ ID NO: 15313 - DNA, 203 bp, Homo sapiens
ggcgcgccagtcctgatcgggtaactgacacaactgtgttcactagcaactactcccagacaccatggtactcccgactcctgaggagaagtctgccgttactgtactcccgggcaaggtgaacgtggatgaagttggtgtactccccctgggcaggctactcccggtctaccctttactcccgaggtcgactcggaccgatg

SEQ ID NO: 15314 - DNA, 203 bp, Homo sapiens
ggcgcgccagtcctgcgcattgtgctgacacaactgtgttcactagcaactactcccagacaccatggtactcccgactcctgaggagaagtctgccgttactgtactcccgggcaaggtgatactccctgaagttggtggtgaggccctgggcaggctgctggtggtctacccttggacccagaggtcgactcggaccgatg

SEQ ID NO: 15315 - DNA, 203 bp, Homo sapiens
ggcgcgccagtcctctgaatgcgcctgacacaactgtgttcactagcaactactcccagacaccatggtactcccgactcctgaggagaagtctgccgttactgtactcccgggcaaggtgatactccctgaagttggtggtgaggccctgggcaggctgctggtggtctaccctttactcccgaggtcgactcggaccgatg

SEQ ID NO: 15316 - DNA, 203 bp, Homo sapiens
ggcgcgccagtcctacgtcaatcactgacacaactgtgttcactagcaactactcccagacaccatggtactcccgactcctgaggagaagtctgccgttactgtactcccgggcaaggtgatactccctgaagttggtgtactccccctgggcaggctgctggtggtctacccttggacccagaggtcgactcggaccgatg

SEQ ID NO: 15317 - DNA, 203 bp, Homo sapiens
ggcgcgccagtcctaatgattgacctgacacaactgtgttcactagcaactactcccagacaccatggtactcccgactcctgaggagaagtctgccgttactgtactcccgggcaaggtgatactccctgaagttggtgtactccccctgggcaggctgctggtggtctaccctttactcccgaggtcgactcggaccgatg

SEQ ID NO: 15318 - DNA, 203 bp, Homo sapiens
ggcgcgccagtccttctagctggactgacacaactgtgttcactagcaactactcccagacaccatggtactcccgactcctgaggtactccctgccgttactgccctgtggggcaaggtgaacgtggatgaagttggtgtactccccctgggcaggctgctggtggtctacccttggacccagaggtcgactcggaccgatg

SEQ ID NO: 15319 - DNA, 203 bp, Homo sapiens
ggcgcgccagtcctcagtagctggctgacacaactgtgttcactagcaactactcccagacaccatggtactcccgactcctgaggtactccctgccgttactgccctgtggggcaaggtgaacgtggatgaagttggtgtactccccctgggcaggctgctggtggtctaccctttactcccgaggtcgactcggaccgatg

SEQ ID NO: 15320 - DNA, 203 bp, Homo sapiens
ggcgcgccagtcctgtaagctggactgacacaactgtgttcactagcaactactcccagacaccatggtactcccgactcctgaggtactccctgccgttactgccctgtggggcaaggtgatactccctgaagttggtggtgaggccctgggcaggctactcccggtctaccctttactcccgaggtcgactcggaccgatg

SEQ ID NO: 15321 - DNA, 203 bp, Homo sapiens
ggcgcgccagtccttcagagctggctgacacaactgtgttcactagcaactactcccagacaccatggtactcccgactcctgaggtactccctgccgttactgccctgtggggcaaggtgatactccctgaagttggtggtgaggccctgggcaggctgctggtggtctaccctttactcccgaggtcgactcggaccgatg

SEQ ID NO: 15322 - DNA, 203 bp, Homo sapiens
ggcgcgccagtcctctcgacgtcactgacacaactgtgttcactagcaactactcccagacaccatggtactcccgactcctgaggtactccctgccgttactgccctgtggggcaaggtgatactccctgaagttggtgtactccccctgggcaggctgctggtggtctacccttggacccagaggtcgactcggaccgatg

SEQ ID NO: 15323 - DNA, 203 bp, Homo sapiens
ggcgcgccagtcctgcccggtaacctgacacaactgtgttcactagcaactactcccagacaccatggtactcccgactcctgaggtactccctgccgttactgccctgtggggcaaggtgatactccctgaagttggtgtactccccctgggcaggctgctggtggtctaccctttactcccgaggtcgactcggaccgatg

SEQ ID NO: 15324 - DNA, 203 bp, Homo sapiens
ggcgcgccagtcctcgcccgagatctgacacaactgtgttcactagcaactactcccagacaccatggtactcccgactcctgaggtactccctgccgttactgtactcccgggcaaggtgaacgtggatgaagttggtggtgaggccctgggcaggctactcccggtctacccttggacccagaggtcgactcggaccgatg

SEQ ID NO: 15325 - DNA, 203 bp, Homo sapiens
ggcgcgccagtccttgcccgttcactgacacaactgtgttcactagcaactactcccagacaccatggtactcccgactcctgaggtactccctgccgttactgtactcccgggcaaggtgaacgtggatgaagttggtggtgaggccctgggcaggctactcccggtctaccctttactcccgaggtcgactcggaccgatg

SEQ ID NO: 15326 - DNA, 203 bp, Homo sapiens
ggcgcgccagtcctagcccgatccctgacacaactgtgttcactagcaactactcccagacaccatggtactcccgactcctgaggtactccctgccgttactgtactcccgggcaaggtgaacgtggatgaagttggtggtgaggccctgggcaggctgctggtggtctacccttggacccagaggtcgactcggaccgatg

SEQ ID NO: 15327 - DNA, 203 bp, Homo sapiens
ggcgcgccagtcctcagcccgtgcctgacacaactgtgttcactagcaactactcccagacaccatggtactcccgactcctgaggtactccctgccgttactgtactcccgggcaaggtgaacgtggatgaagttggtggtgaggccctgggcaggctgctggtggtctaccctttactcccgaggtcgactcggaccgatg

SEQ ID NO: 15328 - DNA, 203 bp, Homo sapiens
ggcgcgccagtcctgagcccgatcctgacacaactgtgttcactagcaactactcccagacaccatggtactcccgactcctgaggtactccctgccgttactgtactcccgggcaaggtgaacgtggatgaagttggtgtactccccctgggcaggctactcccggtctacccttggacccagaggtcgactcggaccgatg

SEQ ID NO: 15329 - DNA, 203 bp, Homo sapiens
ggcgcgccagtcctttagcccgatctgacacaactgtgttcactagcaactactcccagacaccatggtactcccgactcctgaggtactccctgccgttactgtactcccgggcaaggtgatactccctgaagttggtggtgaggccctgggcaggctgctggtggtctaccctttactcccgaggtcgactcggaccgatg

SEQ ID NO: 15330 - DNA, 203 bp, Homo sapiens
ggcgcgccagtccttaggcccgaactgacacaactgtgttcactagcaactactcccagacaccatggtactcccgactcctgaggtactccctgccgttactgtactcccgggcaaggtgatactccctgaagttggtgtactccccctgggcaggctactcccggtctacccttggacccagaggtcgactcggaccgatg

SEQ ID NO: 15331 - DNA, 203 bp, Homo sapiens
ggcgcgccagtcctacgcccgtttctgacacaactgtgttcactagcaactactcccagacaccatggtactcccgactcctgaggtactccctgccgttactgtactcccgggcaaggtgatactccctgaagttggtgtactccccctgggcaggctactcccggtctaccctttactcccgaggtcgactcggaccgatg

SEQ ID NO: 15332 - DNA, 203 bp, Homo sapiens
ggcgcgccagtcctgcccgtcgctctgacacaactgtgttcactagcaactactcccagacaccatggtgcatctgactcctgaggagaagtctgccgttactgccctgtggggcaaggtgaacgtggatgaagttggtggtgaggccctgggcaggctactcccggtctaccctttactcccgaggtcgactcggaccgatg

SEQ ID NO: 15333 - DNA, 203 bp, Homo sapiens
ggcgcgccagtcctgcccgacctgctgacacaactgtgttcactagcaactactcccagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15334 - DNA, 203 bp, Homo sapiens
ggcgcgccagtcctgcccgtacacctgacacaactgtgttcactagcaactactcccagacaccatggtgcatctgactcctgaggagaagtctgccgttactgccctgtggggcaaggtgaacgtggatgaagttggtggtgaggccctgggcaggctgctggtggtctaccctttactcccgaggtcgactcggaccgatg

SEQ ID NO: 15335 - DNA, 203 bp, Homo sapiens
ggcgcgccagtccttactcgggcgctgacacaactgtgttcactagcaactactcccagacaccatggtgcatctgactcctgaggagaagtctgccgttactgccctgtggggcaaggtgaacgtggatgaagttggtgtactccccctgggcaggctactcccggtctaccctttactcccgaggtcgactcggaccgatg

SEQ ID NO: 15336 - DNA, 203 bp, Homo sapiens
ggcgcgccagtccttggtcgggctctgacacaactgtgttcactagcaactactcccagacaccatggtgcatctgactcctgaggagaagtctgccgttactgccctgtggggcaaggtgatactccctgaagttggtggtgaggccctgggcaggctgctggtggtctacccttggacccagaggtcgactcggaccgatg

SEQ ID NO: 15337 - DNA, 203 bp, Homo sapiens
ggcgcgccagtcctaggacgggccctgacacaactgtgttcactagcaactactcccagacaccatggtgcatctgactcctgaggagaagtctgccgttactgccctgtggggcaaggtgatactccctgaagttggtggtgaggccctgggcaggctgctggtggtctaccctttactcccgaggtcgactcggaccgatg

SEQ ID NO: 15338 - DNA, 203 bp, Homo sapiens
ggcgcgccagtcctacgggcaaccctgacacaactgtgttcactagcaactactcccagacaccatggtgcatctgactcctgaggagaagtctgccgttactgccctgtggggcaaggtgatactccctgaagttggtgtactccccctgggcaggctactcccggtctaccctttactcccgaggtcgactcggaccgatg

SEQ ID NO: 15339 - DNA, 203 bp, Homo sapiens
ggcgcgccagtcctggacacgggcctgacacaactgtgttcactagcaactactcccagacaccatggtgcatctgactcctgaggagaagtctgccgttactgccctgtggggcaaggtgatactccctgaagttggtgtactccccctgggcaggctgctggtggtctacccttggacccagaggtcgactcggaccgatg

SEQ ID NO: 15340 - DNA, 203 bp, Homo sapiens
ggcgcgccagtcctacgggcgtatctgacacaactgtgttcactagcaactactcccagacaccatggtgcatctgactcctgaggagaagtctgccgttactgtactcccgggcaaggtgaacgtggatgaagttggtggtgaggccctgggcaggctgctggtggtctaccctttactcccgaggtcgactcggaccgatg

SEQ ID NO: 15341 - DNA, 203 bp, Homo sapiens
ggcgcgccagtcctctcgggcggtctgacacaactgtgttcactagcaactactcccagacaccatggtgcatctgactcctgaggagaagtctgccgttactgtactcccgggcaaggtgaacgtggatgaagttggtgtactccccctgggcaggctactcccggtctacccttggacccagaggtcgactcggaccgatg

SEQ ID NO: 15342 - DNA, 203 bp, Homo sapiens
ggcgcgccagtcctgcgggcggtactgacacaactgtgttcactagcaactactcccagacaccatggtgcatctgactcctgaggagaagtctgccgttactgtactcccgggcaaggtgaacgtggatgaagttggtgtactccccctgggcaggctactcccggtctaccctttactcccgaggtcgactcggaccgatg

SEQ ID NO: 15343 - DNA, 203 bp, Homo sapiens
ggcgcgccagtcctttcgggccttctgacacaactgtgttcactagcaactactcccagacaccatggtgcatctgactcctgaggagaagtctgccgttactgtactcccgggcaaggtgaacgtggatgaagttggtgtactccccctgggcaggctgctggtggtctacccttggacccagaggtcgactcggaccgatg

SEQ ID NO: 15344 - DNA, 203 bp, Homo sapiens
ggcgcgccagtccttacgctagagctgacacaactgtgttcactagcaactactcccagacaccatggtgcatctgactcctgaggagaagtctgccgttactgtactcccgggcaaggtgaacgtggatgaagttggtgtactccccctgggcaggctgctggtggtctaccctttactcccgaggtcgactcggaccgatg

SEQ ID NO: 15345 - DNA, 203 bp, Homo sapiens
ggcgcgccagtcctctcgtagcatctgacacaactgtgttcactagcaactactcccagacaccatggtgcatctgactcctgaggagaagtctgccgttactgtactcccgggcaaggtgatactccctgaagttggtggtgaggccctgggcaggctgctggtggtctaccctttactcccgaggtcgactcggaccgatg

SEQ ID NO: 15346 - DNA, 203 bp, Homo sapiens
ggcgcgccagtcctatgctactagctgacacaactgtgttcactagcaactactcccagacaccatggtgcatctgactcctgaggagaagtctgccgttactgtactcccgggcaaggtgatactccctgaagttggtgtactccccctgggcaggctactcccggtctaccctttactcccgaggtcgactcggaccgatg

SEQ ID NO: 15347 - DNA, 203 bp, Homo sapiens
ggcgcgccagtcctttgaatgctactgacacaactgtgttcactagcaactactcccagacaccatggtgcatctgactcctgaggagaagtctgccgttactgtactcccgggcaaggtgatactccctgaagttggtgtactccccctgggcaggctgctggtggtctacccttggacccagaggtcgactcggaccgatg

SEQ ID NO: 15348 - DNA, 203 bp, Homo sapiens
ggcgcgccagtcctactcatgctactgacacaactgtgttcactagcaactactcccagacaccatggtgcatctgactcctgaggtactccctgccgttactgccctgtggggcaaggtgaacgtggatgaagttggtggtgaggccctgggcaggctactcccggtctacccttggacccagaggtcgactcggaccgatg

SEQ ID NO: 15349 - DNA, 203 bp, Homo sapiens
ggcgcgccagtcctatgctaggacctgacacaactgtgttcactagcaactactcccagacaccatggtgcatctgactcctgaggtactccctgccgttactgccctgtggggcaaggtgaacgtggatgaagttggtggtgaggccctgggcaggctactcccggtctaccctttactcccgaggtcgactcggaccgatg

SEQ ID NO: 15350 - DNA, 203 bp, Homo sapiens
ggcgcgccagtccttagcatacgcctgacacaactgtgttcactagcaactactcccagacaccatggtgcatctgactcctgaggtactccctgccgttactgccctgtggggcaaggtgaacgtggatgaagttggtggtgaggccctgggcaggctgctggtggtctacccttggacccagaggtcgactcggaccgatg

SEQ ID NO: 15351 - DNA, 203 bp, Homo sapiens
ggcgcgccagtcctagaaagaatgctgacacaactgtgttcactagcaactactcccagacaccatggtgcatctgactcctgaggtactccctgccgttactgccctgtggggcaaggtgaacgtggatgaagttggtgtactccccctgggcaggctactcccggtctaccctttactcccgaggtcgactcggaccgatg

SEQ ID NO: 15352 - DNA, 203 bp, Homo sapiens
ggcgcgccagtcctacattcttcgctgacacaactgtgttcactagcaactactcccagacaccatggtgcatctgactcctgaggtactccctgccgttactgccctgtggggcaaggtgaacgtggatgaagttggtgtactccccctgggcaggctgctggtggtctacccttggacccagaggtcgactcggaccgatg

SEQ ID NO: 15353 - DNA, 203 bp, Homo sapiens
ggcgcgccagtcctccattcttttctgacacaactgtgttcactagcaactactcccagacaccatggtgcatctgactcctgaggtactccctgccgttactgccctgtggggcaaggtgaacgtggatgaagttggtgtactccccctgggcaggctgctggtggtctaccctttactcccgaggtcgactcggaccgatg

SEQ ID NO: 15354 - DNA, 203 bp, Homo sapiens
ggcgcgccagtcctcccatgtgtcctgacacaactgtgttcactagcaactactcccagacaccatggtgcatctgactcctgaggtactccctgccgttactgccctgtggggcaaggtgatactccctgaagttggtggtgaggccctgggcaggctactcccggtctaccctttactcccgaggtcgactcggaccgatg

SEQ ID NO: 15355 - DNA, 203 bp, Homo sapiens
ggcgcgccagtcctgagcatgtgcctgacacaactgtgttcactagcaactactcccagacaccatggtgcatctgactcctgaggtactccctgccgttactgccctgtggggcaaggtgatactccctgaagttggtggtgaggccctgggcaggctgctggtggtctacccttggacccagaggtcgactcggaccgatg

SEQ ID NO: 15356 - DNA, 203 bp, Homo sapiens
ggcgcgccagtcctgctcatgtgtctgacacaactgtgttcactagcaactactcccagacaccatggtgcatctgactcctgaggtactccctgccgttactgccctgtggggcaaggtgatactccctgaagttggtgtactccccctgggcaggctactcccggtctacccttggacccagaggtcgactcggaccgatg

SEQ ID NO: 15357 - DNA, 203 bp, Homo sapiens
ggcgcgccagtccttacatgtggactgacacaactgtgttcactagcaactactcccagacaccatggtgcatctgactcctgaggtactccctgccgttactgccctgtggggcaaggtgatactccctgaagttggtgtactccccctgggcaggctactcccggtctaccctttactcccgaggtcgactcggaccgatg

SEQ ID NO: 15358 - DNA, 203 bp, Homo sapiens
ggcgcgccagtcctcatgtgcatactgacacaactgtgttcactagcaactactcccagacaccatggtgcatctgactcctgaggtactccctgccgttactgccctgtggggcaaggtgatactccctgaagttggtgtactccccctgggcaggctgctggtggtctacccttggacccagaggtcgactcggaccgatg

SEQ ID NO: 15359 - DNA, 203 bp, Homo sapiens
ggcgcgccagtcctcttcatgtgcctgacacaactgtgttcactagcaactactcccagacaccatggtgcatctgactcctgaggtactccctgccgttactgtactcccgggcaaggtgaacgtggatgaagttggtggtgaggccctgggcaggctactcccggtctacccttggacccagaggtcgactcggaccgatg

SEQ ID NO: 15360 - DNA, 203 bp, Homo sapiens
ggcgcgccagtccttcacatgtgcctgacacaactgtgttcactagcaactactcccagacaccatggtgcatctgactcctgaggtactccctgccgttactgtactcccgggcaaggtgaacgtggatgaagttggtggtgaggccctgggcaggctactcccggtctaccctttactcccgaggtcgactcggaccgatg

SEQ ID NO: 15361 - DNA, 203 bp, Homo sapiens
ggcgcgccagtcctcacatggtacctgacacaactgtgttcactagcaactactcccagacaccatggtgcatctgactcctgaggtactccctgccgttactgtactcccgggcaaggtgaacgtggatgaagttggtggtgaggccctgggcaggctgctggtggtctaccctttactcccgaggtcgactcggaccgatg

SEQ ID NO: 15362 - DNA, 203 bp, Homo sapiens
ggcgcgccagtcctacacatggacctgacacaactgtgttcactagcaactactcccagacaccatggtgcatctgactcctgaggtactccctgccgttactgtactcccgggcaaggtgaacgtggatgaagttggtgtactccccctgggcaggctactcccggtctacccttggacccagaggtcgactcggaccgatg

SEQ ID NO: 15363 - DNA, 203 bp, Homo sapiens
ggcgcgccagtccttctgcacatgctgacacaactgtgttcactagcaactactcccagacaccatggtgcatctgactcctgaggtactccctgccgttactgtactcccgggcaaggtgaacgtggatgaagttggtgtactccccctgggcaggctactcccggtctaccctttactcccgaggtcgactcggaccgatg

SEQ ID NO: 15364 - DNA, 203 bp, Homo sapiens
ggcgcgccagtcctctacacatgtctgacacaactgtgttcactagcaactactcccagacaccatggtgcatctgactcctgaggtactccctgccgttactgtactcccgggcaaggtgaacgtggatgaagttggtgtactccccctgggcaggctgctggtggtctacccttggacccagaggtcgactcggaccgatg

SEQ ID NO: 15365 - DNA, 203 bp, Homo sapiens
ggcgcgccagtcctataccacatgctgacacaactgtgttcactagcaactactcccagacaccatggtgcatctgactcctgaggtactccctgccgttactgtactcccgggcaaggtgatactccctgaagttggtggtgaggccctgggcaggctactcccggtctacccttggacccagaggtcgactcggaccgatg

SEQ ID NO: 15366 - DNA, 203 bp, Homo sapiens
ggcgcgccagtccttccacatgtcctgacacaactgtgttcactagcaactactcccagacaccatggtgcatctgactcctgaggtactccctgccgttactgtactcccgggcaaggtgatactccctgaagttggtggtgaggccctgggcaggctactcccggtctaccctttactcccgaggtcgactcggaccgatg

SEQ ID NO: 15367 - DNA, 203 bp, Homo sapiens
ggcgcgccagtcctgtcacatgggctgacacaactgtgttcactagcaactactcccagacaccatggtgcatctgactcctgaggtactccctgccgttactgtactcccgggcaaggtgatactccctgaagttggtggtgaggccctgggcaggctgctggtggtctacccttggacccagaggtcgactcggaccgatg

SEQ ID NO: 15368 - DNA, 203 bp, Homo sapiens
ggcgcgccagtcctccacatgtaactgacacaactgtgttcactagcaactactcccagacaccatggtgcatctgactcctgaggtactccctgccgttactgtactcccgggcaaggtgatactccctgaagttggtggtgaggccctgggcaggctgctggtggtctaccctttactcccgaggtcgactcggaccgatg

SEQ ID NO: 15369 - DNA, 203 bp, Homo sapiens
ggcgcgccagtccttttaaacctcctgacacaactgtgttcactagcaactactcccagacaccatggtgcatctgactcctgaggtactccctgccgttactgtactcccgggcaaggtgatactccctgaagttggtgtactccccctgggcaggctactcccggtctaccctttactcccgaggtcgactcggaccgatg

SEQ ID NO: 15370 - DNA, 203 bp, Homo sapiens
ggcgcgccagtcctatgagcgtgcctgacacaactgtgttcactagcaacttcttggcaaaaccatggtgcatctgactcctgaggagaagtctgccgttactgccctgtggggcaaggtgaacgtggatgaagttggtgttcttggcaaaggcaggcttcttggcaaatacccttggacccagaggtcgactcggaccgatg

SEQ ID NO: 15371 - DNA, 203 bp, Homo sapiens
ggcgcgccagtcctattgcgtgcactgacacaactgtgttcactagcaacttcttggcaaaaccatggtgcatctgactcctgaggagaagtctgccgttactgccctgtggggcaaggtgattcttggcaaagttggtgttcttggcaaaggcaggcttcttggcaaatacccttggacccagaggtcgactcggaccgatg

SEQ ID NO: 15372 - DNA, 203 bp, Homo sapiens
ggcgcgccagtccttagcacgcacctgacacaactgtgttcactagcaacttcttggcaaaaccatggtgcatctgactcctgaggagaagtctgccgttactgttcttggcaaaaaggtgaacgtggatgaagttggtggtgaggccctgggcaggcttcttggcaaatacccttggacccagaggtcgactcggaccgatg

SEQ ID NO: 15373 - DNA, 203 bp, Homo sapiens
ggcgcgccagtccttttagcacgcctgacacaactgtgttcactagcaacttcttggcaaaaccatggtgcatctgactcctgaggagaagtctgccgttactgttcttggcaaaaaggtgaacgtggatgaagttggtgttcttggcaaaggcaggctgctggtggtctacccttggacccagaggtcgactcggaccgatg

SEQ ID NO: 15374 - DNA, 203 bp, Homo sapiens
ggcgcgccagtcctgagcacgctactgacacaactgtgttcactagcaacttcttggcaaaaccatggtgcatctgactcctgaggagaagtctgccgttactgttcttggcaaaaaggtgattcttggcaaagttggtggtgaggccctgggcaggcttcttggcaaatacccttggacccagaggtcgactcggaccgatg

SEQ ID NO: 15375 - DNA, 203 bp, Homo sapiens
ggcgcgccagtcctatatgtggtgctgacacaactgtgttcactagcaacttcttggcaaaaccatggtgcatctgactcctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15376 - DNA, 203 bp, Homo sapiens
ggcgcgccagtcctgttggatcccctgacacaactgtgttcactagcaacttcttggcaaaaccatggtgcatctgactcctgaggttcttggcaaagttactgccctgtggggcaaggtgaacgtggatgaagttggtgttcttggcaaaggcaggctgctggtggtctacccttggacccagaggtcgactcggaccgatg

SEQ ID NO: 15377 - DNA, 203 bp, Homo sapiens
ggcgcgccagtcctaatttgaaacctgacacaactgtgttcactagcaacttcttggcaaaaccatggtgcatctgactcctgaggttcttggcaaagttactgccctgtggggcaaggtgaacgtggatgaagttggtgttcttggcaaaggcaggcttcttggcaaatacccttggacccagaggtcgactcggaccgatg

SEQ ID NO: 15378 - DNA, 203 bp, Homo sapiens
ggcgcgccagtccttgctgattcgctgacacaactgtgttcactagcaacttcttggcaaaaccatggtgcatctgactcctgaggttcttggcaaagttactgccctgtggggcaaggtgattcttggcaaagttggtggtgaggccctgggcaggcttcttggcaaatacccttggacccagaggtcgactcggaccgatg

SEQ ID NO: 15379 - DNA, 203 bp, Homo sapiens
ggcgcgccagtcctgctgcagtagctgacacaactgtgttcactagcaacttcttggcaaaaccatggtgcatctgactcctgaggttcttggcaaagttactgccctgtggggcaaggtgattcttggcaaagttggtgttcttggcaaaggcaggctgctggtggtctacccttggacccagaggtcgactcggaccgatg

SEQ ID NO: 15380 - DNA, 203 bp, Homo sapiens
ggcgcgccagtcctgttttaagctctgacacaactgtgttcactagcaacttcttggcaaaaccatggtgcatctgactcctgaggttcttggcaaagttactgttcttggcaaaaaggtgaacgtggatgaagttggtggtgaggccctgggcaggcttcttggcaaatacccttggacccagaggtcgactcggaccgatg

SEQ ID NO: 15381 - DNA, 203 bp, Homo sapiens
ggcgcgccagtcctaagattttagctgacacaactgtgttcactagcaacttcttggcaaaaccatggtgcatctgactcctgaggttcttggcaaagttactgttcttggcaaaaaggtgaacgtggatgaagttggtgttcttggcaaaggcaggcttcttggcaaatacccttggacccagaggtcgactcggaccgatg

SEQ ID NO: 15382 - DNA, 203 bp, Homo sapiens
ggcgcgccagtcctattttactggctgacacaactgtgttcactagcaacttcttggcaaaaccatggttcttggcaaacctgaggagaagtctgccgttactgccctgtggggcaaggtgaacgtggatgaagttggtgttcttggcaaaggcaggctgctggtggtctacccttggacccagaggtcgactcggaccgatg

SEQ ID NO: 15383 - DNA, 203 bp, Homo sapiens
ggcgcgccagtcctcgttttaaatctgacacaactgtgttcactagcaacttcttggcaaaaccatggttcttggcaaacctgaggagaagtctgccgttactgttcttggcaaaaaggtgaacgtggatgaagttggtggtgaggccctgggcaggcttcttggcaaatacccttggacccagaggtcgactcggaccgatg

SEQ ID NO: 15384 - DNA, 203 bp, Homo sapiens
ggcgcgccagtccttaaaatcgttctgacacaactgtgttcactagcaacttcttggcaaaaccatggttcttggcaaacctgaggagaagtctgccgttactgttcttggcaaaaaggtgaacgtggatgaagttggtgttcttggcaaaggcaggctgctggtggtctacccttggacccagaggtcgactcggaccgatg

SEQ ID NO: 15385 - DNA, 203 bp, Homo sapiens
ggcgcgccagtcctagttaaaatcctgacacaactgtgttcactagcaacttcttggcaaaaccatggttcttggcaaacctgaggagaagtctgccgttactgttcttggcaaaaaggtgaacgtggatgaagttggtgttcttggcaaaggcaggcttcttggcaaatacccttggacccagaggtcgactcggaccgatg

SEQ ID NO: 15386 - DNA, 203 bp, Homo sapiens
ggcgcgccagtcctgtgttaaaagctgacacaactgtgttcactagcaacttcttggcaaaaccatggttcttggcaaacctgaggagaagtctgccgttactgttcttggcaaaaaggtgattcttggcaaagttggtgttcttggcaaaggcaggctgctggtggtctacccttggacccagaggtcgactcggaccgatg

SEQ ID NO: 15387 - DNA, 203 bp, Homo sapiens
ggcgcgccagtccttaaaattgacctgacacaactgtgttcactagcaacttcttggcaaaaccatggttcttggcaaacctgaggagaagtctgccgttactgttcttggcaaaaaggtgattcttggcaaagttggtgttcttggcaaaggcaggcttcttggcaaatacccttggacccagaggtcgactcggaccgatg

SEQ ID NO: 15388 - DNA, 203 bp, Homo sapiens
ggcgcgccagtcctcctaaaagtcctgacacaactgtgttcactagcaacttcttggcaaaaccatggttcttggcaaacctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15389 - DNA, 203 bp, Homo sapiens
ggcgcgccagtcctgaatctaaaactgacacaactgtgttcactagcaacttcttggcaaaaccatggttcttggcaaacctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15390 - DNA, 203 bp, Homo sapiens
ggcgcgccagtccttagtaaaagtctgacacaactgtgttcactagcaacttcttggcaaaaccatggttcttggcaaacctgaggttcttggcaaagttactgccctgtggggcaaggtgaacgtggatgaagttggtgttcttggcaaaggcaggctgctggtggtctacccttggacccagaggtcgactcggaccgatg

SEQ ID NO: 15391 - DNA, 203 bp, Homo sapiens
ggcgcgccagtccttaggttaaaactgacacaactgtgttcactagcaacttcttggcaaaaccatggttcttggcaaacctgaggttcttggcaaagttactgttcttggcaaaaaggtgaacgtggatgaagttggtggtgaggccctgggcaggctgctggtggtctacccttggacccagaggtcgactcggaccgatg

SEQ ID NO: 15392 - DNA, 203 bp, Homo sapiens
ggcgcgccagtccttaaaagcagtctgacacaactgtgttcactagcaacttcttggcaaaaccatggttcttggcaaacctgaggttcttggcaaagttactgttcttggcaaaaaggtgaacgtggatgaagttggtggtgaggccctgggcaggcttcttggcaaatacccttggacccagaggtcgactcggaccgatg

SEQ ID NO: 15393 - DNA, 203 bp, Homo sapiens
ggcgcgccagtccttaaaagattgctgacacaactgtgttcactagcaacttcttggcaaaaccatggttcttggcaaacctgaggttcttggcaaagttactgttcttggcaaaaaggtgattcttggcaaagttggtggtgaggccctgggcaggcttcttggcaaatacccttggacccagaggtcgactcggaccgatg

SEQ ID NO: 15394 - DNA, 203 bp, Homo sapiens
ggcgcgccagtcctttaacatggactgacacaactgtgttcactagcaacttcttggcaaaaccatggttcttggcaaacctgaggttcttggcaaagttactgttcttggcaaaaaggtgattcttggcaaagttggtgttcttggcaaaggcaggcttcttggcaaatacccttttcttggcaaatcgactcggaccgatg

SEQ ID NO: 15395 - DNA, 203 bp, Homo sapiens
ggcgcgccagtccttatgttacgtctgacacaactgtgttcactagcaagtttcagctttgcaaccatactccccccggaacccaaagactttggtttcccggaagctgcccggcgggtcatgggaataacgccgccgcatcgccggtcggcatcgtttatggtcggaactacgacggtatcagaggtcgactcggaccgatg

SEQ ID NO: 15396 - DNA, 203 bp, Homo sapiens
ggcgcgccagtcctatgttactctctgacacaactgtgttcactagcaattcttggcaaacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 15397 - DNA, 203 bp, Homo sapiens
ggcgcgccagtcctaccatgttacctgacacaactgtgttcactagcacacggaatcgagaaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15398 - DNA, 203 bp, Homo sapiens
ggcgcgccagtcctaaagcgctctctgacacaactgtgttcactagcaccgcaggctccactcctggtggtgcccttccgtcaattcctttaagtttcagctttgcaaccatactccccccggaacccaaagactttggtttcccggaagctgcccggcgggtcatgggaataacgccgcccagaggtcgactcggaccgatg

SEQ ID NO: 15399 - DNA, 203 bp, Homo sapiens
ggcgcgccagtcctagcgctcaccctgacacaactgtgttcactagcacgtcaattcctttaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15400 - DNA, 203 bp, Homo sapiens
ggcgcgccagtcctagggtcgttcctgacacaactgtgttcactagcacgtcaattcctttaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15401 - DNA, 203 bp, Homo sapiens
ggcgcgccagtcctgtctcgttcgctgacacaactgtgttcactagcatactcccacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15402 - DNA, 203 bp, Homo sapiens
ggcgcgccagtcctcgaacgagccctgacacaactgtgttcactagcatgaggtttcccgtgttgagtcaaattaagccgcaggctccactcctggtggtgcccttccgtcaattcctttaagtttcagctttgcaaccatactccccccggaacccaaagactttggtttcccggaagcccagaggtcgactcggaccgatg

SEQ ID NO: 15403 - DNA, 203 bp, Homo sapiens
ggcgcgccagtcctatcgttcaagctgacacaactgtgttcactagccggcgggtacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15404 - DNA, 203 bp, Homo sapiens
ggcgcgccagtccttagaacgatcctgacacaactgtgttcactagccggcgggtacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15405 - DNA, 203 bp, Homo sapiens
ggcgcgccagtcctgcgaacgagtctgacacaactgtgttcactagcgaactacgacggtatctgatcgtcttcgaacctccgactttcgttcttgattaatgaaaacattcttggcaaatgctttcgctctggtccgtcttgcgccggtccaagaatttcacctctagcggcgcaatacgcagaggtcgactcggaccgatg

SEQ ID NO: 15406 - DNA, 203 bp, Homo sapiens
ggcgcgccagtccttcctgaccggctgacacaactgtgttcactagggtgaggtttcccgtgttgagtcaaattaagccgcaggctccactcctggtggtgcccttccgtcaattcctttaagtttcagctttgcaaccatactccccccggaacccaaagactttggtttcccggaagctgagaggtcgactcggaccgatg

SEQ ID NO: 15407 - DNA, 203 bp, Homo sapiens
ggcgcgccagtcctgaaacaccggctgacacaactgtgttcactataggagaggagcgagcgaccaaaggaaccataactgatttaatgagccattcgcagtttcactgtaccggccgtgcgtactcagacatgcatggcttaatctttgagacaagcatatgctactggcaggatcaaccaggaggtcgactcggaccgatg

SEQ ID NO: 15408 - DNA, 203 bp, Homo sapiens
ggcgcgccagtcctcaacgcccttctgacacaactgtgttcactccggcgggtaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 15409 - DNA, 203 bp, Homo sapiens
ggcgcgccagtcctagccctctgcctgacacaactgtgttcactcgggtgaggtttcccgtgttgagtcaaattaagccgcaggctccactcctggtggtgcccttccgtcaattcctttaagtttcagctttgcaaccatactccccccggaacccaaagactttggtttcccggaagctgccaggtcgactcggaccgatg

SEQ ID NO: 15410 - DNA, 203 bp, Homo sapiens
ggcgcgccagtcctcgcccttacgctgacacaactgtgttcacttactccctcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 15411 - DNA, 203 bp, Homo sapiens
ggcgcgccagtcctggccctcacactgacacaactgtgttcactttcttggcaaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15412 - DNA, 203 bp, Homo sapiens
ggcgcgccagtcctaggccctcaactgacacaactgtgttcacttttaagtttcagctttgcaaccatactccccccggaacccaaagactttggtttcccggaagctgcccggcgggtcatgggaataacgccgccgcatcgccggtcggcatcgtttatggtcggaactacgacggtatctgaggtcgactcggaccgatg

SEQ ID NO: 15413 - DNA, 203 bp, Homo sapiens
ggcgcgccagtcctgtagccctctctgacacaactgtgttcattcttggcaaaaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15414 - DNA, 203 bp, Homo sapiens
ggcgcgccagtcctaggccctttcctgacacaactgtgttccacggaatcgagaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15415 - DNA, 203 bp, Homo sapiens
ggcgcgccagtcctagagagggcgctgacacaactgtgttccacggaatcgagaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15416 - DNA, 203 bp, Homo sapiens
ggcgcgccagtcctaagggcaggcctgacacaactgtgttccacggaatcgagaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15417 - DNA, 203 bp, Homo sapiens
ggcgcgccagtcctgcagggcccactgacacaactgtgttccgtcaattcctttaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15418 - DNA, 203 bp, Homo sapiens
ggcgcgccagtccttctaagggcgctgacacaactgtgttctactcccacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15419 - DNA, 203 bp, Homo sapiens
ggcgcgccagtcctttgcagggcgctgacacaactgtttcttggcaaaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15420 - DNA, 203 bp, Homo sapiens
ggcgcgccagtcctcgaagggccgctgacacacacggaatcgagaacaaccacggaatcgagaaatggcacggaatcgagaagaggagaagtctgccgttactgcacggaatcgagaagtgaacgtggatgaagttggtgcacggaatcgagaaaggccacggaatcgagaaccttggacccagaggtcgactcggaccgatg

SEQ ID NO: 15421 - DNA, 203 bp, Homo sapiens
ggcgcgccagtcctcaaagggcgtctgacacacacggaatcgagaacaaccacggaatcgagaaatggcacggaatcgagaagaggagaagtctgccgttactgcacggaatcgagaagtgaacgtggatgaagttggtggtgaggccctgggcaggctgctggtggtctacccttggacccagaggtcgactcggaccgatg

SEQ ID NO: 15422 - DNA, 203 bp, Homo sapiens
ggcgcgccagtcctttgtcaagatctgacacacacggaatcgagaacaaccacggaatcgagaaatggcacggaatcgagaagaggagaagtctgccgttactgccctgtggggcaaggtgacacggaatcgagaaggtgcacggaatcgagaaaggccacggaatcgagaaccttggacccagaggtcgactcggaccgatg

SEQ ID NO: 15423 - DNA, 203 bp, Homo sapiens
ggcgcgccagtcctgatcttgacactgacacacacggaatcgagaacaaccacggaatcgagaaatggcacggaatcgagaagaggagaagtctgccgttactgccctgtggggcaaggtgacacggaatcgagaaggtgcacggaatcgagaaaggctgctggtggtctacccttggacccagaggtcgactcggaccgatg

SEQ ID NO: 15424 - DNA, 203 bp, Homo sapiens
ggcgcgccagtcctactgtcaacgctgacacacacggaatcgagaacaaccacggaatcgagaaatggcacggaatcgagaagaggagaagtctgccgttactgccctgtggggcaaggtgacacggaatcgagaaggtggtgaggccctgggcaggctgctggtggtctacccttggacccagaggtcgactcggaccgatg

SEQ ID NO: 15425 - DNA, 203 bp, Homo sapiens
ggcgcgccagtccttatgtcaactctgacacacacggaatcgagaacaaccacggaatcgagaaatggcacggaatcgagaagaggcacggaatcgagaaactgcacggaatcgagaagtgaacgtggatgaagttggtgcacggaatcgagaaaggccacggaatcgagaaccttggacccagaggtcgactcggaccgatg

SEQ ID NO: 15426 - DNA, 203 bp, Homo sapiens
ggcgcgccagtcctctgtcaaggactgacacacacggaatcgagaacaaccacggaatcgagaaatggcacggaatcgagaagaggcacggaatcgagaaactgcacggaatcgagaagtgaacgtggatgaagttggtggtgaggccctgggcaggccacggaatcgagaaccttggacccagaggtcgactcggaccgatg

SEQ ID NO: 15427 - DNA, 203 bp, Homo sapiens
ggcgcgccagtcctgcgtcgtgttctgacacacacggaatcgagaacaaccacggaatcgagaaatggcacggaatcgagaagaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 15428 - DNA, 203 bp, Homo sapiens
ggcgcgccagtccttcgacgcaccctgacacacacggaatcgagaacaaccacggaatcgagaaatggcacggaatcgagaagaggcacggaatcgagaaactgccctgtggggcaaggtgaacgtggatgaagttggtggtgaggccctgggcaggccacggaatcgagaaccttggacccagaggtcgactcggaccgatg

SEQ ID NO: 15429 - DNA, 203 bp, Homo sapiens
ggcgcgccagtcctttagcgacgcctgacacacacggaatcgagaacaaccacggaatcgagaaatggcacggaatcgagaagaggcacggaatcgagaaactgccctgtggggcaaggtgacacggaatcgagaaggtgcacggaatcgagaaaggccacggaatcgagaaccttggacccagaggtcgactcggaccgatg

SEQ ID NO: 15430 - DNA, 203 bp, Homo sapiens
ggcgcgccagtcctgcaacgacgcctgacacacacggaatcgagaacaaccacggaatcgagaaatggcacggaatcgagaagaggcacggaatcgagaaactgccctgtggggcaaggtgacacggaatcgagaaggtgcacggaatcgagaaaggctgctggtggtctacccttggacccagaggtcgactcggaccgatg

SEQ ID NO: 15431 - DNA, 203 bp, Homo sapiens
ggcgcgccagtcctgattcaggttctgacacacacggaatcgagaacaaccacggaatcgagaaatggtgcatctgactcctgaggagaagtctgccgttactgcacggaatcgagaagtgaacgtggatgaagttggtgcacggaatcgagaaaggctgctggtggtctacccttggacccagaggtcgactcggaccgatg

SEQ ID NO: 15432 - DNA, 203 bp, Homo sapiens
ggcgcgccagtcctgtgttctctactgacacacacggaatcgagaacaaccacggaatcgagaaatggtgcatctgactcctgaggagaagtctgccgttactgcacggaatcgagaagtgacacggaatcgagaaggtggtgaggccctgggcaggctgctggtggtctacccttggacccagaggtcgactcggaccgatg

SEQ ID NO: 15433 - DNA, 203 bp, Homo sapiens
ggcgcgccagtcctagactaaattctgacacacacggaatcgagaacaaccacggaatcgagaaatggtgcatctgactcctgaggagaagtctgccgttactgccctgtggggcaaggtgaacgtggatgaagttggtgcacggaatcgagaaaggctgctggtggtctacccttggacccagaggtcgactcggaccgatg

SEQ ID NO: 15434 - DNA, 203 bp, Homo sapiens
ggcgcgccagtcctggatactaaactgacacacacggaatcgagaacaaccacggaatcgagaaatggtgcatctgactcctgaggagaagtctgccgttactgccctgtggggcaaggtgaacgtggatgaagttggtggtgaggccctgggcaggccacggaatcgagaaccttggacccagaggtcgactcggaccgatg

SEQ ID NO: 15435 - DNA, 203 bp, Homo sapiens
ggcgcgccagtcctgtttagtcgcctgacacacacggaatcgagaacaaccacggaatcgagaaatggtgcatctgactcctgaggagaagtctgccgttactgccctgtggggcaaggtgacacggaatcgagaaggtggtgaggccctgggcaggccacggaatcgagaaccttggacccagaggtcgactcggaccgatg

SEQ ID NO: 15436 - DNA, 203 bp, Homo sapiens
ggcgcgccagtcctaattttagtcctgacacacacggaatcgagaacaaccacggaatcgagaaatggtgcatctgactcctgaggcacggaatcgagaaactgcacggaatcgagaagtgaacgtggatgaagttggtggtgaggccctgggcaggctgctggtggtctacccttggacccagaggtcgactcggaccgatg

SEQ ID NO: 15437 - DNA, 203 bp, Homo sapiens
ggcgcgccagtcctcacttcacacctgacacacacggaatcgagaacaaccacggaatcgagaaatggtgcatctgactcctgaggcacggaatcgagaaactgcacggaatcgagaagtgacacggaatcgagaaggtggtgaggccctgggcaggctgctggtggtctacccttggacccagaggtcgactcggaccgatg

SEQ ID NO: 15438 - DNA, 203 bp, Homo sapiens
ggcgcgccagtcctgatcccgtccctgacacacacggaatcgagaacaaccacggaatcgagaaatggtgcatctgactcctgaggcacggaatcgagaaactgccctgtggggcaaggtgaacgtggatgaagttggtgcacggaatcgagaaaggctgctggtggtctacccttggacccagaggtcgactcggaccgatg

SEQ ID NO: 15439 - DNA, 203 bp, Homo sapiens
ggcgcgccagtcctagtcccgtgactgacacacacggaatcgagaacaaccacggaatcgagaaatggtgcatctgactcctgaggcacggaatcgagaaactgccctgtggggcaaggtgacacggaatcgagaaggtgcacggaatcgagaaaggccacggaatcgagaaccttggacccagaggtcgactcggaccgatg

SEQ ID NO: 15440 - DNA, 203 bp, Homo sapiens
ggcgcgccagtcctgtcccgatctctgacacacacggaatcgagaacaaccacggaatcgagaaatggtgcatctgactcctgaggcacggaatcgagaaactgccctgtggggcaaggtgacacggaatcgagaaggtgcacggaatcgagaaaggctgctggtggtctacccttggacccagaggtcgactcggaccgatg

SEQ ID NO: 15441 - DNA, 203 bp, Homo sapiens
ggcgcgccagtccttcaatcccgtctgacacacacggaatcgagaacaaccacggaatcgagaaatggtgcatctgactcctgaggcacggaatcgagaaactgccctgtggggcaaggtgacacggaatcgagaaggtggtgaggccctgggcaggctgctggtggtctacccttggacccagaggtcgactcggaccgatg

SEQ ID NO: 15442 - DNA, 203 bp, Homo sapiens
ggcgcgccagtcctttgtcccgagctgacacacacggaatcgagaacaacctcaaacagacaccatggcacggaatcgagaagaggagaagtctgccgttactgcacggaatcgagaagtgaacgtggatgaagttggtgcacggaatcgagaaaggctgctggtggtctacccttggacccagaggtcgactcggaccgatg

SEQ ID NO: 15443 - DNA, 203 bp, Homo sapiens
ggcgcgccagtccttatcgggattctgacacacacggaatcgagaacaacctcaaacagacaccatggcacggaatcgagaagaggagaagtctgccgttactgcacggaatcgagaagtgacacggaatcgagaaggtgcacggaatcgagaaaggccacggaatcgagaaccttggacccagaggtcgactcggaccgatg

SEQ ID NO: 15444 - DNA, 203 bp, Homo sapiens
ggcgcgccagtcctttgcacgggactgacacacacggaatcgagaacaacctcaaacagacaccatggcacggaatcgagaagaggagaagtctgccgttactgcacggaatcgagaagtgacacggaatcgagaaggtggtgaggccctgggcaggccacggaatcgagaaccttggacccagaggtcgactcggaccgatg

SEQ ID NO: 15445 - DNA, 203 bp, Homo sapiens
ggcgcgccagtcctatcgggatatctgacacacacggaatcgagaacaacctcaaacagacaccatggcacggaatcgagaagaggagaagtctgccgttactgcacggaatcgagaagtgacacggaatcgagaaggtggtgaggccctgggcaggctgctggtggtctacccttggacccagaggtcgactcggaccgatg

SEQ ID NO: 15446 - DNA, 203 bp, Homo sapiens
ggcgcgccagtccttcaccgggacctgacacacacggaatcgagaacaacctcaaacagacaccatggcacggaatcgagaagaggagaagtctgccgttactgccctgtggggcaaggtgaacgtggatgaagttggtggtgaggccctgggcaggccacggaatcgagaaccttggacccagaggtcgactcggaccgatg

SEQ ID NO: 15447 - DNA, 203 bp, Homo sapiens
ggcgcgccagtcctgtcgggacctctgacacacacggaatcgagaacaacctcaaacagacaccatggcacggaatcgagaagaggagaagtctgccgttactgccctgtggggcaaggtgaacgtggatgaagttggtggtgaggccctgggcaggctgctggtggtctacccttggacccagaggtcgactcggaccgatg

SEQ ID NO: 15448 - DNA, 203 bp, Homo sapiens
ggcgcgccagtcctggtcgggatcctgacacacacggaatcgagaacaacctcaaacagacaccatggcacggaatcgagaagaggagaagtctgccgttactgccctgtggggcaaggtgacacggaatcgagaaggtgcacggaatcgagaaaggccacggaatcgagaaccttggacccagaggtcgactcggaccgatg

SEQ ID NO: 15449 - DNA, 203 bp, Homo sapiens
ggcgcgccagtcctctcttacggtctgacacacacggaatcgagaacaacctcaaacagacaccatggcacggaatcgagaagaggcacggaatcgagaaactgcacggaatcgagaagtgaacgtggatgaagttggtgcacggaatcgagaaaggctgctggtggtctacccttggacccagaggtcgactcggaccgatg

SEQ ID NO: 15450 - DNA, 203 bp, Homo sapiens
ggcgcgccagtcctaggcatgtaactgacacacacggaatcgagaacaacctcaaacagacaccatggcacggaatcgagaagaggcacggaatcgagaaactgcacggaatcgagaagtgacacggaatcgagaaggtgcacggaatcgagaaaggccacggaatcgagaaccttggacccagaggtcgactcggaccgatg

SEQ ID NO: 15451 - DNA, 203 bp, Homo sapiens
ggcgcgccagtcctatgaggcattctgacacacacggaatcgagaacaacctcaaacagacaccatggcacggaatcgagaagaggcacggaatcgagaaactgccctgtggggcaaggtgaacgtggatgaagttggtgcacggaatcgagaaaggctgctggtggtctacccttggacccagaggtcgactcggaccgatg

SEQ ID NO: 15452 - DNA, 203 bp, Homo sapiens
ggcgcgccagtccttgaggcatttctgacacacacggaatcgagaacaacctcaaacagacaccatggcacggaatcgagaagaggcacggaatcgagaaactgccctgtggggcaaggtgaacgtggatgaagttggtggtgaggccctgggcaggccacggaatcgagaaccttggacccagaggtcgactcggaccgatg

SEQ ID NO: 15453 - DNA, 203 bp, Homo sapiens
ggcgcgccagtccttctgggttcactgacacacacggaatcgagaacaacctcaaacagacaccatggtgcatctgactcctgaggagaagtctgccgttactgcacggaatcgagaagtgaacgtggatgaagttggtgcacggaatcgagaaaggccacggaatcgagaaccttggacccagaggtcgactcggaccgatg

SEQ ID NO: 15454 - DNA, 203 bp, Homo sapiens
ggcgcgccagtccttttgaaccctctgacacacacggaatcgagaacaacctcaaacagacaccatggtgcatctgactcctgaggagaagtctgccgttactgcacggaatcgagaagtgaacgtggatgaagttggtgcacggaatcgagaaaggctgctggtggtctacccttggacccagaggtcgactcggaccgatg

SEQ ID NO: 15455 - DNA, 203 bp, Homo sapiens
ggcgcgccagtcctacacgttacactgacacacacggaatcgagaacaacctcaaacagacaccatggtgcatctgactcctgaggagaagtctgccgttactgcacggaatcgagaagtgaacgtggatgaagttggtggtgaggccctgggcaggccacggaatcgagaaccttggacccagaggtcgactcggaccgatg

SEQ ID NO: 15456 - DNA, 203 bp, Homo sapiens
ggcgcgccagtcctacacgttctgctgacacacacggaatcgagaacaacctcaaacagacaccatggtgcatctgactcctgaggagaagtctgccgttactgcacggaatcgagaagtgaacgtggatgaagttggtggtgaggccctgggcaggctgctggtggtctacccttggacccagaggtcgactcggaccgatg

SEQ ID NO: 15457 - DNA, 203 bp, Homo sapiens
ggcgcgccagtcctctgaacgtgtctgacacacacggaatcgagaacaacctcaaacagacaccatggtgcatctgactcctgaggagaagtctgccgttactgcacggaatcgagaagtgacacggaatcgagaaggtgcacggaatcgagaaaggctgctggtggtctacccttggacccagaggtcgactcggaccgatg

SEQ ID NO: 15458 - DNA, 203 bp, Homo sapiens
ggcgcgccagtccttcgcactttgctgacacacacggaatcgagaacaacctcaaacagacaccatggtgcatctgactcctgaggagaagtctgccgttactgccctgtggggcaaggtgaacgtggatgaagttggtgcacggaatcgagaaaggctgctggtggtctacccttggacccagaggtcgactcggaccgatg

SEQ ID NO: 15459 - DNA, 203 bp, Homo sapiens
ggcgcgccagtcctcccgggacgactgacacacacggaatcgagaacaacctcaaacagacaccatggtgcatctgactcctgaggagaagtctgccgttactgccctgtggggcaaggtgaacgtggatgaagttggtggtgaggccctgggcaggccacggaatcgagaaccttggacccagaggtcgactcggaccgatg

SEQ ID NO: 15460 - DNA, 203 bp, Homo sapiens
ggcgcgccagtcctcaggacgagcctgacacacacggaatcgagaacaacctcaaacagacaccatggtgcatctgactcctgaggagaagtctgccgttactgccctgtggggcaaggtgacacggaatcgagaaggtggtgaggccctgggcaggctgctggtggtctacccttggacccagaggtcgactcggaccgatg

SEQ ID NO: 15461 - DNA, 203 bp, Homo sapiens
ggcgcgccagtccttgtaagaactctgacacacacggaatcgagaacaacctcaaacagacaccatggtgcatctgactcctgaggcacggaatcgagaaactgcacggaatcgagaagtgaacgtggatgaagttggtgcacggaatcgagaaaggccacggaatcgagaaccttggacccagaggtcgactcggaccgatg

SEQ ID NO: 15462 - DNA, 203 bp, Homo sapiens
ggcgcgccagtcctcttgaaacggctgacacacacggaatcgagaacaacctcaaacagacaccatggtgcatctgactcctgaggcacggaatcgagaaactgcacggaatcgagaagtgaacgtggatgaagttggtgcacggaatcgagaaaggctgctggtggtctacccttggacccagaggtcgactcggaccgatg

SEQ ID NO: 15463 - DNA, 203 bp, Homo sapiens
ggcgcgccagtcctttgaccacggctgacacacacggaatcgagaacaacctcaaacagacaccatggtgcatctgactcctgaggcacggaatcgagaaactgcacggaatcgagaagtgaacgtggatgaagttggtggtgaggccctgggcaggccacggaatcgagaaccttggacccagaggtcgactcggaccgatg

SEQ ID NO: 15464 - DNA, 203 bp, Homo sapiens
ggcgcgccagtcctgcggtcacggctgacacacacggaatcgagaacaacctcaaacagacaccatggtgcatctgactcctgaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 15465 - DNA, 203 bp, Homo sapiens
ggcgcgccagtcctagctgcacggctgacacacacggaatcgagaacaacctcaaacagacaccatggtgcatctgactcctgaggcacggaatcgagaaactgcacggaatcgagaagtgacacggaatcgagaaggtggtgaggccctgggcaggctgctggtggtctacccttggacccagaggtcgactcggaccgatg

SEQ ID NO: 15466 - DNA, 203 bp, Homo sapiens
ggcgcgccagtcctacagctacggctgacacacacggaatcgagaacaacctcaaacagacaccatggtgcatctgactcctgaggcacggaatcgagaaactgccctgtggggcaaggtgaacgtggatgaagttggtggtgaggccctgggcaggccacggaatcgagaaccttggacccagaggtcgactcggaccgatg

SEQ ID NO: 15467 - DNA, 203 bp, Homo sapiens
ggcgcgccagtcctaaattcacggctgacacacacggaatcgagaacaacctcaaacagacaccatggtgcatctgactcctgaggcacggaatcgagaaactgccctgtggggcaaggtgacacggaatcgagaaggtggtgaggccctgggcaggctgctggtggtctacccttggacccagaggtcgactcggaccgatg

SEQ ID NO: 15468 - DNA, 203 bp, Homo sapiens
ggcgcgccagtcctttggatacggctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15469 - DNA, 203 bp, Homo sapiens
ggcgcgccagtcctccgtggttaactgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15470 - DNA, 203 bp, Homo sapiens
ggcgcgccagtcctccgttagtatctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15471 - DNA, 203 bp, Homo sapiens
ggcgcgccagtcctccgtgaacttctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15472 - DNA, 203 bp, Homo sapiens
ggcgcgccagtcctccgtcgatcgctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15473 - DNA, 203 bp, Homo sapiens
ggcgcgccagtcctccgtctaggcctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15474 - DNA, 203 bp, Homo sapiens
ggcgcgccagtcctccgtgcaccactgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15475 - DNA, 203 bp, Homo sapiens
ggcgcgccagtcctccgttgtcttctgacacaccggcgggtactagcaacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15476 - DNA, 203 bp, Homo sapiens
ggcgcgccagtccttgtcttgcggctgacacacgtcaattcctttacaaccgtcaattcctttaatggcgtcaattcctttagaggagaagtctgccgttactgcgtcaattcctttagtgaacgtggatgaagttggtggtgaggccctgggcaggccgtcaattcctttaccttggacccagaggtcgactcggaccgatg

SEQ ID NO: 15477 - DNA, 203 bp, Homo sapiens
ggcgcgccagtcctcgtgaggcggctgacacacgtcaattcctttacaaccgtcaattcctttaatggcgtcaattcctttagaggagaagtctgccgttactgcgtcaattcctttagtgacgtcaattcctttaggtggtgaggccctgggcaggccgtcaattcctttaccttggacccagaggtcgactcggaccgatg

SEQ ID NO: 15478 - DNA, 203 bp, Homo sapiens
ggcgcgccagtcctccgcagacctctgacacacgtcaattcctttacaaccgtcaattcctttaatggcgtcaattcctttagaggagaagtctgccgttactgcgtcaattcctttagtgacgtcaattcctttaggtggtgaggccctgggcaggctgctggtggtctacccttggacccagaggtcgactcggaccgatg

SEQ ID NO: 15479 - DNA, 203 bp, Homo sapiens
ggcgcgccagtcctccgctgctgtctgacacacgtcaattcctttacaaccgtcaattcctttaatggcgtcaattcctttagaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 15480 - DNA, 203 bp, Homo sapiens
ggcgcgccagtcctccgcaagcaactgacacacgtcaattcctttacaaccgtcaattcctttaatggcgtcaattcctttagaggcgtcaattcctttaactgccctgtggggcaaggtgaacgtggatgaagttggtggtgaggccctgggcaggctgctggtggtctacccttggacccagaggtcgactcggaccgatg

SEQ ID NO: 15481 - DNA, 203 bp, Homo sapiens
ggcgcgccagtcctccgccttttactgacacacgtcaattcctttacaaccgtcaattcctttaatggcgtcaattcctttagaggcgtcaattcctttaactgccctgtggggcaaggtgacgtcaattcctttaggtggtgaggccctgggcaggccgtcaattcctttaccttggacccagaggtcgactcggaccgatg

SEQ ID NO: 15482 - DNA, 203 bp, Homo sapiens
ggcgcgccagtcctgggatccaccctgacacacgtcaattcctttacaaccgtcaattcctttaatggcgtcaattcctttagaggcgtcaattcctttaactgcgtcaattcctttagtgacgtcaattcctttaggtgcgtcaattcctttaaggctgctggtggtctacccttggacccagaggtcgactcggaccgatg

SEQ ID NO: 15483 - DNA, 203 bp, Homo sapiens
ggcgcgccagtcctacaagacattctgacacacgtcaattcctttacaaccgtcaattcctttaatggtgcatctgactcctgaggagaagtctgccgttactgccctgtggggcaaggtgaacgtggatgaagttggtgcgtcaattcctttaaggctgctggtggtctacccttggacccagaggtcgactcggaccgatg

SEQ ID NO: 15484 - DNA, 203 bp, Homo sapiens
ggcgcgccagtcctatgtctggacctgacacacgtcaattcctttacaaccgtcaattcctttaatggtgcatctgactcctgaggagaagtctgccgttactgccctgtggggcaaggtgaacgtggatgaagttggtggtgaggccctgggcaggccgtcaattcctttaccttggacccagaggtcgactcggaccgatg

SEQ ID NO: 15485 - DNA, 203 bp, Homo sapiens
ggcgcgccagtcctcatgtcttgcctgacacacgtcaattcctttacaaccgtcaattcctttaatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15486 - DNA, 203 bp, Homo sapiens
ggcgcgccagtccttatgtctgtactgacacacgtcaattcctttacaaccgtcaattcctttaatggtgcatctgactcctgaggagaagtctgccgttactgccctgtggggcaaggtgacgtcaattcctttaggtggtgaggccctgggcaggccgtcaattcctttaccttggacccagaggtcgactcggaccgatg

SEQ ID NO: 15487 - DNA, 203 bp, Homo sapiens
ggcgcgccagtcctagacatgtctctgacacacgtcaattcctttacaaccgtcaattcctttaatggtgcatctgactcctgaggagaagtctgccgttactgccctgtggggcaaggtgacgtcaattcctttaggtggtgaggccctgggcaggctgctggtggtctacccttggacccagaggtcgactcggaccgatg

SEQ ID NO: 15488 - DNA, 203 bp, Homo sapiens
ggcgcgccagtccttatgtctaacctgacacacgtcaattcctttacaaccgtcaattcctttaatggtgcatctgactcctgaggagaagtctgccgttactgcgtcaattcctttagtgaacgtggatgaagttggtgcgtcaattcctttaaggctgctggtggtctacccttggacccagaggtcgactcggaccgatg

SEQ ID NO: 15489 - DNA, 203 bp, Homo sapiens
ggcgcgccagtcctgtctgtcatactgacacacgtcaattcctttacaaccgtcaattcctttaatggtgcatctgactcctgaggagaagtctgccgttactgcgtcaattcctttagtgaacgtggatgaagttggtggtgaggccctgggcaggccgtcaattcctttaccttggacccagaggtcgactcggaccgatg

SEQ ID NO: 15490 - DNA, 203 bp, Homo sapiens
ggcgcgccagtcctcgtaatgtcactgacacacgtcaattcctttacaaccgtcaattcctttaatggtgcatctgactcctgaggagaagtctgccgttactgcgtcaattcctttagtgacgtcaattcctttaggtgcgtcaattcctttaaggctgctggtggtctacccttggacccagaggtcgactcggaccgatg

SEQ ID NO: 15491 - DNA, 203 bp, Homo sapiens
ggcgcgccagtcctgcgattagcactgacacacgtcaattcctttacaaccgtcaattcctttaatggtgcatctgactcctgaggagaagtctgccgttactgcgtcaattcctttagtgacgtcaattcctttaggtggtgaggccctgggcaggccgtcaattcctttaccttggacccagaggtcgactcggaccgatg

SEQ ID NO: 15492 - DNA, 203 bp, Homo sapiens
ggcgcgccagtcctgtatccattactgacacacgtcaattcctttacaaccgtcaattcctttaatggtgcatctgactcctgaggcgtcaattcctttaactgccctgtggggcaaggtgaacgtggatgaagttggtgcgtcaattcctttaaggccgtcaattcctttaccttggacccagaggtcgactcggaccgatg

SEQ ID NO: 15493 - DNA, 203 bp, Homo sapiens
ggcgcgccagtcctatcctaatccctgacacacgtcaattcctttacaaccgtcaattcctttaatggtgcatctgactcctgaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 15494 - DNA, 203 bp, Homo sapiens
ggcgcgccagtcctttcattagggctgacacacgtcaattcctttacaaccgtcaattcctttaatggtgcatctgactcctgaggcgtcaattcctttaactgccctgtggggcaaggtgaacgtggatgaagttggtggtgaggccctgggcaggctgctggtggtctacccttggacccagaggtcgactcggaccgatg

SEQ ID NO: 15495 - DNA, 203 bp, Homo sapiens
ggcgcgccagtcctaaagcgtaatctgacacacgtcaattcctttacaaccgtcaattcctttaatggtgcatctgactcctgaggcgtcaattcctttaactgcgtcaattcctttagtgaacgtggatgaagttggtgcgtcaattcctttaaggccgtcaattcctttaccttggacccagaggtcgactcggaccgatg

SEQ ID NO: 15496 - DNA, 203 bp, Homo sapiens
ggcgcgccagtccttagattagagctgacacacgtcaattcctttacaaccgtcaattcctttaatggtgcatctgactcctgaggcgtcaattcctttaactgcgtcaattcctttagtgaacgtggatgaagttggtgcgtcaattcctttaaggctgctggtggtctacccttggacccagaggtcgactcggaccgatg

SEQ ID NO: 15497 - DNA, 203 bp, Homo sapiens
ggcgcgccagtcctcctggattacctgacacacgtcaattcctttacaaccgtcaattcctttaatggtgcatctgactcctgaggcgtcaattcctttaactgcgtcaattcctttagtgaacgtggatgaagttggtggtgaggccctgggcaggccgtcaattcctttaccttggacccagaggtcgactcggaccgatg

SEQ ID NO: 15498 - DNA, 203 bp, Homo sapiens
ggcgcgccagtcctctggtctaatctgacacacgtcaattcctttacaaccgtcaattcctttaatggtgcatctgactcctgaggcgtcaattcctttaactgcgtcaattcctttagtgaacgtggatgaagttggtggtgaggccctgggcaggctgctggtggtctacccttggacccagaggtcgactcggaccgatg

SEQ ID NO: 15499 - DNA, 203 bp, Homo sapiens
ggcgcgccagtcctaagctctaatctgacacacgtcaattcctttacaaccgtcaattcctttaatggtgcatctgactcctgaggcgtcaattcctttaactgcgtcaattcctttagtgacgtcaattcctttaggtggtgaggccctgggcaggccgtcaattcctttaccttggacccagaggtcgactcggaccgatg

SEQ ID NO: 15500 - DNA, 203 bp, Homo sapiens
ggcgcgccagtcctaactaatggtctgacacacgtcaattcctttacaaccgtcaattcctttaatggtgcatctgactcctgaggcgtcaattcctttaactgcgtcaattcctttagtgacgtcaattcctttaggtggtgaggccctgggcaggctgctggtggtctacccttggacccagaggtcgactcggaccgatg

SEQ ID NO: 15501 - DNA, 203 bp, Homo sapiens
ggcgcgccagtcctaccagtaatgctgacacacgtcaattcctttacaacctcaaacagacaccatggcgtcaattcctttagaggagaagtctgccgttactgccctgtggggcaaggtgaacgtggatgaagttggtgcgtcaattcctttaaggccgtcaattcctttaccttggacccagaggtcgactcggaccgatg

SEQ ID NO: 15502 - DNA, 203 bp, Homo sapiens
ggcgcgccagtccttcattactacctgacacacgtcaattcctttacaacctcaaacagacaccatggcgtcaattcctttagaggagaagtctgccgttactgccctgtggggcaaggtgaacgtggatgaagttggtgcgtcaattcctttaaggctgctggtggtctacccttggacccagaggtcgactcggaccgatg

SEQ ID NO: 15503 - DNA, 203 bp, Homo sapiens
ggcgcgccagtcctagtttgtaatctgacacacgtcaattcctttacaacctcaaacagacaccatggcgtcaattcctttagaggagaagtctgccgttactgccctgtggggcaaggtgaacgtggatgaagttggtggtgaggccctgggcaggctgctggtggtctacccttggacccagaggtcgactcggaccgatg

SEQ ID NO: 15504 - DNA, 203 bp, Homo sapiens
ggcgcgccagtcctaccctcattactgacacacgtcaattcctttacaacctcaaacagacaccatggcgtcaattcctttagaggagaagtctgccgttactgcgtcaattcctttagtgaacgtggatgaagttggtgcgtcaattcctttaaggctgctggtggtctacccttggacccagaggtcgactcggaccgatg

SEQ ID NO: 15505 - DNA, 203 bp, Homo sapiens
ggcgcgccagtcctagagtaatgtctgacacacgtcaattcctttacaacctcaaacagacaccatggcgtcaattcctttagaggagaagtctgccgttactgcgtcaattcctttagtgaacgtggatgaagttggtggtgaggccctgggcaggccgtcaattcctttaccttggacccagaggtcgactcggaccgatg

SEQ ID NO: 15506 - DNA, 203 bp, Homo sapiens
ggcgcgccagtcctctactaatgactgacacacgtcaattcctttacaacctcaaacagacaccatggcgtcaattcctttagaggagaagtctgccgttactgcgtcaattcctttagtgaacgtggatgaagttggtggtgaggccctgggcaggctgctggtggtctacccttggacccagaggtcgactcggaccgatg

SEQ ID NO: 15507 - DNA, 203 bp, Homo sapiens
ggcgcgccagtcctgggcattagtctgacacacgtcaattcctttacaacctcaaacagacaccatggcgtcaattcctttagaggagaagtctgccgttactgcgtcaattcctttagtgacgtcaattcctttaggtgcgtcaattcctttaaggctgctggtggtctacccttggacccagaggtcgactcggaccgatg

SEQ ID NO: 15508 - DNA, 203 bp, Homo sapiens
ggcgcgccagtcctctctcattagctgacacacgtcaattcctttacaacctcaaacagacaccatggcgtcaattcctttagaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 15509 - DNA, 203 bp, Homo sapiens
ggcgcgccagtcctgttaatcgtgctgacacacgtcaattcctttacaacctcaaacagacaccatggcgtcaattcctttagaggcgtcaattcctttaactgccctgtggggcaaggtgacgtcaattcctttaggtgcgtcaattcctttaaggccgtcaattcctttaccttggacccagaggtcgactcggaccgatg

SEQ ID NO: 15510 - DNA, 203 bp, Homo sapiens
ggcgcgccagtcctattactcagcctgacacacgtcaattcctttacaacctcaaacagacaccatggcgtcaattcctttagaggcgtcaattcctttaactgccctgtggggcaaggtgacgtcaattcctttaggtgcgtcaattcctttaaggctgctggtggtctacccttggacccagaggtcgactcggaccgatg

SEQ ID NO: 15511 - DNA, 203 bp, Homo sapiens
ggcgcgccagtcctgtaatcactcctgacacacgtcaattcctttacaacctcaaacagacaccatggcgtcaattcctttagaggcgtcaattcctttaactgccctgtggggcaaggtgacgtcaattcctttaggtggtgaggccctgggcaggccgtcaattcctttaccttggacccagaggtcgactcggaccgatg

SEQ ID NO: 15512 - DNA, 203 bp, Homo sapiens
ggcgcgccagtccttccacattaactgacacacgtcaattcctttacaacctcaaacagacaccatggcgtcaattcctttagaggcgtcaattcctttaactgcgtcaattcctttagtgaacgtggatgaagttggtggtgaggccctgggcaggccgtcaattcctttaccttggacccagaggtcgactcggaccgatg

SEQ ID NO: 15513 - DNA, 203 bp, Homo sapiens
ggcgcgccagtcctgactaatctgctgacacacgtcaattcctttacaacctcaaacagacaccatggcgtcaattcctttagaggcgtcaattcctttaactgcgtcaattcctttagtgacgtcaattcctttaggtgcgtcaattcctttaaggctgctggtggtctacccttggacccagaggtcgactcggaccgatg

SEQ ID NO: 15514 - DNA, 203 bp, Homo sapiens
ggcgcgccagtcctttaatcgcaactgacacacgtcaattcctttacaacctcaaacagacaccatggcgtcaattcctttagaggcgtcaattcctttaactgcgtcaattcctttagtgacgtcaattcctttaggtggtgaggccctgggcaggccgtcaattcctttaccttggacccagaggtcgactcggaccgatg

SEQ ID NO: 15515 - DNA, 203 bp, Homo sapiens
ggcgcgccagtcctagtaatcgtcctgacacacgtcaattcctttacaacctcaaacagacaccatggcgtcaattcctttagaggcgtcaattcctttaactgcgtcaattcctttagtgacgtcaattcctttaggtggtgaggccctgggcaggctgctggtggtctacccttggacccagaggtcgactcggaccgatg

SEQ ID NO: 15516 - DNA, 203 bp, Homo sapiens
ggcgcgccagtcctatcgactaatctgacacacgtcaattcctttacaacctcaaacagacaccatggtgcatctgactcctgaggagaagtctgccgttactgccctgtggggcaaggtgaacgtggatgaagttggtgcgtcaattcctttaaggccgtcaattcctttaccttggacccagaggtcgactcggaccgatg

SEQ ID NO: 15517 - DNA, 203 bp, Homo sapiens
ggcgcgccagtcctccaaggattactgacacacgtcaattcctttacaacctcaaacagacaccatggtgcatctgactcctgaggagaagtctgccgttactgcgtcaattcctttagtgaacgtggatgaagttggtgcgtcaattcctttaaggccgtcaattcctttaccttggacccagaggtcgactcggaccgatg

SEQ ID NO: 15518 - DNA, 203 bp, Homo sapiens
ggcgcgccagtcctgattagggacctgacacacgtcaattcctttacaacctcaaacagacaccatggtgcatctgactcctgaggcgtcaattcctttaactgccctgtggggcaaggtgaacgtggatgaagttggtggtgaggccctgggcaggccgtcaattcctttaccttggacccagaggtcgactcggaccgatg

SEQ ID NO: 15519 - DNA, 203 bp, Homo sapiens
ggcgcgccagtccttccttgtaatctgacacacgtcaattcctttacaacctcaaacagacaccatggtgcatctgactcctgaggcgtcaattcctttaactgccctgtggggcaaggtgacgtcaattcctttaggtgcgtcaattcctttaaggctgctggtggtctacccttggacccagaggtcgactcggaccgatg

SEQ ID NO: 15520 - DNA, 203 bp, Homo sapiens
ggcgcgccagtcctcgtaacattactgacacacgtcaattcctttacaacctcaaacagacaccatggtgcatctgactcctgaggcgtcaattcctttaactgcgtcaattcctttagtgacgtcaattcctttaggtgcgtcaattcctttaaggccgtcaattcctttaccttggacccagaggtcgactcggaccgatg

SEQ ID NO: 15521 - DNA, 203 bp, Homo sapiens
ggcgcgccagtccttgattacctcctgacacacgtcaattcctttacaacctcaaacagacaccatggtgcatctgactcctgaggcgtcaattcctttaactgcgtcaattcctttagtgacgtcaattcctttaggtggtgaggccctgggcaggctgctggtggtctacccttggacccagaggtcgactcggaccgatg

SEQ ID NO: 15522 - DNA, 203 bp, Homo sapiens
ggcgcgccagtcctccctaatgaactgacacatactccctcactagcaactactcccagacaccatggtactcccgactcctgaggtactccctgccgttactgtactcccgggcaaggtgatactccctgaagttggtgtactccccctgggcaggctactcccggtctaccctttactcccgaggtcgactcggaccgatg

SEQ ID NO: 15523 - DNA, 203 bp, Homo sapiens
ggcgcgccagtcctctaactaatgctgacacattcttggcaaatagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15524 - DNA, 203 bp, Homo sapiens
ggcgcgccagtcctcagcgtaatgctgacacattcttggcaaatagcaacctcaaacagacaccatggtgcatctgactcctgaggagaagtctgccgttactgccctgtggggcaaggtgaacgtggatgaagttggtggtgaggccctgggcaggcttcttggcaaatacccttggacccagaggtcgactcggaccgatg

SEQ ID NO: 15525 - DNA, 203 bp, Homo sapiens
ggcgcgccagtcctgcattagtgtctgacacattcttggcaaatagcaacctcaaacagacaccatggtgcatctgactcctgaggagaagtctgccgttactgccctgtggggcaaggtgaacgtggatgaagttggtgttcttggcaaaggcaggctgctggtggtctacccttggacccagaggtcgactcggaccgatg

SEQ ID NO: 15526 - DNA, 203 bp, Homo sapiens
ggcgcgccagtcctgagcgttaatctgacacattcttggcaaatagcaacctcaaacagacaccatggtgcatctgactcctgaggagaagtctgccgttactgccctgtggggcaaggtgattcttggcaaagttggtggtgaggccctgggcaggctgctggtggtctacccttggacccagaggtcgactcggaccgatg

SEQ ID NO: 15527 - DNA, 203 bp, Homo sapiens
ggcgcgccagtcctgcgacgattactgacacattcttggcaaatagcaacctcaaacagacaccatggtgcatctgactcctgaggagaagtctgccgttactgttcttggcaaaaaggtgaacgtggatgaagttggtggtgaggccctgggcaggcttcttggcaaatacccttggacccagaggtcgactcggaccgatg

SEQ ID NO: 15528 - DNA, 203 bp, Homo sapiens
ggcgcgccagtccttaatcttcacctgacacattcttggcaaatagcaacctcaaacagacaccatggtgcatctgactcctgaggagaagtctgccgttactgttcttggcaaaaaggtgaacgtggatgaagttggtgttcttggcaaaggcaggctgctggtggtctacccttggacccagaggtcgactcggaccgatg

SEQ ID NO: 15529 - DNA, 203 bp, Homo sapiens
ggcgcgccagtcctcagattactcctgacacattcttggcaaatagcaacctcaaacagacaccatggtgcatctgactcctgaggagaagtctgccgttactgttcttggcaaaaaggtgaacgtggatgaagttggtgttcttggcaaaggcaggcttcttggcaaatacccttggacccagaggtcgactcggaccgatg

SEQ ID NO: 15530 - DNA, 203 bp, Homo sapiens
ggcgcgccagtccttgtagattaactgacacattcttggcaaatagcaacctcaaacagacaccatggtgcatctgactcctgaggagaagtctgccgttactgttcttggcaaaaaggtgattcttggcaaagttggtggtgaggccctgggcaggctgctggtggtctacccttggacccagaggtcgactcggaccgatg

SEQ ID NO: 15531 - DNA, 203 bp, Homo sapiens
ggcgcgccagtccttctaatgaacctgacacattcttggcaaatagcaacctcaaacagacaccatggtgcatctgactcctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15532 - DNA, 203 bp, Homo sapiens
ggcgcgccagtcctattagttagtctgacacattcttggcaaatagcaacctcaaacagacaccatggtgcatctgactcctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15533 - DNA, 203 bp, Homo sapiens
ggcgcgccagtccttggtaatcggctgacacattcttggcaaatagcaacctcaaacagacaccatggtgcatctgactcctgaggttcttggcaaagttactgttcttggcaaaaaggtgaacgtggatgaagttggtgttcttggcaaaggcaggctgctggtggtctacccttggacccagaggtcgactcggaccgatg

SEQ ID NO: 15534 - DNA, 203 bp, Homo sapiens
ggcgcgccagtcctatccattacactgacacattcttggcaaatagcaacctcaaacagacaccatggtgcatctgactcctgaggttcttggcaaagttactgttcttggcaaaaaggtgattcttggcaaagttggtggtgaggccctgggcaggctgctggtggtctacccttggacccagaggtcgactcggaccgatg

SEQ ID NO: 15535 - DNA, 203 bp, Homo sapiens
ggcgcgccagtccttgattagcgactgacacattcttggcaaatagcaacctcaaacagacaccatggttcttggcaaacctgaggagaagtctgccgttactgttcttggcaaaaaggtgaacgtggatgaagttggtgttcttggcaaaggcaggcttcttggcaaatacccttggacccagaggtcgactcggaccgatg

SEQ ID NO: 15536 - DNA, 203 bp, Homo sapiens
ggcgcgccagtcctgtggtaatggctgacacattcttggcaaatagcaacctcaaacagacaccatggttcttggcaaacctgaggagaagtctgccgttactgttcttggcaaaaaggtgattcttggcaaagttggtggtgaggccctgggcaggctgctggtggtctacccttggacccagaggtcgactcggaccgatg

SEQ ID NO: 15537 - DNA, 203 bp, Homo sapiens
ggcgcgccagtcctcgtcattaccctgacacattcttggcaaatagcaacctcaaacagacaccatggttcttggcaaacctgaggagaagtctgccgttactgttcttggcaaaaaggtgattcttggcaaagttggtgttcttggcaaaggcaggctgctggtggtctacccttggacccagaggtcgactcggaccgatg

SEQ ID NO: 15538 - DNA, 203 bp, Homo sapiens
ggcgcgccagtcctcaggattaacctgacacattcttggcaaatagcaacctcaaacagacaccatggttcttggcaaacctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15539 - DNA, 203 bp, Homo sapiens
ggcgcgccagtcctcgtggtaatcctgacacattcttggcaaatagcaacctcaaacagacaccatggttcttggcaaacctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15540 - DNA, 203 bp, Homo sapiens
ggcgcgccagtcctattaggcccactgacacattcttggcaaatagcaacctcaaacagacaccatggttcttggcaaacctgaggttcttggcaaagttactgccctgtggggcaaggtgattcttggcaaagttggtggtgaggccctgggcaggctgctggtggtctacccttggacccagaggtcgactcggaccgatg

SEQ ID NO: 15541 - DNA, 203 bp, Homo sapiens
ggcgcgccagtccttacattaacgctgacacattcttggcaaatagcaacctcaaacagacaccatggttcttggcaaacctgaggttcttggcaaagttactgccctgtggggcaaggtgattcttggcaaagttggtgttcttggcaaaggcaggcttcttggcaaatacccttggacccagaggtcgactcggaccgatg

SEQ ID NO: 15542 - DNA, 203 bp, Homo sapiens
ggcgcgccagtcctattactagtcctgacacattcttggcaaatagcaacctcaaacagacaccatggttcttggcaaacctgaggttcttggcaaagttactgttcttggcaaaaaggtgaacgtggatgaagttggtggtgaggccctgggcaggctgctggtggtctacccttggacccagaggtcgactcggaccgatg

SEQ ID NO: 15543 - DNA, 203 bp, Homo sapiens
ggcgcgccagtccttgttaatgccctgacacattcttggcaaatagcaacctcaaacagacaccatggttcttggcaaacctgaggttcttggcaaagttactgttcttggcaaaaaggtgaacgtggatgaagttggtgttcttggcaaaggcaggctgctggtggtctacccttggacccagaggtcgactcggaccgatg

SEQ ID NO: 15544 - DNA, 203 bp, Homo sapiens
ggcgcgccagtccttttgcgctcactgacacattcttggcaaatagcaacttcttggcaaaaccatggtgcatctgactcctgaggagaagtctgccgttactgccctgtggggcaaggtgaacgtggatgaagttggtgttcttggcaaaggcaggcttcttggcaaatacccttggacccagaggtcgactcggaccgatg

SEQ ID NO: 15545 - DNA, 203 bp, Homo sapiens
ggcgcgccagtcctagttgcgctactgacacattcttggcaaatagcaacttcttggcaaaaccatggtgcatctgactcctgaggagaagtctgccgttactgccctgtggggcaaggtgattcttggcaaagttggtggtgaggccctgggcaggcttcttggcaaatacccttggacccagaggtcgactcggaccgatg

SEQ ID NO: 15546 - DNA, 203 bp, Homo sapiens
ggcgcgccagtcctgttgcgcattctgacacattcttggcaaatagcaacttcttggcaaaaccatggtgcatctgactcctgaggagaagtctgccgttactgccctgtggggcaaggtgattcttggcaaagttggtgttcttggcaaaggcaggctgctggtggtctacccttggacccagaggtcgactcggaccgatg

SEQ ID NO: 15547 - DNA, 203 bp, Homo sapiens
ggcgcgccagtcctatgcgcaacactgacacattcttggcaaatagcaacttcttggcaaaaccatggtgcatctgactcctgaggagaagtctgccgttactgttcttggcaaaaaggtgaacgtggatgaagttggtgttcttggcaaaggcaggctgctggtggtctacccttggacccagaggtcgactcggaccgatg

SEQ ID NO: 15548 - DNA, 203 bp, Homo sapiens
ggcgcgccagtcctccagcgaacactgacacattcttggcaaatagcaacttcttggcaaaaccatggtgcatctgactcctgaggagaagtctgccgttactgttcttggcaaaaaggtgattcttggcaaagttggtggtgaggccctgggcaggcttcttggcaaatacccttggacccagaggtcgactcggaccgatg

SEQ ID NO: 15549 - DNA, 203 bp, Homo sapiens
ggcgcgccagtcctcccagcgtacctgacacattcttggcaaatagcaacttcttggcaaaaccatggtgcatctgactcctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15550 - DNA, 203 bp, Homo sapiens
ggcgcgccagtcctagtcgctggtctgacacattcttggcaaatagcaacttcttggcaaaaccatggtgcatctgactcctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15551 - DNA, 203 bp, Homo sapiens
ggcgcgccagtcctccagcggtagctgacacattcttggcaaatagcaacttcttggcaaaaccatggtgcatctgactcctgaggttcttggcaaagttactgccctgtggggcaaggtgattcttggcaaagttggtggtgaggccctgggcaggctgctggtggtctacccttggacccagaggtcgactcggaccgatg

SEQ ID NO: 15552 - DNA, 203 bp, Homo sapiens
ggcgcgccagtcctccagcgtagcctgacacattcttggcaaatagcaacttcttggcaaaaccatggtgcatctgactcctgaggttcttggcaaagttactgccctgtggggcaaggtgattcttggcaaagttggtgttcttggcaaaggcaggctgctggtggtctacccttggacccagaggtcgactcggaccgatg

SEQ ID NO: 15553 - DNA, 203 bp, Homo sapiens
ggcgcgccagtcctagaattgaatctgacacattcttggcaaatagcaacttcttggcaaaaccatggtgcatctgactcctgaggttcttggcaaagttactgccctgtggggcaaggtgattcttggcaaagttggtgttcttggcaaaggcaggcttcttggcaaatacccttggacccagaggtcgactcggaccgatg

SEQ ID NO: 15554 - DNA, 203 bp, Homo sapiens
ggcgcgccagtcctgacgcagactctgacacattcttggcaaatagcaacttcttggcaaaaccatggtgcatctgactcctgaggttcttggcaaagttactgttcttggcaaaaaggtgattcttggcaaagttggtggtgaggccctgggcaggcttcttggcaaatacccttggacccagaggtcgactcggaccgatg

SEQ ID NO: 15555 - DNA, 203 bp, Homo sapiens
ggcgcgccagtccttttggatcaactgacacattcttggcaaatagcaacttcttggcaaaaccatggttcttggcaaacctgaggagaagtctgccgttactgccctgtggggcaaggtgaacgtggatgaagttggtgttcttggcaaaggcaggctgctggtggtctacccttggacccagaggtcgactcggaccgatg

SEQ ID NO: 15556 - DNA, 203 bp, Homo sapiens
ggcgcgccagtccttgagcgtggactgacacattcttggcaaatagcaacttcttggcaaaaccatggttcttggcaaacctgaggagaagtctgccgttactgccctgtggggcaaggtgattcttggcaaagttggtgttcttggcaaaggcaggctgctggtggtctacccttggacccagaggtcgactcggaccgatg

SEQ ID NO: 15557 - DNA, 203 bp, Homo sapiens
ggcgcgccagtcctttgcgtggacctgacacattcttggcaaatagcaacttcttggcaaaaccatggttcttggcaaacctgaggagaagtctgccgttactgttcttggcaaaaaggtgaacgtggatgaagttggtggtgaggccctgggcaggcttcttggcaaatacccttggacccagaggtcgactcggaccgatg

SEQ ID NO: 15558 - DNA, 203 bp, Homo sapiens
ggcgcgccagtccttatgagatcgctgacacattcttggcaaatagcaacttcttggcaaaaccatggttcttggcaaacctgaggagaagtctgccgttactgttcttggcaaaaaggtgaacgtggatgaagttggtgttcttggcaaaggcaggcttcttggcaaatacccttggacccagaggtcgactcggaccgatg

SEQ ID NO: 15559 - DNA, 203 bp, Homo sapiens
ggcgcgccagtccttggatctcaactgacacattcttggcaaatagcaacttcttggcaaaaccatggttcttggcaaacctgaggagaagtctgccgttactgttcttggcaaaaaggtgattcttggcaaagttggtggtgaggccctgggcaggcttcttggcaaatacccttggacccagaggtcgactcggaccgatg

SEQ ID NO: 15560 - DNA, 203 bp, Homo sapiens
ggcgcgccagtccttgcgatctcactgacacattcttggcaaatagcaacttcttggcaaaaccatggttcttggcaaacctgaggagaagtctgccgttactgttcttggcaaaaaggtgattcttggcaaagttggtgttcttggcaaaggcaggctgctggtggtctacccttggacccagaggtcgactcggaccgatg

SEQ ID NO: 15561 - DNA, 203 bp, Homo sapiens
ggcgcgccagtcctcgtagaccctctgacacattcttggcaaatagcaacttcttggcaaaaccatggttcttggcaaacctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15562 - DNA, 203 bp, Homo sapiens
ggcgcgccagtcctctgcctgaacctgacacattcttggcaaatagcaacttcttggcaaaaccatggttcttggcaaacctgaggttcttggcaaagttactgccctgtggggcaaggtgattcttggcaaagttggtgttcttggcaaaggcaggcttcttggcaaatacccttggacccagaggtcgactcggaccgatg

SEQ ID NO: 15563 - DNA, 203 bp, Homo sapiens
ggcgcgccagtccttgcctgggcgctgacacattcttggcaaatagcaacttcttggcaaaaccatggttcttggcaaacctgaggttcttggcaaagttactgttcttggcaaaaaggtgaacgtggatgaagttggtggtgaggccctgggcaggctgctggtggtctacccttggacccagaggtcgactcggaccgatg

SEQ ID NO: 15564 - DNA, 203 bp, Homo sapiens
ggcgcgccagtccttgcctgaatgctgacacattcttggcaaatagcaacttcttggcaaaaccatggttcttggcaaacctgaggttcttggcaaagttactgttcttggcaaaaaggtgaacgtggatgaagttggtgttcttggcaaaggcaggcttcttggcaaatacccttggacccagaggtcgactcggaccgatg

SEQ ID NO: 15565 - DNA, 203 bp, Homo sapiens
ggcgcgccagtcctcatgcctgatctgacacattcttggcaaatagcaacttcttggcaaaaccatggttcttggcaaacctgaggttcttggcaaagttactgttcttggcaaaaaggtgattcttggcaaagttggtggtgaggccctgggcaggctgctggtggtctacccttggacccagaggtcgactcggaccgatg

SEQ ID NO: 15566 - DNA, 203 bp, Homo sapiens
ggcgcgccagtcctgcctgcctgtctgacacattcttggcaaatagcaacttcttggcaaaaccatggttcttggcaaacctgaggttcttggcaaagttactgttcttggcaaaaaggtgattcttggcaaagttggtgttcttggcaaaggcaggcttcttggcaaatacccttggacccagaggtcgactcggaccgatg

SEQ ID NO: 15567 - DNA, 203 bp, Homo sapiens
ggcgcgccagtcctcaggcagtggctgacaccggcgggttcactagcaacctcaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 15568 - DNA, 203 bp, Homo sapiens
ggcgcgccagtcctgactttaccgctgacatactcccgttcactagcaacctcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 15569 - DNA, 203 bp, Homo sapiens
ggcgcgccagtcctcggtacatgactgacattcttggcaaaactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15570 - DNA, 203 bp, Homo sapiens
ggcgcgccagtcctcggtgtgaatctgacattcttggcaaaactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15571 - DNA, 203 bp, Homo sapiens
ggcgcgccagtcctcggtatctcactgcacggaatcgagaaactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15572 - DNA, 203 bp, Homo sapiens
ggcgcgccagtcctcggctcaaatctgcctttagggcggagccggctcccaccggccgtagtctggggaccggccgtggacggtccaccggccgtcggccgtttaccggccgtgctggctgtaccggccgttcgcggccgaccggccgtcgctcctggaccggccgtagcgcgacaaccggccgtagccgactcggaccgatg

SEQ ID NO: 15573 - DNA, 203 bp, Homo sapiens
ggcgcgccagtcctcatgcgatttctgcctttagggcggagccggctcccgctctcctcagtctgcggcacggaatcgagaagtcccacggaatcgagaagtttcacggaatcgagaactgtcacggaatcgagaagccgcacggaatcgagaactggcacggaatcgagaagacaccatgtcggagccgactcggaccgatg

SEQ ID NO: 15574 - DNA, 203 bp, Homo sapiens
ggcgcgccagtcctcgcatggttactgcctttagggcggagccggctcccgctctcctcagtctgcggcgtcaattcctttagtcccgtcaattcctttagtttcgtcaattcctttactgtcgtcaattcctttagccgcgtcaattcctttactggcgtcaattcctttagacaccatgtcggagccgactcggaccgatg

SEQ ID NO: 15575 - DNA, 203 bp, Homo sapiens
ggcgcgccagtcctcgcatgatccctgcctttagggcggagccggctcccgctctcctcagtctgcggtactcccgcggacggtcctactcccggcggccgttttactcccttgctggctgttactcccagtcgcggccgtactcccatcgctcctggtactccccgagcgcgacatactcccggagccgactcggaccgatg

SEQ ID NO: 15576 - DNA, 203 bp, Homo sapiens
ggcgcgccagtccttcgcatgaatctgcctttagggcggagccggctcccgctctcctcagtctgcggtgggctagcggagggtccggcttccggcggccgtttaccggccgtgctggctgtaccggccgttcgcggccgaccggccgtcgctcctggaccggccgtagcgcgacaaccggccgtagccgactcggaccgatg

SEQ ID NO: 15577 - DNA, 203 bp, Homo sapiens
ggcgcgccagtccttcacgcatgtctgcctttagggcggagccggctcccgctctcctcagtctgcggtgggctagcggagggtccggcttccggcggccgtttctgtctcttgctggctgtcgtcaattcctttagccgcgtcaattcctttactggcgtcaattcctttagacaccatgtcggagccgactcggaccgatg

SEQ ID NO: 15578 - DNA, 203 bp, Homo sapiens
ggcgcgccagtcctcttgtcaattctgcctttagggcggagccggctcccgctctcctcagtctgcggtgggctagcggagggtccggcttccggcggccgtttctgtctcttgctggctgtctcgctgagtcgcggccgaccggccgtcgctcctggaccggccgtagcgcgacaaccggccgtagccgactcggaccgatg

SEQ ID NO: 15579 - DNA, 203 bp, Homo sapiens
ggcgcgccagtcctaattgacaacctgcctttagggcggagccggctcccgctctcctcagtctgcggtgggctagcggagggtccggcttccggcggccgtttctgtctcttgctggctgtctcgctgagtcgcggccgcacggaatcgagaactggcacggaatcgagaagacaccatgtcggagccgactcggaccgatg

SEQ ID NO: 15580 - DNA, 203 bp, Homo sapiens
ggcgcgccagtcctcattacgtttctgcctttagggcggagccggctcccgctctcctcagtctgcggtgggctagcggagggtccggcttccggcggccgtttctgtctcttgctggctgtctcgctgagtcgcggccgccttctcatcgctcctggaaggtcccgagcgcgacaaccggccgtagccgactcggaccgatg

SEQ ID NO: 15581 - DNA, 203 bp, Homo sapiens
ggcgcgccagtcctcctttacgttctgcctttagggcggagccggctcccgctctcctcagtctgcggtgggctagcggagggtccggcttccggcggccgtttctgtctcttgctggctgtctcgctgagtcgcggccgccttctcatcgctcctggaaggtcccgagcgcgacatactcccggagccgactcggaccgatg

SEQ ID NO: 15582 - DNA, 203 bp, Homo sapiens
ggcgcgccagtcctcacgtaagtactgcctttagggcggagccggctcccgctctcctcagtctgcggtgggctagcggagggtccggcttccggcggccgtttctgtctcttgctggctgtctcgctgagtcgcggccgccttctcatcgctcctggaccggccgtagcgcgacaaccggccgtagccgactcggaccgatg

SEQ ID NO: 15583 - DNA, 203 bp, Homo sapiens
ggcgcgccagtcctacgcacgtagctgcctttagggcggagccggctcccgctctcctcagtctgcggtgggctagcggagggtccggcttccggcggccgtttctgtctcttgctggctgtctcgctgagtcgcggccgccttctcatcgctcctggcgtcaattcctttagacaccatgtcggagccgactcggaccgatg

SEQ ID NO: 15584 - DNA, 203 bp, Homo sapiens
ggcgcgccagtcctcctcgcacgactgcctttagggcggagccggctcccgctctcctcagtctgcggtgggctagcggagggtccggcttccggcggccgtttctgtctcttgctggctgtctcgctgagtcgcggccgccttctcatcgctcctggtactccccgagcgcgacatactcccggagccgactcggaccgatg

SEQ ID NO: 15585 - DNA, 203 bp, Homo sapiens
ggcgcgccagtcctccgcacgatcctgcctttagggcggagccggctcccgctctcctcagtctgcggtgggctagcggagggtccggcttccggcggccgtttctgtctcttgctggctgtctcgctgagtcgcggccgcgtcaattcctttactggcgtcaattcctttagacaccatgtcggagccgactcggaccgatg

SEQ ID NO: 15586 - DNA, 203 bp, Homo sapiens
ggcgcgccagtcctcgcacgacggctgcctttagggcggagccggctcccgctctcctcagtctgcggtgggctagcggagggtccggcttccggcggccgtttctgtctcttgctggctgtctcgctgagtcgcggccgttcttggcaaactcctggttcttggcaaacgcgacattcttggcaaaccgactcggaccgatg

SEQ ID NO: 15587 - DNA, 203 bp, Homo sapiens
ggcgcgccagtcctcgtgcgttggctgcctttagggcggagccggctcccgctctcctcagtctgcggtgggctagcggagggtccggcttccggcggccgtttctgtctcttgctggctgtttcttggcaaagcggccgttcttggcaaactcctggttcttggcaaacgcgacattcttggcaaaccgactcggaccgatg

SEQ ID NO: 15588 - DNA, 203 bp, Homo sapiens
ggcgcgccagtccttaccgtgcgtctgcctttagggcggagccggctcccgctctcctcagtctgcggtgggctagcggagggtccggcttccggcggccgtttttcttggcaaatggctgtttcttggcaaagcggccgttcttggcaaactcctggttcttggcaaacgcgacattcttggcaaaccgactcggaccgatg

SEQ ID NO: 15589 - DNA, 203 bp, Homo sapiens
ggcgcgccagtcctgagacgtgcgctgcctttagggcggagccggctcccgctctcctcagtctgcggttcttggcaaaacggtccttcttggcaaagccgtttttcttggcaaatggctgtttcttggcaaagcggccgttcttggcaaactcctggttcttggcaaacgcgacattcttggcaaaccgactcggaccgatg

SEQ ID NO: 15590 - DNA, 203 bp, Homo sapiens
ggcgcgccagtcctcgtgcgtaacctgcctttagggcggagccggctccctactccctcagtctgcggtactcccgcggacggtcctactcccggcggccgttttactcccttgctggctgttactcccagtcgcggccgtactcccatcgctcctggtactccccgagcgcgacatactcccggagccgactcggaccgatg

SEQ ID NO: 15591 - DNA, 203 bp, Homo sapiens
ggcgcgccagtcctgattgtgaccctgccttttactcccagccggctccctactccctcagtctgcggtactcccgcggacggtcctactcccggcggccgttttactcccttgctggctgttactcccagtcgcggccgtactcccatcgctcctggtactccccgagcgcgacatactcccggagccgactcggaccgatg

SEQ ID NO: 15592 - DNA, 203 bp, Homo sapiens
ggcgcgccagtcctttcacaatgcctgcctttttcttggcaaaggctcccttcttggcaaatctgcggttcttggcaaaacggtccttcttggcaaagccgtttttcttggcaaatggctgtttcttggcaaagcggccgttcttggcaaactcctggttcttggcaaacgcgacattcttggcaaaccgactcggaccgatg

SEQ ID NO: 15593 - DNA, 203 bp, Homo sapiens
ggcgcgccagtcctgcgctgatcgctgcgtcaattcctttaactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15594 - DNA, 203 bp, Homo sapiens
ggcgcgccagtcctttcagcgctactgcgtcaattcctttaactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15595 - DNA, 203 bp, Homo sapiens
ggcgcgccagtcctggcgctgagtctgtactccctgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15596 - DNA, 203 bp, Homo sapiens
ggcgcgccagtcctcgcgctgtccctgtactccctgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15597 - DNA, 203 bp, Homo sapiens
ggcgcgccagtcctcgtcgaatccgaacaaaaccggcgggtaaaacaagaccggcgggtggaagaaaaccggcgggttacacaaaaccggcgggtgaaaaaaggccggcgggtaaaacggagccggcgggtaaaatttaaccggcgggtgaatttaaaccggcgggtaacaccaagccggcgggtaaacgactcggaccgatg

SEQ ID NO: 15598 - DNA, 203 bp, Homo sapiens
ggcgcgccagtccttcaaattcgagaacaaaagcaaaaacaaaaacaagaacaaaaaagggaagaaaaacaaaagtatacacaaaaaccaaaaaagaaaaaaggccagagacaaaaacggagccggcgggtaaaatttaaccggcgggtgaatttaaaccggcgggtaacaccaagccggcgggtaaacgactcggaccgatg

SEQ ID NO: 15599 - DNA, 203 bp, Homo sapiens
ggcgcgccagtcctgtgctaccgagaacaaaagcaaaaacaaaaacaagaacaaaaaagggaagaaaaacaaaagtatacacaaaaaccaaaaaagaaaaaaggtactccccaaaaacggagtactccccaaaaatttaatactccccagaatttaaatactccctaaacaccaagtactccccaaaacgactcggaccgatg

SEQ ID NO: 15600 - DNA, 203 bp, Homo sapiens
ggcgcgccagtcctgctggaccgagaacaaaagcaaaaacaaaaacaagaacaaaaaagggaagaaaaacaaaagtatacacaaaacacggaatcgagaaaaggcacggaatcgagaaggagcacggaatcgagaattaacacggaatcgagaataaacacggaatcgagaacaagatagagacaaaacgactcggaccgatg

SEQ ID NO: 15601 - DNA, 203 bp, Homo sapiens
ggcgcgccagtcctgggcactcgggaacaaaagcaaaaacaaaaacaagaacaaaaaagggaagaaaatactccctatacacaaaatactcccaagaaaaaaggtactccccaaaaacggagtactccccaaaaatttaatactccccagaatttaaatactccctaaacaccaagtactccccaaaacgactcggaccgatg

SEQ ID NO: 15602 - DNA, 203 bp, Homo sapiens
ggcgcgccagtcctccctgtgcccgaacaaaagcaaaaacaaaaacaagaacaaaaaagggaagaaaattcttggcaaacacaaaattcttggcaaaaaaaaggttcttggcaaaaacggagttcttggcaaaaatttaattcttggcaaaatttaaattcttggcaaacaccaagttcttggcaaaacgactcggaccgatg

SEQ ID NO: 15603 - DNA, 203 bp, Homo sapiens
ggcgcgccagtcctagtgccctgcgaacaaaagcaaaaacaaaaacaagacacggaatcgagaaaaaacacggaatcgagaaaaaacacggaatcgagaaaaggcacggaatcgagaaggagcacggaatcgagaattaacacggaatcgagaataaacacggaatcgagaacaagatagagacaaaacgactcggaccgatg

SEQ ID NO: 15604 - DNA, 203 bp, Homo sapiens
ggcgcgccagtcctactaagtcccgaacaaaagcaaaaacaaaaacaagattcttggcaaaaagaaaattcttggcaaacacaaaattcttggcaaaaaaaaggttcttggcaaaaacggagttcttggcaaaaatttaattcttggcaaaatttaaattcttggcaaacaccaagttcttggcaaaacgactcggaccgatg

SEQ ID NO: 15605 - DNA, 203 bp, Homo sapiens
ggcgcgccagtccttggacttaaagaacaaaattcttggcaaaaacaagattcttggcaaaaagaaaattcttggcaaacacaaaattcttggcaaaaaaaaggttcttggcaaaaacggagttcttggcaaaaatttaattcttggcaaaatttaaattcttggcaaacaccaagttcttggcaaaacgactcggaccgatg

SEQ ID NO: 15606 - DNA, 203 bp, Homo sapiens
ggcgcgccagtcctagggacttacgagatacacacggaatcgagaaactccacggaatcgagaaaactcacggaatcgagaacggacacggaatcgagaaaattcacggaatcgagaataggcacggaatcgagaaaatccacggaatcgagaagatccacggaatcgagaaccagaatcatacaatccgactcggaccgatg

SEQ ID NO: 15607 - DNA, 203 bp, Homo sapiens
ggcgcgccagtccttaatcccagtgagatacaccggcgggtcacacactcccggcgggtaatcaaactccggcgggttcattgggaccggcgggtctcataattccggcgggtaatcataggccggcgggtttagaaatcccggcgggtttcgtgatcccggcgggtccacaccagccggcgggtatccgactcggaccgatg

SEQ ID NO: 15608 - DNA, 203 bp, Homo sapiens
ggcgcgccagtcctgttaatcccagagatacacgtcaattcctttaactccgtcaattcctttaaactcgtcaattcctttacggacgtcaattcctttaaattcgtcaattcctttataggcgtcaattcctttaaatccgtcaattcctttagatccgtcaattcctttaccagaatcatacaatccgactcggaccgatg

SEQ ID NO: 15609 - DNA, 203 bp, Homo sapiens
ggcgcgccagtcctagggattagggagatacagctgccactcacacactcaccggccgtaatcaaactaccggccgttcattcggaaccggccgtctcataattaccggccgtaatcataggaccggccgtttagaaatcaccggccgtttcgtgatcaccggccgtccacaccagaccggccgtatccgactcggaccgatg

SEQ ID NO: 15610 - DNA, 203 bp, Homo sapiens
ggcgcgccagtccttaccagggacgagatacagctgccactcacacactcatccagacaaatcaaactagactcacatcattcggaaacaattctctcataatttaaagaaaaaatcataggccggacgggttagaaatcccggcgggtttcgtgatcccggcgggtccacaccagccggcgggtatccgactcggaccgatg

SEQ ID NO: 15611 - DNA, 203 bp, Homo sapiens
ggcgcgccagtccttccagggtcggagatacagctgccactcacacactcatccagacaaatcaaactagactcacatcattcggaaacaattctctcataatttaaagaaaaaatcataggccggacgggttagaaatccggtgcttgttcgtgatcaccggccgtccacaccagaccggccgtatccgactcggaccgatg

SEQ ID NO: 15612 - DNA, 203 bp, Homo sapiens
ggcgcgccagtccttccctggtaagagatacagctgccactcacacactcatccagacaaatcaaactagactcacatcattcggaaacaattctctcataatttaaagaaaaaatcataggccggacgggttagaaatccggtgcttgttcgtgatccacggaatcgagaaccagaatcatacaatccgactcggaccgatg

SEQ ID NO: 15613 - DNA, 203 bp, Homo sapiens
ggcgcgccagtccttctaggctgggagatacagctgccactcacacactcatccagacaaatcaaactagactcacatcattcggaaacaattctctcataatttaaagaaaaaatcataggccggacgggttagaaatccgtcaattcctttagatccgtcaattcctttaccagaatcatacaatccgactcggaccgatg

SEQ ID NO: 15614 - DNA, 203 bp, Homo sapiens
ggcgcgccagtcctggtgacgttagagatacagctgccactcacacactcatccagacaaatcaaactagactcacatcattcggaaacaattctctcataatttaaagaaaaaatcataggccggacgggttagaaatcttcttggcaaacgtgatcttcttggcaaaacaccagttcttggcaaaccgactcggaccgatg

SEQ ID NO: 15615 - DNA, 203 bp, Homo sapiens
ggcgcgccagtcctggctgggtaagagatacagctgccactcacacactcatccagacaaatcaaactagactcacatcattcggaaacaattctctcataatttaaagaaaaaatcataggccggcgggtttagaaatcccggcgggtttcgtgatcccggcgggtccacaccagccggcgggtatccgactcggaccgatg

SEQ ID NO: 15616 - DNA, 203 bp, Homo sapiens
ggcgcgccagtcctttacccagctgagatacagctgccactcacacactcatccagacaaatcaaactagactcacatcattcggaaacaattctctcataatttaaagaaaaaatcataggcgtcaattcctttaaatccgtcaattcctttagatccgtcaattcctttaccagaatcatacaatccgactcggaccgatg

SEQ ID NO: 15617 - DNA, 203 bp, Homo sapiens
ggcgcgccagtccttgcctgcagcgagatacagctgccactcacacactcatccagacaaatcaaactagactcacatcattcggaaacaattctctcataatttactcccaaaatcataggtactcccggttagaaatctactccctgttcgtgatctactcccctccacaccagtactccccaatccgactcggaccgatg

SEQ ID NO: 15618 - DNA, 203 bp, Homo sapiens
ggcgcgccagtccttcacacgaccgagatacagctgccactcacacactcatccagacaaatcaaactagactcacatcattcggacacggaatcgagaaaattcacggaatcgagaataggcacggaatcgagaaaatccacggaatcgagaagatccacggaatcgagaaccagaatcatacaatccgactcggaccgatg

SEQ ID NO: 15619 - DNA, 203 bp, Homo sapiens
ggcgcgccagtcctactcacacgtgagatacagctgccactcacacactcatccagacaaatcaaactagactcacatcattcggacgtcaattcctttaaattcgtcaattcctttataggcgtcaattcctttaaatccgtcaattcctttagatccgtcaattcctttaccagaatcatacaatccgactcggaccgatg

SEQ ID NO: 15620 - DNA, 203 bp, Homo sapiens
ggcgcgccagtcctgcgcacacgcgagatacagctgccactcacacactcatccagacaaatcaaactccggcgggttcattgggaccggcgggtctcataattccggcgggtaatcataggccggcgggtttagaaatcccggcgggtttcgtgatcccggcgggtccacaccagccggcgggtatccgactcggaccgatg

SEQ ID NO: 15621 - DNA, 203 bp, Homo sapiens
ggcgcgccagtcctatacacacgcgagatacagctgccactcacacactcatccagacaaatcaaactcgtcaattcctttacggacgtcaattcctttaaattcgtcaattcctttataggcgtcaattcctttaaatccgtcaattcctttagatccgtcaattcctttaccagaatcatacaatccgactcggaccgatg

SEQ ID NO: 15622 - DNA, 203 bp, Homo sapiens
ggcgcgccagtcctcgtgtgtgctgagatacagctgccactcacacactcatccagacaaatcaaacttactccccatcattcggatactcccctctcataatttactcccaaaatcataggtactcccggttagaaatctactccctgttcgtgatctactcccctccacaccagtactccccaatccgactcggaccgatg

SEQ ID NO: 15623 - DNA, 203 bp, Homo sapiens
ggcgcgccagtcctcgtgtgacgagagatacattcttggcaaacacactcttcttggcaaatcaaactttcttggcaaaattcggattcttggcaaacataattttcttggcaaatcataggttcttggcaaaagaaatcttcttggcaaacgtgatcttcttggcaaaacaccagttcttggcaaaccgactcggaccgatg

SEQ ID NO: 15624 - DNA, 203 bp, Homo sapiens
ggcgcgccagtcctagcgtgtgcagatgccggcacggaatcgagaacgtccacggaatcgagaaccctcacggaatcgagaaattacacggaatcgagaacggacacggaatcgagaaccgacacggaatcgagaactggcacggaatcgagaattcgcacggaatcgagaacaagtaagacccaatccgactcggaccgatg

SEQ ID NO: 15625 - DNA, 203 bp, Homo sapiens
ggcgcgccagtcctatcgtgtggtgatgccggccggcgggtaccgccgtcccggcgggtcggttccctccggcgggttcccgattaccggcgggtccgcagggaccggcgggtaccacccgaccggcgggtgactcctggccggcgggtctcatttcgccggcgggtttactcaagccggcgggtatccgactcggaccgatg

SEQ ID NO: 15626 - DNA, 203 bp, Homo sapiens
ggcgcgccagtcctgacatattgcgatgccggcctccgtggaccgccgtcccctgtaaccggttccctcacggaatcgagaaattacacggaatcgagaacggacacggaatcgagaaccgacacggaatcgagaactggcacggaatcgagaattcgcacggaatcgagaacaagtaagacccaatccgactcggaccgatg

SEQ ID NO: 15627 - DNA, 203 bp, Homo sapiens
ggcgcgccagtcctagaagccgctgatgccggcctccgtggaccgccgtcccctgtaaccggttccctgcacggccgtcccgattaaccgattccccgcacggaaccggccgtaccacccgaaccggccgtgactcctggaccggccgtctcatttcgaccggccgtttactcaagaccggccgtatccgactcggaccgatg

SEQ ID NO: 15628 - DNA, 203 bp, Homo sapiens
ggcgcgccagtcctctcaagccgcgatgccggcctccgtggaccgccgtcccctgtaaccggttccctgcacggccgtcccgattaaccgattccccgcacggacgtcaattcctttaccgacgtcaattcctttactggcgtcaattcctttattcgcgtcaattcctttacaagtaagacccaatccgactcggaccgatg

SEQ ID NO: 15629 - DNA, 203 bp, Homo sapiens
ggcgcgccagtcctgccgcaatgcgatgccggcctccgtggaccgccgtcccctgtaaccggttccctgcacggccgtcccgattaaccgattccccgcacggagcaccgcggaccacccgaaccggccgtgactcctggaccggccgtctcatttcgaccggccgtttactcaagaccggccgtatccgactcggaccgatg

SEQ ID NO: 15630 - DNA, 203 bp, Homo sapiens
ggcgcgccagtcctccctgccgctgatgccggcctccgtggaccgccgtcccctgtaaccggttccctgcacggccgtcccgattaaccgattccccgcacggagcaccgcggaccacccgaccgcgagccgactcctggaccggccgtctcatttcgaccggccgtttactcaagaccggccgtatccgactcggaccgatg

SEQ ID NO: 15631 - DNA, 203 bp, Homo sapiens
ggcgcgccagtcctcgtgccgccagatgccggcctccgtggaccgccgtcccctgtaaccggttccctgcacggccgtcccgattaaccgattccccgcacggagcaccgcggaccacccgaccgcgagccgactcctggagttcgttcctcatttcgacggcggcattactcaagtaagacccaatccgactcggaccgatg

SEQ ID NO: 15632 - DNA, 203 bp, Homo sapiens
ggcgcgccagtcctatgccgctaagatgccggcctccgtggaccgccgtcccctgtaaccggttccctgcacggccgtcccgattaaccgattccccgcacggagcaccgcggaccacccgaccgcgagccgactcctggagttcgttcctcatttcgacggcggcattactcaagttcttggcaaaccgactcggaccgatg

SEQ ID NO: 15633 - DNA, 203 bp, Homo sapiens
ggcgcgccagtcctcgccgcatatgatgccggcctccgtggaccgccgtcccctgtaaccggttccctgcacggccgtcccgattaaccgattccccgcacggagcaccgcggaccacccgaccgcgagccgactcctggagttcgttcctcatttcgcacggaatcgagaacaagtaagacccaatccgactcggaccgatg

SEQ ID NO: 15634 - DNA, 203 bp, Homo sapiens
ggcgcgccagtcctctaagccgccgatgccggcctccgtggaccgccgtcccctgtaaccggttccctgcacggccgtcccgattaaccgattccccgcacggagcaccgcggaccacccgaccgcgagccgactcctggcacggaatcgagaattcgcacggaatcgagaacaagtaagacccaatccgactcggaccgatg

SEQ ID NO: 15635 - DNA, 203 bp, Homo sapiens
ggcgcgccagtcctgccgcggtcagatgccggcctccgtggaccgccgtcccctgtaaccggttccctgcacggccgtcccgattaaccgattccccgcacggagcaccgcggaccacccgaccgcgagccgactcctggcgtcaattcctttattcgcgtcaattcctttacaagtaagacccaatccgactcggaccgatg

SEQ ID NO: 15636 - DNA, 203 bp, Homo sapiens
ggcgcgccagtcctagctgccgccgatgccggcctccgtggaccgccgtcccctgtaaccggttccctgcacggccgtcccgattaaccgattccccgcacggagcaccgcggaccacccgaccgcgagccgactcctggttcttggcaaacatttcgttcttggcaaaactcaagttcttggcaaaccgactcggaccgatg

SEQ ID NO: 15637 - DNA, 203 bp, Homo sapiens
ggcgcgccagtcctgccgcatgaggatgccggcctccgtggaccgccgtcccctgtaaccggttccctgcacggccgtcccgattaaccgattccccgcacggagcaccgcggaccacccgaccggcgggtgactcctggccggcgggtctcatttcgccggcgggtttactcaagccggcgggtatccgactcggaccgatg

SEQ ID NO: 15638 - DNA, 203 bp, Homo sapiens
ggcgcgccagtcctgccgcaaacggatgccggcctccgtggaccgccgtcccctgtaaccggttccctgcacggccgtcccgattaaccgattccccgcacggagcaccgcggaccacccgacgtcaattcctttactggcgtcaattcctttattcgcgtcaattcctttacaagtaagacccaatccgactcggaccgatg

SEQ ID NO: 15639 - DNA, 203 bp, Homo sapiens
ggcgcgccagtccttttgccgctagatgccggcctccgtggaccgccgtcccctgtaaccggttccctgcacggccgtcccgattaaccgattccccgcacggagcaccgcggaccacccgatactcccccgactcctggtactccctcctcatttcgtactccccattactcaagtactccccaatccgactcggaccgatg

SEQ ID NO: 15640 - DNA, 203 bp, Homo sapiens
ggcgcgccagtcctgtgcggcaacgatgccggcctccgtggaccgccgtcccctgtaaccggttccctgcacggccgtcccgattaaccgattccccgcacggatactcccggaccacccgatactcccccgactcctggtactccctcctcatttcgtactccccattactcaagtactccccaatccgactcggaccgatg

SEQ ID NO: 15641 - DNA, 203 bp, Homo sapiens
ggcgcgccagtccttggcggctcagatgccggcctccgtggaccgccgtcccctgtaaccggttccctgcacggccgtcccgattaccggcgggtccgcagggaccggcgggtaccacccgaccggcgggtgactcctggccggcgggtctcatttcgccggcgggtttactcaagccggcgggtatccgactcggaccgatg

SEQ ID NO: 15642 - DNA, 203 bp, Homo sapiens
ggcgcgccagtccttgcggcgaacgatgccggcctccgtggaccgccgtcccctgtaaccggttccctgcacggccgtcccgattacgtcaattcctttacggacgtcaattcctttaccgacgtcaattcctttactggcgtcaattcctttattcgcgtcaattcctttacaagtaagacccaatccgactcggaccgatg

SEQ ID NO: 15643 - DNA, 203 bp, Homo sapiens
ggcgcgccagtcctcgctgcggcagatgccggcctccgtggaccgccgtcccctgtaaccggttccctgcacggccgtcccgattattcttggcaaagcacggattcttggcaaacacccgattcttggcaaactcctggttcttggcaaacatttcgttcttggcaaaactcaagttcttggcaaaccgactcggaccgatg

SEQ ID NO: 15644 - DNA, 203 bp, Homo sapiens
ggcgcgccagtcctagagcggcacgatgccggcctccgtggaccgccgtctactcccaccggttcccttactccccgtcccgattatactcccccccgcacggatactcccggaccacccgatactcccccgactcctggtactccctcctcatttcgtactccccattactcaagtactccccaatccgactcggaccgatg

SEQ ID NO: 15645 - DNA, 203 bp, Homo sapiens
ggcgcgccagtcctgctaagcggcgatgcgggaccggccgtaccgccgtcaccggccgtcggttccctaccggccgttcccgattaaccggccgtccgcacggaaccggccgtaccacccgaaccggccgtgactcctggaccggccgtctcatttcgaccggccgtttactcaagaccggccgtatccgactcggaccgatg

SEQ ID NO: 15646 - DNA, 203 bp, Homo sapiens
ggcgcgccagtccttgcggcactcgcagtcctcacggaatcgagaagcagcacggaatcgagaattcccacggaatcgagaatccgcacggaatcgagaagctgcacggaatcgagaaagtgcacggaatcgagaaccttcacggaatcgagaacgtgcacggaatcgagaacgacggcgaggtccgacgactcggaccgatg

SEQ ID NO: 15647 - DNA, 203 bp, Homo sapiens
ggcgcgccagtcctaaaggcggcagcagtcctgggctgtacccggcgcagaccggccgtgctgcttccaccggccgtgtatctccgaccggccgtgggctgctgaccggccgtgaggaagtgaccggccgtgccgaccttaccggccgtctgggcgtgaccggccgtgcctccgacaccggccgtcgacgactcggaccgatg

SEQ ID NO: 15648 - DNA, 203 bp, Homo sapiens
ggcgcgccagtcctcgaggcggctgcagtcctgggctgtacccggcgcagcacggaatcgagaattcccacggaatcgagaatccgcacggaatcgagaagctgcacggaatcgagaaagtgcacggaatcgagaaccttcacggaatcgagaacgtgcacggaatcgagaacgacggcgaggtccgacgactcggaccgatg

SEQ ID NO: 15649 - DNA, 203 bp, Homo sapiens
ggcgcgccagtcctggatctagtagcagtcctgggctgtacccggcgcagctgggagcggctgcttcccgtcaattcctttatccgcgtcaattcctttagctgcgtcaattcctttaagtgcgtcaattcctttaccttcgtcaattcctttacgtgcgtcaattcctttacgacggcgaggtccgacgactcggaccgatg

SEQ ID NO: 15650 - DNA, 203 bp, Homo sapiens
ggcgcgccagtcctactagatcctgcagtcctgggctgtacccggcgcagctgggagcggctgcttcctactccctcgtatctccgtactccctggggctgctgtactcccgcgaggaagtgtactcccccgccgacctttactccctgctgggcgtgtactcccaggcctccgactactccctccgacgactcggaccgatg

SEQ ID NO: 15651 - DNA, 203 bp, Homo sapiens
ggcgcgccagtcctgacccgctgagcagtcctgggctgtacccggcgcagctgggagcggctgcttcctccggggtcgtatctccgcccggcatggggctgctgcacggaatcgagaaagtgcacggaatcgagaaccttcacggaatcgagaacgtgcacggaatcgagaacgacggcgaggtccgacgactcggaccgatg

SEQ ID NO: 15652 - DNA, 203 bp, Homo sapiens
ggcgcgccagtccttgcgtcgattgcagtcctgggctgtacccggcgcagctgggagcggctgcttcctccggggtcgtatctccgcccggcatggggctgctggacctttgcgaggaagtgtactcccccgccgacctttactccctgctgggcgtgtactcccaggcctccgactactccctccgacgactcggaccgatg

SEQ ID NO: 15653 - DNA, 203 bp, Homo sapiens
ggcgcgccagtcctctacgtcaccgcagtcctgggctgtacccggcgcagctgggagcggctgcttcctccggggtcgtatctccgcccggcatggggctgctggacctttgcgaggaagtgttcggcaccgccgaccttaccggccgtctgggcgtgaccggccgtgcctccgacaccggccgtcgacgactcggaccgatg

SEQ ID NO: 15654 - DNA, 203 bp, Homo sapiens
ggcgcgccagtccttgacgtagtggcagtcctgggctgtacccggcgcagctgggagcggctgcttcctccggggtcgtatctccgcccggcatggggctgctggacctttgcgaggaagtgttcggcaccgccgaccttcacggaatcgagaacgtgcacggaatcgagaacgacggcgaggtccgacgactcggaccgatg

SEQ ID NO: 15655 - DNA, 203 bp, Homo sapiens
ggcgcgccagtcctccaagcgcctgcagtcctgggctgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacttcttggcaaaacgactcggaccgatg

SEQ ID NO: 15656 - DNA, 203 bp, Homo sapiens
ggcgcgccagtccttctcaggcgcgcagtcctgggctgtacccggcgcagctgggagcggctgcttcctccggggtcgtatctccgcccggcatggggctgctggacctttgcgaggaagtgttcggcaccgccgacctttaccgggtgctgggcgtgtactcccaggcctccgactactccctccgacgactcggaccgatg

SEQ ID NO: 15657 - DNA, 203 bp, Homo sapiens
ggcgcgccagtcctacaggcgctggcagtcctgggctgtacccggcgcagctgggagcggctgcttcctccggggtcgtatctccgcccggcatggggctgctggacctttgcgaggaagtgttcggcaccgccgaccttttcttggcaaagggcgtgttcttggcaaactccgacttcttggcaaaacgactcggaccgatg

SEQ ID NO: 15658 - DNA, 203 bp, Homo sapiens
ggcgcgccagtcctttagcgctaggcagtcctgggctgtacccggcgcagctgggagcggctgcttcctccggggtcgtatctccgcccggcatggggctgctggacctttgcgaggaagtgttcttggcaaacgaccttttcttggcaaagggcgtgttcttggcaaactccgacttcttggcaaaacgactcggaccgatg

SEQ ID NO: 15659 - DNA, 203 bp, Homo sapiens
ggcgcgccagtcctagtcctatcggcagtcctgggctgtacccggcgcagctgggagcggctgcttcctccggggtcgtatctccgtactccctggggctgctgtactcccgcgaggaagtgtactcccccgccgacctttactccctgctgggcgtgtactcccaggcctccgactactccctccgacgactcggaccgatg

SEQ ID NO: 15660 - DNA, 203 bp, Homo sapiens
ggcgcgccagtcctacctatcttagcagtcctgggctgtacccggcgcagctgggagcggctgcttcctccggggtcgtatctccgttcttggcaaagctgctgttcttggcaaaggaagtgttcttggcaaacgaccttttcttggcaaagggcgtgttcttggcaaactccgacttcttggcaaaacgactcggaccgatg

SEQ ID NO: 15661 - DNA, 203 bp, Homo sapiens
ggcgcgccagtcctctatggtcaggcagtccttactcccacccggcgcagtactccccggctgcttcctactccctcgtatctccgtactccctggggctgctgtactcccgcgaggaagtgtactcccccgccgacctttactccctgctgggcgtgtactcccaggcctccgactactccctccgacgactcggaccgatg

SEQ ID NO: 15662 - DNA, 203 bp, Homo sapiens
ggcgcgccagtcctaggctatgtagcagtcctttcttggcaaaggcgcagttcttggcaaatgcttccttcttggcaaaatctccgttcttggcaaagctgctgttcttggcaaaggaagtgttcttggcaaacgaccttttcttggcaaagggcgtgttcttggcaaactccgacttcttggcaaaacgactcggaccgatg

SEQ ID NO: 15663 - DNA, 203 bp, Homo sapiens
ggcgcgccagtcctaacctctatcgcccgttaaccggccgtgcaaacgacaccggccgtcggtccacgaccggccgtaatgtctctaccggccgttaggcgtagaccggccgttgacaaggaaccggccgtgccgggggcaccggccgtgactccaagaccggccgttcccggtggaccggccgttgccgactcggaccgatg

SEQ ID NO: 15664 - DNA, 203 bp, Homo sapiens
ggcgcgccagtcctctatccaaatgcccgttacccacctgggcaaacgacgcccacgtacggtccacgtactccctcaatgtctcttactcccaataggcgtagtactcccgttgacaaggatactcccgggccgggggctactcccgggactccaagtactccccttcccggtggtactcccaatgccgactcggaccgatg

SEQ ID NO: 15665 - DNA, 203 bp, Homo sapiens
ggcgcgccagtcctactatctggtgcccgttacccacctgggcaaacgacgcccacgtacggtccacgtcgcccttcaatgtctctaccggccgttaggcgtagaccggccgttgacaaggaaccggccgtgccgggggcaccggccgtgactccaagaccggccgttcccggtggaccggccgttgccgactcggaccgatg

SEQ ID NO: 15666 - DNA, 203 bp, Homo sapiens
ggcgcgccagtccttgctatgtaagcccgttacccacctgggcaaacgacgcccacgtacggtccacgtcgcccttcaatgtctctcgtcaattcctttagtagcgtcaattcctttaaggacgtcaattcctttagggccgtcaattcctttacaagcgtcaattcctttagtgggccgggaaatgccgactcggaccgatg

SEQ ID NO: 15667 - DNA, 203 bp, Homo sapiens
ggcgcgccagtcctgtcattctatgcccgttacccacctgggcaaacgacgcccacgtacggtccacgtcgcccttcaatgtctctcttgaccaataggcgtagaccggccgttgacaaggaaccggccgtgccgggggcaccggccgtgactccaagaccggccgttcccggtggaccggccgttgccgactcggaccgatg

SEQ ID NO: 15668 - DNA, 203 bp, Homo sapiens
ggcgcgccagtcctactatgtatcgcccgttacccacctgggcaaacgacgcccacgtacggtccacgtcgcccttcaatgtctctcttgaccaataggcgtagcacggaatcgagaaaggacacggaatcgagaagggccacggaatcgagaacaagcacggaatcgagaagtgggccgggaaatgccgactcggaccgatg

SEQ ID NO: 15669 - DNA, 203 bp, Homo sapiens
ggcgcgccagtccttagtagctatgcccgttacccacctgggcaaacgacgcccacgtacggtccacgtcgcccttcaatgtctctcttgaccaataggcgtagccggcgagttgacaaggaaccggccgtgccgggggcaccggccgtgactccaagaccggccgttcccggtggaccggccgttgccgactcggaccgatg

SEQ ID NO: 15670 - DNA, 203 bp, Homo sapiens
ggcgcgccagtcctcggccctattgcccgttacccacctgggcaaacgacgcccacgtacggtccacgtcgcccttcaatgtctctcttgaccaataggcgtagccggcgagttgacaaggaccagtgggggccgggggcccggcgggtgactccaagccggcgggttcccggtggccggcgggttgccgactcggaccgatg

SEQ ID NO: 15671 - DNA, 203 bp, Homo sapiens
ggcgcgccagtccttgctattgacgcccgttacccacctgggcaaacgacgcccacgtacggtccacgtcgcccttcaatgtctctcttgaccaataggcgtagccggcgagttgacaaggaccagtgggggccgggggcttggagagggactccaagcgtcaattcctttagtgggccgggaaatgccgactcggaccgatg

SEQ ID NO: 15672 - DNA, 203 bp, Homo sapiens
ggcgcgccagtcctcctgggctatgcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtggaccggccgttgccgactcggaccgatg

SEQ ID NO: 15673 - DNA, 203 bp, Homo sapiens
ggcgcgccagtcctgaccctattggcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtggccggcgggttgccgactcggaccgatg

SEQ ID NO: 15674 - DNA, 203 bp, Homo sapiens
ggcgcgccagtccttctatgtgcagcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtgggccgggaaatgccgactcggaccgatg

SEQ ID NO: 15675 - DNA, 203 bp, Homo sapiens
ggcgcgccagtcctgtaggctatcgcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtggtactcccaatgccgactcggaccgatg

SEQ ID NO: 15676 - DNA, 203 bp, Homo sapiens
ggcgcgccagtcctttctatgacagcccgttacccacctgggcaaacgacgcccacgtacggtccacgtcgcccttcaatgtctctcttgaccaataggcgtagccggcgagttgacaaggacgtcaattcctttagggccgtcaattcctttacaagcgtcaattcctttagtgggccgggaaatgccgactcggaccgatg

SEQ ID NO: 15677 - DNA, 203 bp, Homo sapiens
ggcgcgccagtcctcactctattcgcccgttacccacctgggcaaacgacgcccacgtacggtccacgtcgcccttcaatgtctctcttgaccaataggcgtagccggcgagttgacaaggatactcccgggccgggggctactcccgggactccaagtactccccttcccggtggtactcccaatgccgactcggaccgatg

SEQ ID NO: 15678 - DNA, 203 bp, Homo sapiens
ggcgcgccagtcctatgctatcgggcccgttacccacctgggcaaacgacgcccacgtacggtccacgtcgcccttcaatgtctctcttgaccaataggcgtagttcttggcaaaacaaggattcttggcaaacgggggcttcttggcaaactccaagttcttggcaaaccggtggttcttggcaaaccgactcggaccgatg

SEQ ID NO: 15679 - DNA, 203 bp, Homo sapiens
ggcgcgccagtcctatgactatccgcccgttacccacctgggcaaacgacgcccacgtacggtccacgtcgcccttcaatgtctcttactcccaataggcgtagtactcccgttgacaaggatactcccgggccgggggctactcccgggactccaagtactccccttcccggtggtactcccaatgccgactcggaccgatg

SEQ ID NO: 15680 - DNA, 203 bp, Homo sapiens
ggcgcgccagtcctcctatcctttgcccgttacccacctgggcaaacgactactccctacggtccacgtactccctcaatgtctcttactcccaataggcgtagtactcccgttgacaaggatactcccgggccgggggctactcccgggactccaagtactccccttcccggtggtactcccaatgccgactcggaccgatg

SEQ ID NO: 15681 - DNA, 203 bp, Homo sapiens
ggcgcgccagtccttcgactatgtgcccgttatactcccgggcaaacgactactccctacggtccacgtactccctcaatgtctcttactcccaataggcgtagtactcccgttgacaaggatactcccgggccgggggctactcccgggactccaagtactccccttcccggtggtactcccaatgccgactcggaccgatg

SEQ ID NO: 15682 - DNA, 203 bp, Homo sapiens
ggcgcgccagtcctgtaacctattgcccgttattcttggcaaaaaacgacttcttggcaaagtccacgttcttggcaaatgtctctttcttggcaaaggcgtagttcttggcaaaacaaggattcttggcaaacgggggcttcttggcaaactccaagttcttggcaaaccggtggttcttggcaaaccgactcggaccgatg

SEQ ID NO: 15683 - DNA, 203 bp, Homo sapiens
ggcgcgccagtcctagcactatgtggacccgccaccccagagtcaagctgagggcatcggcatgccgcaccggccgtgatcaggacaccggccgttcgggcagtaccggccgtggccttttcaccggccgttccttccgcaccggccgtactctcagcaccggccgtctgattgtcaccggccgtatacgactcggaccgatg

SEQ ID NO: 15684 - DNA, 203 bp, Homo sapiens
ggcgcgccagtcctctgctatggtggacccgccaccccagagtcaagctgagggcatcggcatgccgcagggaagacgatcaggactgtttttaatcgggcagtcacggaatcgagaatttccacggaatcgagaaccgccacggaatcgagaacagccacggaatcgagaatgtcctgggtcacatacgactcggaccgatg

SEQ ID NO: 15685 - DNA, 203 bp, Homo sapiens
ggcgcgccagtcctgctatcgcatggacccgccaccccagagtcaagctgagggcatcggcatgccgcagggaagacgatcaggactgtttttaatcgggcagtcgcgcggatggccttttcaccggccgttccttccgcaccggccgtactctcagcaccggccgtctgattgtcaccggccgtatacgactcggaccgatg

SEQ ID NO: 15686 - DNA, 203 bp, Homo sapiens
ggcgcgccagtcctctattcgttcggacccgccaccccagagtcaagctgagggcatcggcatgccgcagggaagacgatcaggactgtttttaatcgggcagtcgcgcggatggccttttcccggcgggttccttccgcccggcgggtactctcagcccggcgggtctgattgtcccggcgggtatacgactcggaccgatg

SEQ ID NO: 15687 - DNA, 203 bp, Homo sapiens
ggcgcgccagtccttctcgctatgggacccgccaccccagagtcaagctgagggcatcggcatgccgcagggaagacgatcaggactgtttttaatcgggcagtcgcgcggatggccttttccctctcgcctccttccgcaccggccgtactctcagcaccggccgtctgattgtcaccggccgtatacgactcggaccgatg

SEQ ID NO: 15688 - DNA, 203 bp, Homo sapiens
ggcgcgccagtcctaactatggatggacccgccaccccagagtcaagctgagggcatcggcatgccgcagggaagacgatcaggactgtttttaatcgggcagtcgcgcggatggccttttccctctcgcctccttccgccacggaatcgagaacagccacggaatcgagaatgtcctgggtcacatacgactcggaccgatg

SEQ ID NO: 15689 - DNA, 203 bp, Homo sapiens
ggcgcgccagtcctcctatgaaggggacccgccaccccagagtcaagctgagggcatcggcatgccgcagggaagacgatcaggactgtttttaatcgggcagtcgcgcggatggccttttccctctcgcctccttccgccccgcccccactctcagcaccggccgtctgattgtcaccggccgtatacgactcggaccgatg

SEQ ID NO: 15690 - DNA, 203 bp, Homo sapiens
ggcgcgccagtcctccctatgtgtggacccgccaccccagagtcaagctgagggcatcggcatgccgcagggaagacgatcaggactgtttttaatcgggcagtcgcgcggatggccttttccctctcgcctccttccgccccgcccccactctcagccacggaatcgagaatgtcctgggtcacatacgactcggaccgatg

SEQ ID NO: 15691 - DNA, 203 bp, Homo sapiens
ggcgcgccagtcctactatgttggggacccgccaccccagagtcaagctgagggcatcggcatgccgcagggaagacgatcaggactgtttttaatcgggcagtcgcgcggatggccttttccctctcgcctccttccgccccgcccccactctcagcccggcgggtctgattgtcccggcgggtatacgactcggaccgatg

SEQ ID NO: 15692 - DNA, 203 bp, Homo sapiens
ggcgcgccagtcctcactatgattggacccgccaccccagagtcaagctgagggcatcggcatgccgcagggaagacgatcaggactgtttttaatcgggcagtcgcgcggatggccttttccctctcgcctccttccgccgtcaattcctttacagccgtcaattcctttatgtcctgggtcacatacgactcggaccgatg

SEQ ID NO: 15693 - DNA, 203 bp, Homo sapiens
ggcgcgccagtcctctatctgattggacccgccaccccagagtcaagctgagggcatcggcatgccgctactcccacgatcaggactactcccaatcgggcagttactcccatggccttttctactccccctccttccgctactcccccactctcagctactccccgctgattgtctactcccacatacgactcggaccgatg

SEQ ID NO: 15694 - DNA, 203 bp, Homo sapiens
ggcgcgccagtcctgaacgctattggacccgccaccccagagtcaagctgccggcgggtgcatgccgcccggcgggtgatcaggacccggcgggttcgggcagtccggcgggtggccttttcccggcgggttccttccgcccggcgggtactctcagcccggcgggtctgattgtcccggcgggtatacgactcggaccgatg

SEQ ID NO: 15695 - DNA, 203 bp, Homo sapiens
ggcgcgccagtcctgctctatccaggacccgccaccccagagtcaagctgcgtcaattcctttaccgccgtcaattcctttaggaccgtcaattcctttacagtcgtcaattcctttatttccgtcaattcctttaccgccgtcaattcctttacagccgtcaattcctttatgtcctgggtcacatacgactcggaccgatg

SEQ ID NO: 15696 - DNA, 203 bp, Homo sapiens
ggcgcgccagtcctctattctcaaggacccgccgtcaattcctttagctgcgtcaattcctttaccgccgtcaattcctttaggaccgtcaattcctttacagtcgtcaattcctttatttccgtcaattcctttaccgccgtcaattcctttacagccgtcaattcctttatgtcctgggtcacatacgactcggaccgatg

SEQ ID NO: 15697 - DNA, 203 bp, Homo sapiens
ggcgcgccagtcctctattgagcgggacccgctactcccgagtcaagctgtactccccggcatgccgctactcccacgatcaggactactcccaatcgggcagttactcccatggccttttctactccccctccttccgctactcccccactctcagctactccccgctgattgtctactcccacatacgactcggaccgatg

SEQ ID NO: 15698 - DNA, 203 bp, Homo sapiens
ggcgcgccagtcctgcttctatgagggccgcgaccggccgtcgcttccgcaccggccgtggcgggggaaccggccgtcggtctcagaccggccgtccagctctcaccggccgttcttccgccaccggccgttcgcgtttcaccggccgtcgcaatggaaccggccgtcgccgcgctaccggccgtcaacgactcggaccgatg

SEQ ID NO: 15699 - DNA, 203 bp, Homo sapiens
ggcgcgccagtcctgacctattcggggccgcgcgcgcgcgccgcgtaggagaggagcgagcgaccaaaggaaccataactgatttaatgagccattcgcagtttcactgtaccggccgtgcgtactcagacatgcatggcttaatctttgagacaagcatatgctactggcaggatcaaccaggacaacgactcggaccgatg

SEQ ID NO: 15700 - DNA, 203 bp, Homo sapiens
ggcgcgccagtcctctttctatgtgggccgcgcgcgcgcgccgctaagccgcaggctccactcctggtggtgcccttccgtcaattcctttaagtttcagctttgcaaccatactccccccggaacccaaagactttggtttcccggaagctgcccggcgggtcatgggaataacgccgccgcgacaacgactcggaccgatg

SEQ ID NO: 15701 - DNA, 203 bp, Homo sapiens
ggcgcgccagtcctcgctattcgggggccgcgcgcgcgcgccgctcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatacaacgactcggaccgatg

SEQ ID NO: 15702 - DNA, 203 bp, Homo sapiens
ggcgcgccagtcctgatcatagtcgggccgcgcgcgcgcgccgcttcaagtttcagctttgcaaccatactccccccggaacccaaagactttggtttcccggaagctgcccggcgggtcatgggaataacgccgccgcatcgccggtcggcatcgtttatggtcggaactacgacggtatttgacaacgactcggaccgatg

SEQ ID NO: 15703 - DNA, 203 bp, Homo sapiens
ggcgcgccagtcctttgggatagagggccgcgcgcgcgcgccgcttccaactacgacggtatctgatcgtcttcgaacctccgactttcgttcttgattaatgaaaacattcttggcaaatgctttcgctctggtccgtcttgcgccggtccaagaatttcacctctagcggcgcaatacattgacaacgactcggaccgatg

SEQ ID NO: 15704 - DNA, 203 bp, Homo sapiens
ggcgcgccagtcctatagtagctcgggccgcgcgcgcgcgccgcttccagtttcagctttgcaaccatactccccccggaacccaaagactttggtttcccggaagctgcccggcgggtcatgggaataacgccgccgcatcgccggtcggcatcgtttatggtcggaactacgacggtaattgacaacgactcggaccgatg

SEQ ID NO: 15705 - DNA, 203 bp, Homo sapiens
ggcgcgccagtccttaatcatagggggccgcgcgcgcgcgccgcttccgagaggagcgagcgaccaaaggaaccataactgatttaatgagccattcgcagtttcactgtaccggccgtgcgtactcagacatgcatggcttaatctttgagacaagcatatgctactggcaggatcaacattgacaacgactcggaccgatg

SEQ ID NO: 15706 - DNA, 203 bp, Homo sapiens
ggcgcgccagtcctcatagagtgtgggccgcgcgcgcgcgccgcttccgcaggtttcccgtgttgagtcaaattaagccgcaggctccactcctggtggtgcccttccgtcaattcctttaagtttcagctttgcaaccatactccccccggaacccaaagactttggtttcccggaatcattgacaacgactcggaccgatg

SEQ ID NO: 15707 - DNA, 203 bp, Homo sapiens
ggcgcgccagtccttgagatagacgggccgcgcgcgcgcgccgcttccgccacggaatcgagaagggacacggaatcgagaatcagcacggaatcgagaatctccacggaatcgagaacgcccacggaatcgagaatttccacggaatcgagaatggacacggaatcgagaacgctggtcattgacaacgactcggaccgatg

SEQ ID NO: 15708 - DNA, 203 bp, Homo sapiens
ggcgcgccagtcctacgggatagcgggccgcgcgcgcgcgccgcttccgcgcaggctccactcctggtggtgcccttccgtcaattcctttaagtttcagctttgcaaccatactccccccggaacccaaagactttggtttcccggaagctgcccggcgggtcatgggaataacgccgcattgacaacgactcggaccgatg

SEQ ID NO: 15709 - DNA, 203 bp, Homo sapiens
ggcgcgccagtccttcataggatcgggccgcgcgcgcgcgccgcttccgctactcccacggcgggggatactcccgtcggtctcagtactccctgccagctctctactcccgttcttccgcctactccccgtcgcgtttctactcccgtcgcaatggatactcccatcgccgcgcttactcccgacaacgactcggaccgatg

SEQ ID NO: 15710 - DNA, 203 bp, Homo sapiens
ggcgcgccagtcctgttgagataggggccgcgcgcgcgcgccgcttccgcttaaaaattaaccagacaaatcgctccaccaactaagaacggccatgcaccaccacccacggaatcgagaaagagctatcaatctgtcaatcctgtccgtgtccgggccgggtgaggtttcccgctggtcattgacaacgactcggaccgatg

SEQ ID NO: 15711 - DNA, 203 bp, Homo sapiens
ggcgcgccagtcctaatagctacggggccgcgcgcgcgcgccgcttccgcttaaaacggtatctgatcgtcttcgaacctccgactttcgttcttgattaatgaaaacattcttggcaaatgctttcgctctggtccgtcttgcgccggtccaagaatttcacctctagcggcgctggtcattgacaacgactcggaccgatg

SEQ ID NO: 15712 - DNA, 203 bp, Homo sapiens
ggcgcgccagtcctccaggatagagggccgcgcgcgcgcgccgcttccgcttaaactccactcctggtggtgcccttccgtcaattcctttaagtttcagctttgcaaccatactccccccggaacccaaagactttggtttcccggaagctgcccggcgggtcatgggaatagctggtcattgacaacgactcggaccgatg

SEQ ID NO: 15713 - DNA, 203 bp, Homo sapiens
ggcgcgccagtccttaacgcataggggccgcgcgcgcgcgccgcttccgcttaaataacggcaaccatactccccccggaacccaaagactttggtttcccggaagctgcccggcgggtcatgggaataacgccgccgcatcgccggtcggcatcgtttatggtcggcgccgcgctggtcattgacaacgactcggaccgatg

SEQ ID NO: 15714 - DNA, 203 bp, Homo sapiens
ggcgcgccagtcctatagctcttagggccgcgcgcgcgcgccgcttccgcttaaataacggcaccaaaggaaccataactgatttaatgagccattcgcagtttcactgtaccggccgtgcgtactcagacatgcatggcttaatctttgagacaagcatatgctatcgccgcgctggtcattgacaacgactcggaccgatg

SEQ ID NO: 15715 - DNA, 203 bp, Homo sapiens
ggcgcgccagtcctggatagtctagggccgcgcgcgcgcgccgcttccgcttaaataacggcgaccatactccccccggaacccaaagactttggtttcccggaagctgcccggcgggtcatgggaataacgccgccgcatcgccggtcggcatcgtttatggtcatcgccgcgctggtcattgacaacgactcggaccgatg

SEQ ID NO: 15716 - DNA, 203 bp, Homo sapiens
ggcgcgccagtcctatagtgcgaggggccgcgcgcgcgcgccgcttccgcttaaataacggcgggaaaggaaccataactgatttaatgagccattcgcagtttcactgtaccggccgtgcgtactcagacatgcatggcttaatctttgagacaagcatatgagatcgccgcgctggtcattgacaacgactcggaccgatg

SEQ ID NO: 15717 - DNA, 203 bp, Homo sapiens
ggcgcgccagtcctaataggactagggccgcgcgcgcgcgccgcttccgcttaaataacggcgggacaaatcgctccaccaactaagaacggccatgcaccaccacccacggaatcgagaaagagctatcaatctgtcaatcctgtccgtgtccgggccgggtggatcgccgcgctggtcattgacaacgactcggaccgatg

SEQ ID NO: 15718 - DNA, 203 bp, Homo sapiens
ggcgcgccagtcctacatagtcgcgggccgcgcgcgcgcgccgcttccgcttaaataacggcgggcatactccccccggaacccaaagactttggtttcccggaagctgcccggcgggtcatgggaataacgccgccgcatcgccggtcggcatcgtttatggagatcgccgcgctggtcattgacaacgactcggaccgatg

SEQ ID NO: 15719 - DNA, 203 bp, Homo sapiens
ggcgcgccagtcctcaataggtctgggccgcgcgcgcgcgccgcttccgcttaaataacggcggggaaggaaccataactgatttaatgagccattcgcagtttcactgtaccggccgtgcgtactcagacatgcatggcttaatctttgagacaagcatatgagatcgccgcgctggtcattgacaacgactcggaccgatg

SEQ ID NO: 15720 - DNA, 203 bp, Homo sapiens
ggcgcgccagtcctgtgagatagcgggccgcgcgcgcgcgccgcttccgcttaaataacggcggggcaaatcgctccaccaactaagaacggccatgcaccaccacccacggaatcgagaaagagctatcaatctgtcaatcctgtccgtgtccgggccggggagatcgccgcgctggtcattgacaacgactcggaccgatg

SEQ ID NO: 15721 - DNA, 203 bp, Homo sapiens
ggcgcgccagtcctatagcatagtgggccgcgcgcgcgcgccgcttccgcttaaataacggcgggggaactccccccggaacccaaagactttggtttcccggaagctgcccggcgggtcatgggaataacgccgccgcatcgccggtcggcatcgtttaaagagatcgccgcgctggtcattgacaacgactcggaccgatg

SEQ ID NO: 15722 - DNA, 203 bp, Homo sapiens
ggcgcgccagtccttcatagcactgggccgcgcgcgcgcgccgcttccgcttaaataacggcgggggacaaattaagccgcaggctccactcctggtggtgcccttccgtcaattcctttaagtttcagctttgcaaccatactccccccggaacccaaaaagagatcgccgcgctggtcattgacaacgactcggaccgatg

SEQ ID NO: 15723 - DNA, 203 bp, Homo sapiens
ggcgcgccagtcctatagatacccgggccgcgcgcgcgcgccgcttccgcttaaataacggcgggggaccggcgggtcggtctcagccggcgggtccagctctcccggcgggttcttccgccccggcgggttcgcgtttcccggcgggtcgcaatggaccggcgggtcgccgcgctccggcgggtcaacgactcggaccgatg

SEQ ID NO: 15724 - DNA, 203 bp, Homo sapiens
ggcgcgccagtcctctcaatagttgggccgcgcgcgcgcgccgcttccgcttaaataacggcgggggagatcgctccaccaactaagaacggccatgcaccaccacccacggaatcgagaaagagctatcaatctgtcaatcctgtccgtgtccgggccgaagagatcgccgcgctggtcattgacaacgactcggaccgatg

SEQ ID NO: 15725 - DNA, 203 bp, Homo sapiens
ggcgcgccagtcctcatagcctaggggccgcgcgcgcgcgccgcttccgcttaaataacggcgggggaggccgcataactgatttaatgagccattcgcagtttcactgtaccggccgtgcgtactcagacatgcatggcttaatctttgagacaggaagaagagatcgccgcgctggtcattgacaacgactcggaccgatg

SEQ ID NO: 15726 - DNA, 203 bp, Homo sapiens
ggcgcgccagtcctaagaagataggggccgcgcgcgcgcgccgcttccgcttaaataacggcgggggaggccgccccggaacccaaagactttggtttcccggaagctgcccggcgggtcatgggaataacgccgccgcatcgccggtcggcatcggaagaagagatcgccgcgctggtcattgacaacgactcggaccgatg

SEQ ID NO: 15727 - DNA, 203 bp, Homo sapiens
ggcgcgccagtcctatagagcatggggccgcgcgcgcgcgccgcttccgcttaaataacggcgggggaggccgcgaacctccgactttcgttcttgattaatgaaaacattcttggcaaatgctttcgctctggtccgtcttgcgccggtccaatggaagaagagatcgccgcgctggtcattgacaacgactcggaccgatg

SEQ ID NO: 15728 - DNA, 203 bp, Homo sapiens
ggcgcgccagtccttgcttcataggggccgcgcgcgcgcgccgcttccgcttaaataacggcgggggaggccgcgccggaacccaaagactttggtttcccggaagctgcccggcgggtcatgggaataacgccgccgcatcgccggtcggcaatggaagaagagatcgccgcgctggtcattgacaacgactcggaccgatg

SEQ ID NO: 15729 - DNA, 203 bp, Homo sapiens
ggcgcgccagtcctcagttcataggggccgcgcgcgcgcgccgcttccgcttaaataacggcgggggaggccgcggcaccaactaagaacggccatgcaccaccacccacggaatcgagaaagagctatcaatctgtcaatcctgtccgtgtaatggaagaagagatcgccgcgctggtcattgacaacgactcggaccgatg

SEQ ID NO: 15730 - DNA, 203 bp, Homo sapiens
ggcgcgccagtcctaatagtgccagggccgcgcgcgcgcgccgcttccgcttaaataacggcgggggaggccgcgggccgcaggctccactcctggtggtgcccttccgtcaattcctttaagtttcagctttgcaaccatactccccccggaatggaagaagagatcgccgcgctggtcattgacaacgactcggaccgatg

SEQ ID NO: 15731 - DNA, 203 bp, Homo sapiens
ggcgcgccagtcctatagcgggttgggccgcgcgcgcgcgccgcttccgcttaaataacggcgggggaggccgcggtcggaactaagaacggccatgcaccaccacccacggaatcgagaaagagctatcaatctgtcaatcctgtcctcgcaatggaagaagagatcgccgcgctggtcattgacaacgactcggaccgatg

SEQ ID NO: 15732 - DNA, 203 bp, Homo sapiens
ggcgcgccagtcctatagggacaagggccgcgcgcgcgcgccgcttccgcttaaataacggcgggggaggccgcggtcggcaggctccactcctggtggtgcccttccgtcaattcctttaagtttcagctttgcaaccatactcccctcgcaatggaagaagagatcgccgcgctggtcattgacaacgactcggaccgatg

SEQ ID NO: 15733 - DNA, 203 bp, Homo sapiens
ggcgcgccagtcctcaatagagtggggccgcgcgcgcgcgccgcttccgcttaaataacggcgggggaggccgcggtcgggatttaatgagccattcgcagtttcactgtaccggccgtgcgtactcagacatgcatggcttaatctttcgcaatggaagaagagatcgccgcgctggtcattgacaacgactcggaccgatg

SEQ ID NO: 15734 - DNA, 203 bp, Homo sapiens
ggcgcgccagtcctcatagtacaagggccgcgcgcgcgcgccgcttccgcttaaataacggcgggggaggccgcggtcggtactaagaacggccatgcaccaccacccacggaatcgagaaagagctatcaatctgtcaatcctgtcgtcgcaatggaagaagagatcgccgcgctggtcattgacaacgactcggaccgatg

SEQ ID NO: 15735 - DNA, 203 bp, Homo sapiens
ggcgcgccagtcctataggtcctggggccgcgcgcgcgcgccgcttccgcttaaataacggcgggggaggccgcggtcggtaggctccactcctggtggtgcccttccgtcaattcctttaagtttcagctttgcaaccatactcccgtcgcaatggaagaagagatcgccgcgctggtcattgacaacgactcggaccgatg

SEQ ID NO: 15736 - DNA, 203 bp, Homo sapiens
ggcgcgccagtcctgcacataggagggccgcgcgcgcgcgccgcttccgcttaaataacggcgggggaggccgcggtcggtatttaatgagccattcgcagtttcactgtaccggccgtgcgtactcagacatgcatggcttaatctgtcgcaatggaagaagagatcgccgcgctggtcattgacaacgactcggaccgatg

SEQ ID NO: 15737 - DNA, 203 bp, Homo sapiens
ggcgcgccagtcctaatagtaatcgggccgcgcgcgcgcgccgcttccgcttaaataacggcgggggaggccgcggtcggtctcagaccggccgtccagctctcaccggccgttcttccgccaccggccgttcgcgtttcaccggccgtcgcaatggaaccggccgtcgccgcgctaccggccgtcaacgactcggaccgatg

SEQ ID NO: 15738 - DNA, 203 bp, Homo sapiens
ggcgcgccagtcctatagtagggagggccgcgcgcgcgcgccgcttccgcttaaataacggcgggggaggccgcggtcggtctcagaccggccgtccagctctcaccggccgttcttccgccaccggccgttcgcgtttcaccggccgtcgcaatggaaccggccgtcgccgcgctggtcattgacaacgactcggaccgatg

SEQ ID NO: 15739 - DNA, 203 bp, Homo sapiens
ggcgcgccagtcctccgatttggggggccgcgcgcgcgcgccgcttccgcttaaataacggcgggggaggccgcggtcggtctcagatgagccattcgcagtttcactgtaccggccgtgcgtactcagacatgcatggctttgccggtcgcaatggaagaagagatcgccgcgctggtcattgacaacgactcggaccgatg

SEQ ID NO: 15740 - DNA, 203 bp, Homo sapiens
ggcgcgccagtcctcacacgtcaagggccgcgcgcgcgcgccgcttccgcttaaataacggcgggggaggccgcggtcggtctcagccggcgggtccagctctcccggcgggttcttccgccccggcgggttcgcgtttcccggcgggtcgcaatggaccggcgggtcgccgcgctggtcattgacaacgactcggaccgatg

SEQ ID NO: 15741 - DNA, 203 bp, Homo sapiens
ggcgcgccagtcctcgtgacgtgtgggccgcgcgcgcgcgccgcttccgcttaaataacggcgggggaggccgcggtcggtctcaggggagtatgccagctctcgggagtagttcttccgccgggagtacgtcgcgtttcgggagtagtcgcaatggagggagtaatcgccgcgctggtcattgacaacgactcggaccgatg

SEQ ID NO: 15742 - DNA, 203 bp, Homo sapiens
ggcgcgccagtcctacagttactagggccgcgcgcgcgcgccgcttccgcttaaataacggcgggggaggccgcggtcggtctcagtactccctgccagctctctactcccgttcttccgcctactccccgtcgcgtttctactcccgtcgcaatggatactcccatcgccgcgctggtcattgacaacgactcggaccgatg

SEQ ID NO: 15743 - DNA, 203 bp, Homo sapiens
ggcgcgccagtccttggttaccatgggccgcgcgcgcgcgccgcttccgcttaaataacggcgggggaggccgcggtcggtctcagtactccctgccagctctctactcccgttcttccgcctactccccgtcgcgtttctactcccgtcgcaatggatactcccatcgccgcgcttactcccgacaacgactcggaccgatg

SEQ ID NO: 15744 - DNA, 203 bp, Homo sapiens
ggcgcgccagtccttgtagtaacagggccgcgcgcgcgcgccgcttccgcttaaataacggcgggggaggccgcggtcggtctcagtcactttggtttcccggaagctgcccggcgggtcatgggaataacgccgccgcatctgccggtcgcaatggaagaagagatcgccgcgctggtcattgacaacgactcggaccgatg

SEQ ID NO: 15745 - DNA, 203 bp, Homo sapiens
ggcgcgccagtcctgtattgtaaagggccgcgcgcgcgcgccgcttccgcttaaataacggcgggggaggccgcggtcggtctcagtcgccaagtttcagctttgcaaccatactccccccggaacccaaagactttttctctgccggtcgcaatggaagaagagatcgccgcgctggtcattgacaacgactcggaccgatg

SEQ ID NO: 15746 - DNA, 203 bp, Homo sapiens
ggcgcgccagtcctgctattgtaagggccgcgcgcgcgcgccgcttccgcttaaataacggcgggggaggccgcggtcggtctcagtcgcccctggtggtgcccttccgtcaattcctttaagtttcagctttgcaattctctgccggtcgcaatggaagaagagatcgccgcgctggtcattgacaacgactcggaccgatg

SEQ ID NO: 15747 - DNA, 203 bp, Homo sapiens
ggcgcgccagtcctgccttgcgcggggccgcgcgcgcgcgccgcttccgcttaaataacggcgggggaggccgcggtcggtctcagtcgccgctatgcaccaccacccacggaatcgagaaagagctatcaatccgtttctctgccggtcgcaatggaagaagagatcgccgcgctggtcattgacaacgactcggaccgatg

SEQ ID NO: 15748 - DNA, 203 bp, Homo sapiens
ggcgcgccagtcctctcaaatacagggccgcgcgcgcgcgccgcttccgcttaaataacggcgggggaggccgcggtcggtctcagtcgccgctgccagcgtttcactgtaccggccgtgcgtactcaccgtcgcgtttctctgccggtcgcaatggaagaagagatcgccgcgctggtcattgacaacgactcggaccgatg

SEQ ID NO: 15749 - DNA, 203 bp, Homo sapiens
ggcgcgccagtcctgtcaaaataggggccgcgcgcgcgcgccgcttccgcttaaataacggcgggggaggccgcggtcggtctcagtcgccgctgccagctcccacccacggaatcgagaaagagccgccgtcgcgtttctctgccggtcgcaatggaagaagagatcgccgcgctggtcattgacaacgactcggaccgatg

SEQ ID NO: 15750 - DNA, 203 bp, Homo sapiens
ggcgcgccagtcctgcaaatacatgggccgcgcgcgcgcgccgcttccgcttaaataacggcgggggaggccgcggtcggtctcagtcgccgctgccagctcccttccgtcaattcctttaagtttcgccgtcgcgtttctctgccggtcgcaatggaagaagagatcgccgcgctggtcattgacaacgactcggaccgatg

SEQ ID NO: 15751 - DNA, 203 bp, Homo sapiens
ggcgcgccagtcctcaaatattgagggccgcgcgcgcgcgccgcttccgcttaaataacggcgggggaggccgcggtcggtctcagtcgccgctgccagctctcaaacattcttggcaaatgcttccgccgtcgcgtttctctgccggtcgcaatggaagaagagatcgccgcgctggtcattgacaacgactcggaccgatg

SEQ ID NO: 15752 - DNA, 203 bp, Homo sapiens
ggcgcgccagtcctactaaatacggggccgcgcgcgcgcgccgcttccgcttaaataacggcgggggaggccgcggtcggtctcagtcgccgctgccagctctcacccacggaatcgagaaagatccgccgtcgcgtttctctgccggtcgcaatggaagaagagatcgccgcgctggtcattgacaacgactcggaccgatg

SEQ ID NO: 15753 - DNA, 203 bp, Homo sapiens
ggcgcgccagtcctgggtaaatatgggccgcgcgcgcgcgccgcttccgcttaaataacggcgggggaggccgcggtcggtctcagtcgccgctgccagctctcaccggccgttcttccgccaccggccgttcgcgtttcaccggccgtcgcaatggaaccggccgtcgccgcgctaccggccgtcaacgactcggaccgatg

SEQ ID NO: 15754 - DNA, 203 bp, Homo sapiens
ggcgcgccagtcctcaaatactaggggccgcgcgcgcgcgccgcttccgcttaaataacggcgggggaggccgcggtcggtctcagtcgccgctgccagctctcaccggccgttcttccgccaccggccgttcgcgtttcaccggccgtcgcaatggaaccggccgtcgccgcgctggtcattgacaacgactcggaccgatg

SEQ ID NO: 15755 - DNA, 203 bp, Homo sapiens
ggcgcgccagtcctccctaaatacgggccgcgcgcgcgcgccgcttccgcttaaataacggcgggggaggccgcggtcggtctcagtcgccgctgccagctctcacggccggttcttccgccacggccggttcgcgtttcacggccggtcgcaatggaacggccggtcgccgcgctggtcattgacaacgactcggaccgatg

SEQ ID NO: 15756 - DNA, 203 bp, Homo sapiens
ggcgcgccagtcctggcctaaatagggccgcgcgcgcgcgccgcttccgcttaaataacggcgggggaggccgcggtcggtctcagtcgccgctgccagctctcccggcgggttcttccgccccggcgggttcgcgtttcccggcgggtcgcaatggaccggcgggtcgccgcgctccggcgggtcaacgactcggaccgatg

SEQ ID NO: 15757 - DNA, 203 bp, Homo sapiens
ggcgcgccagtccttatttagcgcgggccgcgcgcgcgcgccgcttccgcttaaataacggcgggggaggccgcggtcggtctcagtcgccgctgccagctctcgcaaccatactcccccccgctccgccgtcgcgtttctctgccggtcgcaatggaagaagagatcgccgcgctggtcattgacaacgactcggaccgatg

SEQ ID NO: 15758 - DNA, 203 bp, Homo sapiens
ggcgcgccagtccttacgctatttgggccgcgcgcgcgcgccgcttccgcttaaataacggcgggggaggccgcggtcggtctcagtcgccgctgccagctctcgcacgcccggcgggtcccgctccgccgtcgcgtttctctgccggtcgcaatggaagaagagatcgccgcgctggtcattgacaacgactcggaccgatg

SEQ ID NO: 15759 - DNA, 203 bp, Homo sapiens
ggcgcgccagtcctcgggttggacgggccgcgcgcgcgcgccgcttccgcttaaataacggcgggggaggccgcggtcggtctcagtcgccgctgccagctctcgcactctgattctccgccgctccgccgtcgcgtttctctgccggtcgcaatggaagaagagatcgccgcgctggtcattgacaacgactcggaccgatg

SEQ ID NO: 15760 - DNA, 203 bp, Homo sapiens
ggcgcgccagtcctgactcgtaccgggccgcgcgcgcgcgccgcttccgcttaaataacggcgggggaggccgcggtcggtctcagtcgccgctgccagctctcgcactctgttcttccgccgctccgccgtcgcgtttcttcttggcaaacaatggattcttggcaaaccgcgctttcttggcaaaacgactcggaccgatg

SEQ ID NO: 15761 - DNA, 203 bp, Homo sapiens
ggcgcgccagtcctctcgtacacggggccgcgcgcgcgcgccgcttccgcttaaataacggcgggggaggccgcggtcggtctcagtcgccgctgccagctctcgcactctgttcttccgcctactccccgtcgcgtttctactcccgtcgcaatggatactcccatcgccgcgcttactcccgacaacgactcggaccgatg

SEQ ID NO: 15762 - DNA, 203 bp, Homo sapiens
ggcgcgccagtcctagtcgtacgtgggccgcgcgcgcgcgccgcttccgcttaaataacggcgggggaggccgcggtcggtctcagtcgccgctgccagctctcgcactctgttcttccgccttcttggcaaagcgtttcttcttggcaaacaatggattcttggcaaaccgcgctttcttggcaaaacgactcggaccgatg

SEQ ID NO: 15763 - DNA, 203 bp, Homo sapiens
ggcgcgccagtcctgtacggttctgggccgcgcgcgcgcgccgcttccgcttaaataacggcgggggaggccgcggtcggtctcagtcgccgctgccagctctcttcttggcaaattccgccttcttggcaaagcgtttcttcttggcaaacaatggattcttggcaaaccgcgctttcttggcaaaacgactcggaccgatg

SEQ ID NO: 15764 - DNA, 203 bp, Homo sapiens
ggcgcgccagtcctgtctgaaccggggccgcgcgcgcgcgccgcttccgcttaaataacggcgggggaggccgcggtcggtctcagtcgccgctgccagctcttcactgtaccggccgtgcgtacccgccgtcgcgtttctctgccggtcgcaatggaagaagagatcgccgcgctggtcattgacaacgactcggaccgatg

SEQ ID NO: 15765 - DNA, 203 bp, Homo sapiens
ggcgcgccagtcctacgagaaccggggccgcgcgcgcgcgccgcttccgcttaaataacggcgggggaggccgcggtcggtctcagtcgccgctgccagctcttcactgtaccggccgtgcgtactcgccgtcgcgtttctctgccggtcgcaatggaagaagagatcgccgcgctggtcattgacaacgactcggaccgatg

SEQ ID NO: 15766 - DNA, 203 bp, Homo sapiens
ggcgcgccagtcctgtgaaccgcggggccgcgcgcgcgcgccgcttccgcttaaataacggcgggggaggccgcggtcggtctcagtcgccgctgccagctggaagctgcccggcgggtcatgggaagccgtcgcgtttctctgccggtcgcaatggaagaagagatcgccgcgctggtcattgacaacgactcggaccgatg

SEQ ID NO: 15767 - DNA, 203 bp, Homo sapiens
ggcgcgccagtcctgagccgacgcgggccgcgcgcgcgcgccgcttccgcttaaataacggcgggggaggccgcggtcggtctcagtcgccgctgccagtgcccttccgtcaattcctttaagtttcagcgtcgcgtttctctgccggtcgcaatggaagaagagatcgccgcgctggtcattgacaacgactcggaccgatg

SEQ ID NO: 15768 - DNA, 203 bp, Homo sapiens
ggcgcgccagtcctagccgacgttgggccgcgcgcgcgcgccgcttccgcttaaataacggcgggggaggccgcggtcggtctcagtcgccgctgccataatgaaaacattcttggcaaatgctttcgctgtcgcgtttctctgccggtcgcaatggaagaagagatcgccgcgctggtcattgacaacgactcggaccgatg

SEQ ID NO: 15769 - DNA, 203 bp, Homo sapiens
ggcgcgccagtcctagtgccgaaggggccgcgcgcgcgcgccgcttccgcttaaataacggcgggggaggccgcggtcggtctcagtcgccgctgccgcagtttcactgtaccggccgtgcgtactcagactcgcgtttctctgccggtcgcaatggaagaagagatcgccgcgctggtcattgacaacgactcggaccgatg

SEQ ID NO: 15770 - DNA, 203 bp, Homo sapiens
ggcgcgccagtccttttcgccgaagggccgcgcgcgcgcgccgcttccgcttaaataacggcgggggaggccgcggtcggtctcagtcgccgctgcctcccggaagctgcccggcgggtcatgggaataactcgcgtttctctgccggtcgcaatggaagaagagatcgccgcgctggtcattgacaacgactcggaccgatg

SEQ ID NO: 15771 - DNA, 203 bp, Homo sapiens
ggcgcgccagtcctagccgattgagggccgcgcgcgcgcgccgcttccgcttaaataacggcgggggaggccgcggtcggtctcagtcgccgctgccttaatgaaaacattcttggcaaatgctttcgctctcgcgtttctctgccggtcgcaatggaagaagagatcgccgcgctggtcattgacaacgactcggaccgatg

SEQ ID NO: 15772 - DNA, 203 bp, Homo sapiens
ggcgcgccagtcctacgtgccgaagggccgcgcgcgcgcgccgcttccgcttaaataacggcgggggaggccgcggtcggtctcagtcgccgctgcgcaccaccacccacggaatcgagaaagagctatcaacgcgtttctctgccggtcgcaatggaagaagagatcgccgcgctggtcattgacaacgactcggaccgatg

SEQ ID NO: 15773 - DNA, 203 bp, Homo sapiens
ggcgcgccagtccttcgccgagtggggccgcgcgcgcgcgccgcttccgcttaaataacggcgggggaggccgcggtcggtctcagtcgccgctgctggtgcccttccgtcaattcctttaagtttcagcttcgcgtttctctgccggtcgcaatggaagaagagatcgccgcgctggtcattgacaacgactcggaccgatg

SEQ ID NO: 15774 - DNA, 203 bp, Homo sapiens
ggcgcgccagtccttgtcagccgagggccgcgcgcgcgcgccgcttccgcttaaataacggcgggggaggccgcggtcggtctcagtcgccgctgcttcccggaagctgcccggcgggtcatgggaataacgcgcgtttctctgccggtcgcaatggaagaagagatcgccgcgctggtcattgacaacgactcggaccgatg

SEQ ID NO: 15775 - DNA, 203 bp, Homo sapiens
ggcgcgccagtcctgccgagttcggggccgcgcgcgcgcgccgcttccgcttaaataacggcgggggaggccgcggtcggtctcagtcgccgctggattaatgaaaacattcttggcaaatgctttcgctctggcgtttctctgccggtcgcaatggaagaagagatcgccgcgctggtcattgacaacgactcggaccgatg

SEQ ID NO: 15776 - DNA, 203 bp, Homo sapiens
ggcgcgccagtcctttagccgactgggccgcgcgcgcgcgccgcttccgcttaaataacggcgggggaggccgcggtcggtctcagtcgccgctggtggtgcccttccgtcaattcctttaagtttcagctttgcatttctctgccggtcgcaatggaagaagagatcgccgcgctggtcattgacaacgactcggaccgatg

SEQ ID NO: 15777 - DNA, 203 bp, Homo sapiens
ggcgcgccagtcctgccgaatagggggccgcgcgcgcgcgccgcttccgcttaaataacggcgggggaggccgcggtcggtctcagtcgccgctttcgcagtttcactgtaccggccgtgcgtactcagacatgcgtttctctgccggtcgcaatggaagaagagatcgccgcgctggtcattgacaacgactcggaccgatg

SEQ ID NO: 15778 - DNA, 203 bp, Homo sapiens
ggcgcgccagtcctgaaagccgatgggccgcgcgcgcgcgccgcttccgcttaaataacggcgggggaggccgcggtcggtctcagtcgccgtggtttcccggaagctgcccggcgggtcatgggaataacgccgctttctctgccggtcgcaatggaagaagagatcgccgcgctggtcattgacaacgactcggaccgatg

SEQ ID NO: 15779 - DNA, 203 bp, Homo sapiens
ggcgcgccagtcctgccgatcagtgggccgcgcgcgcgcgccgcttccgcttaaataacggcgggggaggccgcggtcggtctcagtcgcctcttgattaatgaaaacattcttggcaaatgctttcgctctggtccttctctgccggtcgcaatggaagaagagatcgccgcgctggtcattgacaacgactcggaccgatg

SEQ ID NO: 15780 - DNA, 203 bp, Homo sapiens
ggcgcgccagtccttgccgaaaatgggccgcgcgcgcgcgccgcttccgcttaaataacggcgggggaggccgcggtcggtctcagtcgcggccatgcaccaccacccacggaatcgagaaagagctatcaatctgtcactctgccggtcgcaatggaagaagagatcgccgcgctggtcattgacaacgactcggaccgatg

SEQ ID NO: 15781 - DNA, 203 bp, Homo sapiens
ggcgcgccagtccttcggcagagtgggccgcgcgcgcgcgccgcttccgcttaaataacggcgggggaggccgcggtcggtctcagtcgctttggtttcccggaagctgcccggcgggtcatgggaataacgccgccgtctctgccggtcgcaatggaagaagagatcgccgcgctggtcattgacaacgactcggaccgatg

SEQ ID NO: 15782 - DNA, 203 bp, Homo sapiens
ggcgcgccagtcctgtcggcatacgggccgcgcgcgcgcgccgcttccgcttaaataacggcgggggaggccgcggtcggtctcagtttgccaagaaagctctctttgccaagaattccgcctttgccaagaagcgtttctttgccaagaacaatggatttgccaagaaccgcgctggtcattgacaacgactcggaccgatg

SEQ ID NO: 15783 - DNA, 203 bp, Homo sapiens
ggcgcgccagtcctaagtcggcatgggccgcgcgcgcgcgccgcttccgcttaaataacggcgggggaggccgcggtcggtctcttcctttaagtttcagctttgcaaccatactccccccggaacccaaagactttggtttccccggtcgcaatggaagaagagatcgccgcgctggtcattgacaacgactcggaccgatg

SEQ ID NO: 15784 - DNA, 203 bp, Homo sapiens
ggcgcgccagtcctgtcggctacggggccgcgcgcgcgcgccgcttccgcttaaataacggcgggggaggccgcggtcgtgatttaatgagccattcgcagtttcactgtaccggccgtgcgtactcagacatgcatggcttaatctttcgcaatggaagaagagatcgccgcgctggtcattgacaacgactcggaccgatg

SEQ ID NO: 15785 - DNA, 203 bp, Homo sapiens
ggcgcgccagtcctacacctcggcgggccgcgcgcgcgcgccgcttccgcttaaataacggcgggggaggccgcggtggaacccaaagactttggtttcccggaagctgcccggcgggtcatgggaataacgccgccgcatcgccggtcggcaatggaagaagagatcgccgcgctggtcattgacaacgactcggaccgatg

SEQ ID NO: 15786 - DNA, 203 bp, Homo sapiens
ggcgcgccagtccttgggctcggcgggccgcgcgcgcgcgccgcttccgcttaaataacggcgggggaggccgtaagccgcaggctccactcctggtggtgcccttccgtcaattcctttaagtttcagctttgcaaccatactccccccggaacggaagaagagatcgccgcgctggtcattgacaacgactcggaccgatg

SEQ ID NO: 15787 - DNA, 203 bp, Homo sapiens
ggcgcgccagtccttatcggcaaggggccgcgcgcgcgcgccgcttccgcttaaataacggcgggggaggcgcccttccgtcaattcctttaagtttcagctttgcaaccatactccccccggaacccaaagactttggtttcccggaagctgcccgaagaagagatcgccgcgctggtcattgacaacgactcggaccgatg

SEQ ID NO: 15788 - DNA, 203 bp, Homo sapiens
ggcgcgccagtcctgcttcggcacgggccgcgcgcgcgcgccgcttccgcttaaataacggcgggggaggcttcgaacctccgactttcgttcttgattaatgaaaacattcttggcaaatgctttcgctctggtccgtcttgcgccggtccaagaatagaagagatcgccgcgctggtcattgacaacgactcggaccgatg

SEQ ID NO: 15789 - DNA, 203 bp, Homo sapiens
ggcgcgccagtcctcccgctaccggggccgcgcgcgcgcgccgcttccgcttaaataacggcgggggtggtgcccttccgtcaattcctttaagtttcagctttgcaaccatactccccccggaacccaaagactttggtttcccggaagctgcccggcggagagatcgccgcgctggtcattgacaacgactcggaccgatg

SEQ ID NO: 15790 - DNA, 203 bp, Homo sapiens
ggcgcgccagtcctcacacccttagggccgcgcgcgcgcgccgcttccgcttaaataacggcgggggtggtgcccttccgtcaattcctttaagtttcagctttgcaaccatactccccccggaacccaaagactttggtttcccggaagctgcccggcgggtagatcgccgcgctggtcattgacaacgactcggaccgatg

SEQ ID NO: 15791 - DNA, 203 bp, Homo sapiens
ggcgcgccagtcctaaagcccgttgggccgcgcgcgcgcgccgcttccgcttaaataacggcgtgagtcaaattaagccgcaggctccactcctggtggtgcccttccgtcaattcctttaagtttcagctttgcaaccatactccccccggaacccaaagacttatcgccgcgctggtcattgacaacgactcggaccgatg

SEQ ID NO: 15792 - DNA, 203 bp, Homo sapiens
ggcgcgccagtcctgttcgggcttgggccgcgcgcgcgcgccgcttccgcttaaataacgggaccaaaggaaccataactgatttaatgagccattcgcagtttcactgtaccggccgtgcgtactcagacatgcatggcttaatctttgagacaagcatatgctaccgccgcgctggtcattgacaacgactcggaccgatg

SEQ ID NO: 15793 - DNA, 203 bp, Homo sapiens
ggcgcgccagtcctctttctcgcggggccgcgcgcgcgcgccgcttccgcttaaataacgtgttgagtcaaattaagccgcaggctccactcctggtggtgcccttccgtcaattcctttaagtttcagctttgcaaccatactccccccggaacccaaagactttggttcgcgctggtcattgacaacgactcggaccgatg

SEQ ID NO: 15794 - DNA, 203 bp, Homo sapiens
ggcgcgccagtcctcacctcgcgggggccgcgcgcgcgcgccgcttccgcttaaataactgcaaccatactccccccggaacccaaagactttggtttcccggaagctgcccggcgggtcatgggaataacgccgccgcatcgccggtcggcatcgtttatggtcggaaccgcgctggtcattgacaacgactcggaccgatg

SEQ ID NO: 15795 - DNA, 203 bp, Homo sapiens
ggcgcgccagtcctgaccgcgagagggccgcgcgcgcgcgccgcttccgcttaaataccactcctggtggtgcccttccgtcaattcctttaagtttcagctttgcaaccatactccccccggaacccaaagactttggtttcccggaagctgcccggcgggtcatgggaagcgctggtcattgacaacgactcggaccgatg

SEQ ID NO: 15796 - DNA, 203 bp, Homo sapiens
ggcgcgccagtcctacgcgagtgagggccgcgcgcgcgcgccgcttccgcttaaataccgtgttgagtcaaattaagccgcaggctccactcctggtggtgcccttccgtcaattcctttaagtttcagctttgcaaccatactccccccggaacccaaagactttggtttgcgctggtcattgacaacgactcggaccgatg

SEQ ID NO: 15797 - DNA, 203 bp, Homo sapiens
ggcgcgccagtcctacgcgagaacgggccgcgcgcgcgcgccgcttccgcttaaatagagcgaccaaaggaaccataactgatttaatgagccattcgcagtttcactgtaccggccgtgcgtactcagacatgcatggcttaatctttgagacaagcatatgctactggcgcgctggtcattgacaacgactcggaccgatg

SEQ ID NO: 15798 - DNA, 203 bp, Homo sapiens
ggcgcgccagtcctgacacaccatgggccgcgcgcgcgcgccgcttccgcttaaatcccgtgttgagtcaaattaagccgcaggctccactcctggtggtgcccttccgtcaattcctttaagtttcagctttgcaaccatactccccccggaacccaaagactttggtttccgctggtcattgacaacgactcggaccgatg

SEQ ID NO: 15799 - DNA, 203 bp, Homo sapiens
ggcgcgccagtcctgtgtcagtaggggccgcgcgcgcgcgccgcttccgcttaaatcgagcgaccaaaggaaccataactgatttaatgagccattcgcagtttcactgtaccggccgtgcgtactcagacatgcatggcttaatctttgagacaagcatatgctactggcacgctggtcattgacaacgactcggaccgatg

SEQ ID NO: 15800 - DNA, 203 bp, Homo sapiens
ggcgcgccagtcctacaggtgtcagggccgcgcgcgcgcgccgcttccgcttaagacggtatctgatcgtcttcgaacctccgactttcgttcttgattaatgaaaacattcttggcaaatgctttcgctctggtccgtcttgcgccggtccaagaatttcacctctagcggcgctggtcattgacaacgactcggaccgatg

SEQ ID NO: 15801 - DNA, 203 bp, Homo sapiens
ggcgcgccagtccttgtgtcaccggggccgcgcgcgcgcgccgcttccgcttacagctttgcaaccatactccccccggaacccaaagactttggtttcccggaagctgcccggcgggtcatgggaataacgccgccgcatcgccggtcggcatcgtttatggtcggaactacgatggtcattgacaacgactcggaccgatg

SEQ ID NO: 15802 - DNA, 203 bp, Homo sapiens
ggcgcgccagtcctttgacaccacgggccgcgcgcgcgcgccgcttccgcttacgacggtatctgatcgtcttcgaacctccgactttcgttcttgattaatgaaaacattcttggcaaatgctttcgctctggtccgtcttgcgccggtccaagaatttcacctctagcggcgctggtcattgacaacgactcggaccgatg

SEQ ID NO: 15803 - DNA, 203 bp, Homo sapiens
ggcgcgccagtcctatgacactgcgggccgcgcgcgcgcgccgcttccgcttagagcgagcgaccaaaggaaccataactgatttaatgagccattcgcagtttcactgtaccggccgtgcgtactcagacatgcatggcttaatctttgagacaagcatatgctactggcaggatggtcattgacaacgactcggaccgatg

SEQ ID NO: 15804 - DNA, 203 bp, Homo sapiens
ggcgcgccagtcctgcgcaggacggggccgcgcgcgcgcgccgcttccggaggtttcccgtgttgagtcaaattaagccgcaggctccactcctggtggtgcccttccgtcaattcctttaagtttcagctttgcaaccatactccccccggaacccaaagactttggtttcccggaagcattgacaacgactcggaccgatg

SEQ ID NO: 15805 - DNA, 203 bp, Homo sapiens
ggcgcgccagtcctagcgcaggccgggccgcgcgcgcgcgccgcttcctgaggtttcccgtgttgagtcaaattaagccgcaggctccactcctggtggtgcccttccgtcaattcctttaagtttcagctttgcaaccatactccccccggaacccaaagactttggtttcccggaagcattgacaacgactcggaccgatg

SEQ ID NO: 15806 - DNA, 203 bp, Homo sapiens
ggcgcgccagtcctattctgcgccgggccgcgcgcgcgcgccgcttcgtgaggtttcccgtgttgagtcaaattaagccgcaggctccactcctggtggtgcccttccgtcaattcctttaagtttcagctttgcaaccatactccccccggaacccaaagactttggtttcccggaagctttgacaacgactcggaccgatg

SEQ ID NO: 15807 - DNA, 203 bp, Homo sapiens
ggcgcgccagtccttatgctgcgcgggccgcgcgcgcgcgccgcttggtgaggtttcccgtgttgagtcaaattaagccgcaggctccactcctggtggtgcccttccgtcaattcctttaagtttcagctttgcaaccatactccccccggaacccaaagactttggtttcccggaagctgtgacaacgactcggaccgatg

SEQ ID NO: 15808 - DNA, 203 bp, Homo sapiens
ggcgcgccagtcctccagtgggtggggccgcgcgtcaattcctttaccgccgtcaattcctttagggacgtcaattcctttatcagcgtcaattcctttatctccgtcaattcctttacgcccgtcaattcctttatttccgtcaattcctttatggacgtcaattcctttacgctggtcattgacaacgactcggaccgatg

SEQ ID NO: 15809 - DNA, 203 bp, Homo sapiens
ggcgcgccagtcctaagtgggtcagggccgcgtactcccgccgcttccgctactcccacggcgggggatactcccgtcggtctcagtactccctgccagctctctactcccgttcttccgcctactccccgtcgcgtttctactcccgtcgcaatggatactcccatcgccgcgcttactcccgacaacgactcggaccgatg

SEQ ID NO: 15810 - DNA, 203 bp, Homo sapiens
ggcgcgccagtcctcccactgcgtgttgtgttagttgtgttagtgtaggagaggagcgagcgaccaaaggaaccataactgatttaatgagccattcgcagtttcactgtaccggccgtgcgtactcagacatgcatggcttaatctttgagacaagcatatgctactggcaggatcaaccaggtagtcgactcggaccgatg

SEQ ID NO: 15811 - DNA, 203 bp, Homo sapiens
ggcgcgccagtcctcgatagtggggttgtgttagttgtgttagttaagccgcaggctccactcctggtggtgcccttccgtcaattcctttaagtttcagctttgcaaccatactccccccggaacccaaagactttggtttcccggaagctgcccggcgggtcatgggaataacgccgccgcatagtcgactcggaccgatg

SEQ ID NO: 15812 - DNA, 203 bp, Homo sapiens
ggcgcgccagtcctcgggcccactgttgtgttagttgtgttagttaagccgcaggctccactcctggtggtgcccttccgtcaattcctttaagtttcagctttgcaaccatactccccccggaacccaaagactttggtttcccggaagctgcccggcgggtcatgggaataacgccgccgcttagtcgactcggaccgatg

SEQ ID NO: 15813 - DNA, 203 bp, Homo sapiens
ggcgcgccagtcctaagcccacttgttgtgttagttgtgttagttcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaattagtcgactcggaccgatg

SEQ ID NO: 15814 - DNA, 203 bp, Homo sapiens
ggcgcgccagtcctagtgggacttgttgtgttagttgtgttagttgggaactacgacggtatctgatcgtcttcgaacctccgactttcgttcttgattaatgaaaacattcttggcaaatgctttcgctctggtccgtcttgcgccggtccaagaatttcacctctagcggcgcaatacgagttagtcgactcggaccgatg

SEQ ID NO: 15815 - DNA, 203 bp, Homo sapiens
ggcgcgccagtcctacgcgctgacgttgtgttagttgtgttagttgtaagtttcagctttgcaaccatactccccccggaacccaaagactttggtttcccggaagctgcccggcgggtcatgggaataacgccgccgcatcgccggtcggcatcgtttatggtcggaactacgacggtatcgttagtcgactcggaccgatg

SEQ ID NO: 15816 - DNA, 203 bp, Homo sapiens
ggcgcgccagtccttcgccctagagttgtgttagttgtgttagttgtgccgcaggctccactcctggtggtgcccttccgtcaattcctttaagtttcagctttgcaaccatactccccccggaacccaaagactttggtttcccggaagctgcccggcgggtcatgggaataacgccgcgtgttagtcgactcggaccgatg

SEQ ID NO: 15817 - DNA, 203 bp, Homo sapiens
ggcgcgccagtcctaccggtgctagttgtgttagttgtgttagttgtgtgtttcagctttgcaaccatactccccccggaacccaaagactttggtttcccggaagctgcccggcgggtcatgggaataacgccgccgcatcgccggtcggcatcgtttatggtcggaactacgacggttgtgttagtcgactcggaccgatg

SEQ ID NO: 15818 - DNA, 203 bp, Homo sapiens
ggcgcgccagtccttcgtgcgtcagttgtgttagttgtgttagttgtgttagacgacggtatctgatcgtcttcgaacctccgactttcgttcttgattaatgaaaacattcttggcaaatgctttcgctctggtccgtcttgcgccggtccaagaatttcacctctagcggcgcaagttgtgttagtcgactcggaccgatg

SEQ ID NO: 15819 - DNA, 203 bp, Homo sapiens
ggcgcgccagtccttgcgtcacgagttgtgttagttgtgttagttgtgttagggagcgagcgaccaaaggaaccataactgatttaatgagccattcgcagtttcactgtaccggccgtgcgtactcagacatgcatggcttaatctttgagacaagcatatgctactggcaggatagttgtgttagtcgactcggaccgatg

SEQ ID NO: 15820 - DNA, 203 bp, Homo sapiens
ggcgcgccagtcctgcgtgacgctgttgtgttagttgtgttagttgtgttagtcagctttgcaaccatactccccccggaacccaaagactttggtttcccggaagctgcccggcgggtcatgggaataacgccgccgcatcgccggtcggcatcgtttatggtcggaactacgatagttgtgttagtcgactcggaccgatg

SEQ ID NO: 15821 - DNA, 203 bp, Homo sapiens
ggcgcgccagtcctcaagcgtcacgttgtgttagttgtgttagttgtgttagtcgacggtatctgatcgtcttcgaacctccgactttcgttcttgattaatgaaaacattcttggcaaatgctttcgctctggtccgtcttgcgccggtccaagaatttcacctctagcggcgctagttgtgttagtcgactcggaccgatg

SEQ ID NO: 15822 - DNA, 203 bp, Homo sapiens
ggcgcgccagtcctgtgacgcagagttgtgttagttgtgttagttgtgttagttgaattaaccagacaaatcgctccaccaactaagaacggccatgcaccaccacccacggaatcgagaaagagctatcaatctgtcaatcctgtccgtgtccgggccgggtgaggtttcccgttagttgtgttagtcgactcggaccgatg

SEQ ID NO: 15823 - DNA, 203 bp, Homo sapiens
ggcgcgccagtcctctctcgcgttgttgtgttagttgtgttagttgtgttagttggctttgcaaccatactccccccggaacccaaagactttggtttcccggaagctgcccggcgggtcatgggaataacgccgccgcatcgccggtcggcatcgtttatggtcggaactacgttagttgtgttagtcgactcggaccgatg

SEQ ID NO: 15824 - DNA, 203 bp, Homo sapiens
ggcgcgccagtccttctaacgcgggttgtgttagttgtgttagttgtgttagttgtcgagcgaccaaaggaaccataactgatttaatgagccattcgcagtttcactgtaccggccgtgcgtactcagacatgcatggcttaatctttgagacaagcatatgctactggcatgttagttgtgttagtcgactcggaccgatg

SEQ ID NO: 15825 - DNA, 203 bp, Homo sapiens
ggcgcgccagtccttaacgcgagtgttgtgttagttgtgttagttgtgttagttgtctttgcaaccatactccccccggaacccaaagactttggtttcccggaagctgcccggcgggtcatgggaataacgccgccgcatcgccggtcggcatcgtttatggtcggaactatgttagttgtgttagtcgactcggaccgatg

SEQ ID NO: 15826 - DNA, 203 bp, Homo sapiens
ggcgcgccagtcctcgcaacgcgggttgtgttagttgtgttagttgtgttagttgtgccactcctggtggtgcccttccgtcaattcctttaagtttcagctttgcaaccatactccccccggaacccaaagactttggtttcccggaagctgcccggcgggtcatgggaagtgttagttgtgttagtcgactcggaccgatg

SEQ ID NO: 15827 - DNA, 203 bp, Homo sapiens
ggcgcgccagtccttcaacgcgcagttgtgttagttgtgttagttgtgttagttgtgccgtgttgagtcaaattaagccgcaggctccactcctggtggtgcccttccgtcaattcctttaagtttcagctttgcaaccatactccccccggaacccaaagactttggtttgtgttagttgtgttagtcgactcggaccgatg

SEQ ID NO: 15828 - DNA, 203 bp, Homo sapiens
ggcgcgccagtccttggcgcaggagttgtgttagttgtgttagttgtgttagttgtgttaaccagacaaatcgctccaccaactaagaacggccatgcaccaccacccacggaatcgagaaagagctatcaatctgtcaatcctgtccgtgtccgggccgggtgaggtttcgtgttagttgtgttagtcgactcggaccgatg

SEQ ID NO: 15829 - DNA, 203 bp, Homo sapiens
ggcgcgccagtccttggcgcgttagttgtgttagttgtgttagttgtgttagttgtgttaaccagacaaatcgctccaccaactaagaacggccatgcaccaccacccacggaatcgagaaagagctatcaatctgtcaatcctgtccgtgtccgggccgggtgaggttttgtgttagttgtgttagtcgactcggaccgatg

SEQ ID NO: 15830 - DNA, 203 bp, Homo sapiens
ggcgcgccagtccttgtgccacgtgttgtgttagttgtgttagttgtgttagttgtgttaatctgatcgtcttcgaacctccgactttcgttcttgattaatgaaaacattcttggcaaatgctttcgctctggtccgtcttgcgccggtccaagaatttcacctctagttgtgttagttgtgttagtcgactcggaccgatg

SEQ ID NO: 15831 - DNA, 203 bp, Homo sapiens
ggcgcgccagtcctgtatgccaccgttgtgttagttgtgttagttgtgttagttgtgttacgaccaaaggaaccataactgatttaatgagccattcgcagtttcactgtaccggccgtgcgtactcagacatgcatggcttaatctttgagacaagcatatgctactgttgtgttagttgtgttagtcgactcggaccgatg

SEQ ID NO: 15832 - DNA, 203 bp, Homo sapiens
ggcgcgccagtcctgaagtggctcgttgtgttagttgtgttagttgtgttagttgtgttagcaaccatactccccccggaacccaaagactttggtttcccggaagctgcccggcgggtcatgggaataacgccgccgcatcgccggtcggcatcgtttatggtcggagttgtgttagttgtgttagtcgactcggaccgatg

SEQ ID NO: 15833 - DNA, 203 bp, Homo sapiens
ggcgcgccagtcctgccaccatttgttgtgttagttgtgttagttgtgttagttgtgttagtcagacaaatcgctccaccaactaagaacggccatgcaccaccacccacggaatcgagaaagagctatcaatctgtcaatcctgtccgtgtccgggccgggtgagtagttgtgttagttgtgttagtcgactcggaccgatg

SEQ ID NO: 15834 - DNA, 203 bp, Homo sapiens
ggcgcgccagtcctagccacgccggttgtgttagttgtgttagttgtgttagttgtgttagtcctggtggtgcccttccgtcaattcctttaagtttcagctttgcaaccatactccccccggaacccaaagactttggtttcccggaagctgcccggcgggtcattagttgtgttagttgtgttagtcgactcggaccgatg

SEQ ID NO: 15835 - DNA, 203 bp, Homo sapiens
ggcgcgccagtcctagtggcattcgttgtgttagttgtgttagttgtgttagttgtgttagttagacaaatcgctccaccaactaagaacggccatgcaccaccacccacggaatcgagaaagagctatcaatctgtcaatcctgtccgtgtccgggccgggtgattagttgtgttagttgtgttagtcgactcggaccgatg

SEQ ID NO: 15836 - DNA, 203 bp, Homo sapiens
ggcgcgccagtcctaagtggccctgttgtgttagttgtgttagttgtgttagttgtgttagttgcaaaggaaccataactgatttaatgagccattcgcagtttcactgtaccggccgtgcgtactcagacatgcatggcttaatctttgagacaagcatatgcgttagttgtgttagttgtgttagtcgactcggaccgatg

SEQ ID NO: 15837 - DNA, 203 bp, Homo sapiens
ggcgcgccagtcctggtggccctagttgtgttagttgtgttagttgtgttagttgtgttagttggacaaatcgctccaccaactaagaacggccatgcaccaccacccacggaatcgagaaagagctatcaatctgtcaatcctgtccgtgtccgggccgggtggttagttgtgttagttgtgttagtcgactcggaccgatg

SEQ ID NO: 15838 - DNA, 203 bp, Homo sapiens
ggcgcgccagtcctgggccaccttgttgtgttagttgtgttagttgtgttagttgtgttagttgtgatactccccccggaacccaaagactttggtttcccggaagctgcccggcgggtcatgggaataacgccgccgcatcgccggtcggcatcgtttatggtgttagttgtgttagttgtgttagtcgactcggaccgatg

SEQ ID NO: 15839 - DNA, 203 bp, Homo sapiens
ggcgcgccagtcctcctagccactgttgtgttagttgtgttagttgtgttagttgtgttagttgtggtggtgcccttccgtcaattcctttaagtttcagctttgcaaccatactccccccggaacccaaagactttggtttcccggaagctgcccggcgggttgttagttgtgttagttgtgttagtcgactcggaccgatg

SEQ ID NO: 15840 - DNA, 203 bp, Homo sapiens
ggcgcgccagtcctgtggcacttcgttgtgttagttgtgttagttgtgttagttgtgttagttgtgtaggaaccataactgatttaatgagccattcgcagtttcactgtaccggccgtgcgtactcagacatgcatggcttaatctttgagacaagcatatgtgttagttgtgttagttgtgttagtcgactcggaccgatg

SEQ ID NO: 15841 - DNA, 203 bp, Homo sapiens
ggcgcgccagtcctccagtggcccgttgtgttagttgtgttagttgtgttagttgtgttagttgtgtcgtcttcgaacctccgactttcgttcttgattaatgaaaacattcttggcaaatgctttcgctctggtccgtcttgcgccggtccaagaatttcagtgttagttgtgttagttgtgttagtcgactcggaccgatg

SEQ ID NO: 15842 - DNA, 203 bp, Homo sapiens
ggcgcgccagtcctatcgtggcaggttgtgttagttgtgttagttgtgttagttgtgttagttgtgttaatcgctccaccaactaagaacggccatgcaccaccacccacggaatcgagaaagagctatcaatctgtcaatcctgtccgtgtccgggccgttgtgttagttgtgttagttgtgttagtcgactcggaccgatg

SEQ ID NO: 15843 - DNA, 203 bp, Homo sapiens
ggcgcgccagtcctaccgagtggcgttgtgttagttgtgttagttgtgttagttgtgttagttgtgttaccggccgtagttgtgttaccggccgtagttgtgttaccggccgtagttgtgttaccggccgtagttgtgttaccggccgtagttgtgttaccggccgtagttgtgttaccggccgtagtcgactcggaccgatg

SEQ ID NO: 15844 - DNA, 203 bp, Homo sapiens
ggcgcgccagtcctccttagtggcgttgtgttagttgtgttagttgtgttagttgtgttagttgtgttagaaccataactgatttaatgagccattcgcagtttcactgtaccggccgtgcgtactcagacatgcatggcttaatctttgagacaagcagttgtgttagttgtgttagttgtgttagtcgactcggaccgatg

SEQ ID NO: 15845 - DNA, 203 bp, Homo sapiens
ggcgcgccagtcctgcagtgccacgttgtgttagttgtgttagttgtgttagttgtgttagttgtgttagtattaagccgcaggctccactcctggtggtgcccttccgtcaattcctttaagtttcagctttgcaaccatactccccccggaaccctagttgtgttagttgtgttagttgtgttagtcgactcggaccgatg

SEQ ID NO: 15846 - DNA, 203 bp, Homo sapiens
ggcgcgccagtcctcgaagtggccgttgtgttagttgtgttagttgtgttagttgtgttagttgtgttagtccccccggaacccaaagactttggtttcccggaagctgcccggcgggtcatgggaataacgccgccgcatcgccggtcggcatcgttagttgtgttagttgtgttagttgtgttagtcgactcggaccgatg

SEQ ID NO: 15847 - DNA, 203 bp, Homo sapiens
ggcgcgccagtccttacccgtggcgttgtgttagttgtgttagttgtgttagttgtgttagttgtgttagtgcccttccgtcaattcctttaagtttcagctttgcaaccatactccccccggaacccaaagactttggtttcccggaagctgcccggagttgtgttagttgtgttagttgtgttagtcgactcggaccgatg

SEQ ID NO: 15848 - DNA, 203 bp, Homo sapiens
ggcgcgccagtccttttacgtggcgttgtgttagttgtgttagttgtgttagttgtgttagttgtgttagtgcccttccgtcaattcctttaagtttcagctttgcaaccatactccccccggaacccaaagactttggtttcccggaagctgcccgtagttgtgttagttgtgttagttgtgttagtcgactcggaccgatg

SEQ ID NO: 15849 - DNA, 203 bp, Homo sapiens
ggcgcgccagtcctcatgggtggcgttgtgttagttgtgttagttgtgttagttgtgttagttgtgttagttccataactgatttaatgagccattcgcagtttcactgtaccggccgtgcgtactcagacatgcatggcttaatctttgagacaattagttgtgttagttgtgttagttgtgttagtcgactcggaccgatg

SEQ ID NO: 15850 - DNA, 203 bp, Homo sapiens
ggcgcgccagtccttagccaccctgttgtgttagttgtgttagttgtgttagttgtgttagttgtgttagttcccccggaacccaaagactttggtttcccggaagctgcccggcgggtcatgggaataacgccgccgcatcgccggtcggcatcgttagttgtgttagttgtgttagttgtgttagtcgactcggaccgatg

SEQ ID NO: 15851 - DNA, 203 bp, Homo sapiens
ggcgcgccagtccttcgaactacggttgtgttagttgtgttagttgtgttagttgtgttagttgtgttagttcccttccgtcaattcctttaagtttcagctttgcaaccatactccccccggaacccaaagactttggtttcccggaagctgcccttagttgtgttagttgtgttagttgtgttagtcgactcggaccgatg

SEQ ID NO: 15852 - DNA, 203 bp, Homo sapiens
ggcgcgccagtccttcgaacgtttgttgtgttagttgtgttagttgtgttagttgtgttagttgtgttagttgcgaacctccgactttcgttcttgattaatgaaaacattcttggcaaatgctttcgctctggtccgtcttgcgccggtccaaggttagttgtgttagttgtgttagttgtgttagtcgactcggaccgatg

SEQ ID NO: 15853 - DNA, 203 bp, Homo sapiens
ggcgcgccagtccttcgaacctgagttgtgttagttgtgttagttgtgttagttgtgttagttgtgttagttgtaagccgcaggctccactcctggtggtgcccttccgtcaattcctttaagtttcagctttgcaaccatactccccccggaacgttagttgtgttagttgtgttagttgtgttagtcgactcggaccgatg

SEQ ID NO: 15854 - DNA, 203 bp, Homo sapiens
ggcgcgccagtcctctgttcgactgttgtgttagttgtgttagttgtgttagttgtgttagttgtgttagttgtgaacctccgactttcgttcttgattaatgaaaacattcttggcaaatgctttcgctctggtccgtcttgcgccggtccagtgttagttgtgttagttgtgttagttgtgttagtcgactcggaccgatg

SEQ ID NO: 15855 - DNA, 203 bp, Homo sapiens
ggcgcgccagtcctgtccgtcccggttgtgttagttgtgttagttgtgttagttgtgttagttgtgttagttgtgtaactgatttaatgagccattcgcagtttcactgtaccggccgtgcgtactcagacatgcatggcttaatctttgagtgtgttagttgtgttagttgtgttagttgtgttagtcgactcggaccgatg

SEQ ID NO: 15856 - DNA, 203 bp, Homo sapiens
ggcgcgccagtccttgtccggtcggttgtgttagttgtgttagttgtgttagttgtgttagttgtgttagttgtgtacctccgactttcgttcttgattaatgaaaacattcttggcaaatgctttcgctctggtccgtcttgcgccggtcctgtgttagttgtgttagttgtgttagttgtgttagtcgactcggaccgatg

SEQ ID NO: 15857 - DNA, 203 bp, Homo sapiens
ggcgcgccagtcctagctgtccgagttgtgttagttgtgttagttgtgttagttgtgttagttgtgttagttgtgtcggaacccaaagactttggtttcccggaagctgcccggcgggtcatgggaataacgccgccgcatcgccggtcggctgtgttagttgtgttagttgtgttagttgtgttagtcgactcggaccgatg

SEQ ID NO: 15858 - DNA, 203 bp, Homo sapiens
ggcgcgccagtcctaagtccggttgttgtgttagttgtgttagttgtgttagttgtgttagttgtgttagttgtgtgccgcaggctccactcctggtggtgcccttccgtcaattcctttaagtttcagctttgcaaccatactccccccggtgtgttagttgtgttagttgtgttagttgtgttagtcgactcggaccgatg

SEQ ID NO: 15859 - DNA, 203 bp, Homo sapiens
ggcgcgccagtcctcgtccgctaggttgtgttagttgtgttagttgtgttagttgtgttagttgtgttagttgtgttaccaactaagaacggccatgcaccaccacccacggaatcgagaaagagctatcaatctgtcaatcctgtccgtgttgtgttagttgtgttagttgtgttagttgtgttagtcgactcggaccgatg

SEQ ID NO: 15860 - DNA, 203 bp, Homo sapiens
ggcgcgccagtcctggtccgtggcgttgtgttagttgtgttagttgtgttagttgtgttagttgtgttagttgtgttacgcaggctccactcctggtggtgcccttccgtcaattcctttaagtttcagctttgcaaccatactccccccgttgtgttagttgtgttagttgtgttagttgtgttagtcgactcggaccgatg

SEQ ID NO: 15861 - DNA, 203 bp, Homo sapiens
ggcgcgccagtcctgtggtccgccgttgtgttagttgtgttagttgtgttagttgtgttagttgtgttagttgtgttactccgactttcgttcttgattaatgaaaacattcttggcaaatgctttcgctctggtccgtcttgcgccggtgttgtgttagttgtgttagttgtgttagttgtgttagtcgactcggaccgatg

SEQ ID NO: 15862 - DNA, 203 bp, Homo sapiens
ggcgcgccagtcctacagcgtccggttgtgttagttgtgttagttgtgttagttgtgttagttgtgttagttgtgttactgatttaatgagccattcgcagtttcactgtaccggccgtgcgtactcagacatgcatggcttaatctttggttgtgttagttgtgttagttgtgttagttgtgttagtcgactcggaccgatg

SEQ ID NO: 15863 - DNA, 203 bp, Homo sapiens
ggcgcgccagtcctagtccgaaaggttgtgttagttgtgttagttgtgttagttgtgttagttgtgttagttgtgttagaacccaaagactttggtttcccggaagctgcccggcgggtcatgggaataacgccgccgcatcgccggtcagttgtgttagttgtgttagttgtgttagttgtgttagtcgactcggaccgatg

SEQ ID NO: 15864 - DNA, 203 bp, Homo sapiens
ggcgcgccagtcctgcgtccgttggttgtgttagttgtgttagttgtgttagttgtgttagttgtgttagttgtgttaggcaggctccactcctggtggtgcccttccgtcaattcctttaagtttcagctttgcaaccatactcccccagttgtgttagttgtgttagttgtgttagttgtgttagtcgactcggaccgatg

SEQ ID NO: 15865 - DNA, 203 bp, Homo sapiens
ggcgcgccagtccttgtccgagctgttgtgttagttgtgttagttgtgttagttgtgttagttgtgttagttgtgttaggtcaattcctttaagtttcagctttgcaaccatactccccccggaacccaaagactttggtttcccggaaagttgtgttagttgtgttagttgtgttagttgtgttagtcgactcggaccgatg

SEQ ID NO: 15866 - DNA, 203 bp, Homo sapiens
ggcgcgccagtcctttgtccgatagttgtgttagttgtgttagttgtgttagttgtgttagttgtgttagttgtgttagtaactaagaacggccatgcaccaccacccacggaatcgagaaagagctatcaatctgtcaatcctgtcctagttgtgttagttgtgttagttgtgttagttgtgttagtcgactcggaccgatg

SEQ ID NO: 15867 - DNA, 203 bp, Homo sapiens
ggcgcgccagtcctgtccgggacggttgtgttagttgtgttagttgtgttagttgtgttagttgtgttagttgtgttagtacccaaagactttggtttcccggaagctgcccggcgggtcatgggaataacgccgccgcatcgccggttagttgtgttagttgtgttagttgtgttagttgtgttagtcgactcggaccgatg

SEQ ID NO: 15868 - DNA, 203 bp, Homo sapiens
ggcgcgccagtcctacagtccgctgttgtgttagttgtgttagttgtgttagttgtgttagttgtgttagttgtgttagtcaggctccactcctggtggtgcccttccgtcaattcctttaagtttcagctttgcaaccatactcccctagttgtgttagttgtgttagttgtgttagttgtgttagtcgactcggaccgatg

SEQ ID NO: 15869 - DNA, 203 bp, Homo sapiens
ggcgcgccagtcctccgtccgggagttgtgttagttgtgttagttgtgttagttgtgttagttgtgttagttgtgttagtccgactttcgttcttgattaatgaaaacattcttggcaaatgctttcgctctggtccgtcttgcgccggagttgtgttagttgtgttagttgtgttagttgtgttagtcgactcggaccgatg

SEQ ID NO: 15870 - DNA, 203 bp, Homo sapiens
ggcgcgccagtcctcaattgtccggttgtgttagttgtgttagttgtgttagttgtgttagttgtgttagttgtgttagtgatttaatgagccattcgcagtttcactgtaccggccgtgcgtactcagacatgcatggcttaatctttagttgtgttagttgtgttagttgtgttagttgtgttagtcgactcggaccgatg

SEQ ID NO: 15871 - DNA, 203 bp, Homo sapiens
ggcgcgccagtcctgcagtccgtggttgtgttagttgtgttagttgtgttagttgtgttagttgtgttagttgtgttagttactaagaacggccatgcaccaccacccacggaatcgagaaagagctatcaatctgtcaatcctgtcttagttgtgttagttgtgttagttgtgttagttgtgttagtcgactcggaccgatg

SEQ ID NO: 15872 - DNA, 203 bp, Homo sapiens
ggcgcgccagtcctgagagtccgtgttgtgttagttgtgttagttgtgttagttgtgttagttgtgttagttgtgttagttaggctccactcctggtggtgcccttccgtcaattcctttaagtttcagctttgcaaccatactcccttagttgtgttagttgtgttagttgtgttagttgtgttagtcgactcggaccgatg

SEQ ID NO: 15873 - DNA, 203 bp, Homo sapiens
ggcgcgccagtcctgacgtccgcagttgtgttagttgtgttagttgtgttagttgtgttagttgtgttagttgtgttagttcaattcctttaagtttcagctttgcaaccatactccccccggaacccaaagactttggtttcccggttagttgtgttagttgtgttagttgtgttagttgtgttagtcgactcggaccgatg

SEQ ID NO: 15874 - DNA, 203 bp, Homo sapiens
ggcgcgccagtcctgtgttgtccggttgtgttagttgtgttagttgtgttagttgtgttagttgtgttagttgtgttagttgggctccactcctggtggtgcccttccgtcaattcctttaagtttcagctttgcaaccatactccgttagttgtgttagttgtgttagttgtgttagttgtgttagtcgactcggaccgatg

SEQ ID NO: 15875 - DNA, 203 bp, Homo sapiens
ggcgcgccagtcctgtccgaggctgttgtgttagttgtgttagttgtgttagttgtgttagttgtgttagttgtgttagttgtattcctttaagtttcagctttgcaaccatactccccccggaacccaaagactttggtttccctgttagttgtgttagttgtgttagttgtgttagttgtgttagtcgactcggaccgatg

SEQ ID NO: 15876 - DNA, 203 bp, Homo sapiens
ggcgcgccagtccttacggacccggttgtgttagttgtgttagttgtgttagttgtgttagttgtgttagttgtgttagttgtgaagaacggccatgcaccaccacccacggaatcgagaaagagctatcaatctgtcaatcctgtgttagttgtgttagttgtgttagttgtgttagttgtgttagtcgactcggaccgatg

SEQ ID NO: 15877 - DNA, 203 bp, Homo sapiens
ggcgcgccagtcctacggacaggggttgtgttagttgtgttagttgtgttagttgtgttagttgtgttagttgtgttagttgtgctccactcctggtggtgcccttccgtcaattcctttaagtttcagctttgcaaccatactctgttagttgtgttagttgtgttagttgtgttagttgtgttagtcgactcggaccgatg

SEQ ID NO: 15878 - DNA, 203 bp, Homo sapiens
ggcgcgccagtcctagctacggacgttgtgttagttgtgttagttgtgttagttgtgttagttgtgttagttgtgttagttgtgctccactcctggtggtgcccttccgtcaattcctttaagtttcagctttgcaaccatactgtgttagttgtgttagttgtgttagttgtgttagttgtgttagtcgactcggaccgatg

SEQ ID NO: 15879 - DNA, 203 bp, Homo sapiens
ggcgcgccagtcctcggactaaccgttgtgttagttgtgttagttgtgttagttgtgttagttgtgttagttgtgttagttgtgctttcgttcttgattaatgaaaacattcttggcaaatgctttcgctctggtccgtcttgcgtgttagttgtgttagttgtgttagttgtgttagttgtgttagtcgactcggaccgatg

SEQ ID NO: 15880 - DNA, 203 bp, Homo sapiens
ggcgcgccagtcctacggaccacggttgtgttagttgtgttagttgtgttagttgtgttagttgtgttagttgtgttagttgtgtaagactttggtttcccggaagctgcccggcgggtcatgggaataacgccgccgcatcgtgtgttagttgtgttagttgtgttagttgtgttagttgtgttagtcgactcggaccgatg

SEQ ID NO: 15881 - DNA, 203 bp, Homo sapiens
ggcgcgccagtccttgcggacgctgttgtgttagttgtgttagttgtgttagttgtgttagttgtgttagttgtgttagttgtgtaatgagccattcgcagtttcactgtaccggccgtgcgtactcagacatgcatggcttatgtgttagttgtgttagttgtgttagttgtgttagttgtgttagtcgactcggaccgatg

SEQ ID NO: 15882 - DNA, 203 bp, Homo sapiens
ggcgcgccagtccttgttcggacagttgtgttagttgtgttagttgtgttagttgtgttagttgtgttagttgtgttagttgtgtagaacggccatgcaccaccacccacggaatcgagaaagagctatcaatctgtcaatcctgtgttagttgtgttagttgtgttagttgtgttagttgtgttagtcgactcggaccgatg

SEQ ID NO: 15883 - DNA, 203 bp, Homo sapiens
ggcgcgccagtccttagcggacgtgttgtgttagttgtgttagttgtgttagttgtgttagttgtgttagttgtgttagttgtgttaaacggccatgcaccaccacccacggaatcgagaaagagctatcaatctgtcaatgttgtgttagttgtgttagttgtgttagttgtgttagttgtgttagtcgactcggaccgatg

SEQ ID NO: 15884 - DNA, 203 bp, Homo sapiens
ggcgcgccagtcctaaccggaccagttgtgttagttgtgttagttgtgttagttgtgttagttgtgttagttgtgttagttgtgttacactcctggtggtgcccttccgtcaattcctttaagtttcagctttgcaaccatgttgtgttagttgtgttagttgtgttagttgtgttagttgtgttagtcgactcggaccgatg

SEQ ID NO: 15885 - DNA, 203 bp, Homo sapiens
ggcgcgccagtcctcggacgagttgttgtgttagttgtgttagttgtgttagttgtgttagttgtgttagttgtgttagttgtgttacccgccggagttgtgttacccgccggagttgtgttacccgccggagttgtgttacccgccggagttgtgttacccgccggagttgtgttagttgtgttagtcgactcggaccgatg

SEQ ID NO: 15886 - DNA, 203 bp, Homo sapiens
ggcgcgccagtcctctatcggacggttgtgttagttgtgttagttgtgttagttgtgttagttgtgttagttgtgttagttgtgttagtcggccatgcaccaccacccacggaatcgagaaagagctatcaatctgtcatagttgtgttagttgtgttagttgtgttagttgtgttagttgtgttagtcgactcggaccgatg

SEQ ID NO: 15887 - DNA, 203 bp, Homo sapiens
ggcgcgccagtcctacggacgttagttgtgttagttgtgttagttgtgttagttgtgttagttgtgttagttgtgttagttgtgttagttgaagtttcagctttgcaaccatactccccccggaacccaaagactttgttagttgtgttagttgtgttagttgtgttagttgtgttagttgtgttagtcgactcggaccgatg

SEQ ID NO: 15888 - DNA, 203 bp, Homo sapiens
ggcgcgccagtcctcaccggacttgttgtgttagttgtgttagttgtgttagttgtgttagttgtgttagttgtgttagttgtgttagttgcctggtggtgcccttccgtcaattcctttaagtttcagctttgcaagttagttgtgttagttgtgttagttgtgttagttgtgttagttgtgttagtcgactcggaccgatg

SEQ ID NO: 15889 - DNA, 203 bp, Homo sapiens
ggcgcgccagtcctgcggcggactgttgtgttagttgtgttagttgtgttagttgtgttagttgtgttagttgtgttagttgtgttagttggccatgcaccaccacccacggaatcgagaaagagctatcaatctgtcttagttgtgttagttgtgttagttgtgttagttgtgttagttgtgttagtcgactcggaccgatg

SEQ ID NO: 15890 - DNA, 203 bp, Homo sapiens
ggcgcgccagtcctcgtcacggacgttgtgttagttgtgttagttgtgttagttgtgttagttgtgttagttgtgttagttgtgttagttgtagtttcagctttgcaaccatactccccccggaacccaaagactttgttagttgtgttagttgtgttagttgtgttagttgtgttagttgtgttagtcgactcggaccgatg

SEQ ID NO: 15891 - DNA, 203 bp, Homo sapiens
ggcgcgccagtcctcaacggacgagttgtgttagttgtgttagttgtgttagttgtgttagttgtgttagttgtgttagttgtgttagttgtcattcgcagtttcactgtaccggccgtgcgtactcagacatgcatgttagttgtgttagttgtgttagttgtgttagttgtgttagttgtgttagtcgactcggaccgatg

SEQ ID NO: 15892 - DNA, 203 bp, Homo sapiens
ggcgcgccagtcctcaaagcggacgttgtgttagttgtgttagttgtgttagttgtgttagttgtgttagttgtgttagttgtgttagttgtctggtggtgcccttccgtcaattcctttaagtttcagctttgcatgttagttgtgttagttgtgttagttgtgttagttgtgttagttgtgttagtcgactcggaccgatg

SEQ ID NO: 15893 - DNA, 203 bp, Homo sapiens
ggcgcgccagtcctaatgcggacggttgtgttagttgtgttagttgtgttagttgtgttagttgtgttagttgtgttagttgtgttagttgtgcatgcaccaccacccacggaatcgagaaagagctatcaatctgtgttagttgtgttagttgtgttagttgtgttagttgtgttagttgtgttagtcgactcggaccgatg

SEQ ID NO: 15894 - DNA, 203 bp, Homo sapiens
ggcgcgccagtcctagtacgcacagttgtgttagttgtgttagttgtgttagttgtgttagttgtgttagttgtgttagttgtgttagttgtgtatgcaccaccacccacggaatcgagaaagagctatcaatctgtgttagttgtgttagttgtgttagttgtgttagttgtgttagttgtgttagtcgactcggaccgatg

SEQ ID NO: 15895 - DNA, 203 bp, Homo sapiens
ggcgcgccagtcctacgcacagaagttgtgttagttgtgttagttgtgttagttgtgttagttgtgttagttgtgttagttgtgttagttgtgtggtggtgcccttccgtcaattcctttaagtttcagctttgcgtgttagttgtgttagttgtgttagttgtgttagttgtgttagttgtgttagtcgactcggaccgatg

SEQ ID NO: 15896 - DNA, 203 bp, Homo sapiens
ggcgcgccagtccttaattagtccgttgtgttagttgtgttagttgtgttagttgtgttagttgtgttagttgtgttagttgtgttagttgtgttaggcagtttcactgtaccggccgtgcgtactcagacagttgtgttagttgtgttagttgtgttagttgtgttagttgtgttagttgtgttagtcgactcggaccgatg

SEQ ID NO: 15897 - DNA, 203 bp, Homo sapiens
ggcgcgccagtcctgttaatttctgttgtgttagttgtgttagttgtgttagttgtgttagttgtgttagttgtgttagttgtgttagttgtgttagggtgcccttccgtcaattcctttaagtttcagctagttgtgttagttgtgttagttgtgttagttgtgttagttgtgttagttgtgttagtcgactcggaccgatg

SEQ ID NO: 15898 - DNA, 203 bp, Homo sapiens
ggcgcgccagtcctttcgtaattagttgtgttagttgtgttagttgtgttagttgtgttagttgtgttagttgtgttagttgtgttagttgtgttagttccggaagctgcccggcgggtcatgggaatattagttgtgttagttgtgttagttgtgttagttgtgttagttgtgttagttgtgttagtcgactcggaccgatg

SEQ ID NO: 15899 - DNA, 203 bp, Homo sapiens
ggcgcgccagtcctgcgttaatttgttgtgttagttgtgttagttgtgttagttgtgttagttgtgttagttgtgttagttgtgttagttgtgttagttgctttgcaaccatactccccccggaacccgttagttgtgttagttgtgttagttgtgttagttgtgttagttgtgttagttgtgttagtcgactcggaccgatg

SEQ ID NO: 15900 - DNA, 203 bp, Homo sapiens
ggcgcgccagtcctctctaattttgttgtgttagttgtgttagttgtgttagttgtgttagttgtgttagttgtgttagttgtgttagttgtgttagttgtgccacccacggaatcgagaaagagcgtgttagttgtgttagttgtgttagttgtgttagttgtgttagttgtgttagttgtgttagtcgactcggaccgatg

SEQ ID NO: 15901 - DNA, 203 bp, Homo sapiens
ggcgcgccagtccttaatttcacggttgtgttagttgtgttagttgtgttagttgtgttagttgtgttagttgtgttagttgtgttagttgtgttagttgtgccttccgtcaattcctttaagtttgtgttagttgtgttagttgtgttagttgtgttagttgtgttagttgtgttagttgtgttagtcgactcggaccgatg

SEQ ID NO: 15902 - DNA, 203 bp, Homo sapiens
ggcgcgccagtcctctcttagatcgttgtgttagttgtgttagttgtgttagttgtgttagttgtgttagttgtgttagttgtgttagttgtgttagttgtgtaaaacattcttggcaaatgctttgtgttagttgtgttagttgtgttagttgtgttagttgtgttagttgtgttagttgtgttagtcgactcggaccgatg

SEQ ID NO: 15903 - DNA, 203 bp, Homo sapiens
ggcgcgccagtcctagggcgttaggttgtgttagttgtgttagttgtgttagttgtgttagttgtgttagttgtgttagttgtgttagttgtgttagttgtgttacaaccatactccccccgggttgtgttagttgtgttagttgtgttagttgtgttagttgtgttagttgtgttagttgtgttagtcgactcggaccgatg

SEQ ID NO: 15904 - DNA, 203 bp, Homo sapiens
ggcgcgccagtcctagaggcgttagttgtgttagttgtgttagttgtgttagttgtgttagttgtgttagttgtgttagttgtgttagttgtgttagttgtgttacccacggaatcgagaaaggttgtgttagttgtgttagttgtgttagttgtgttagttgtgttagttgtgttagttgtgttagtcgactcggaccgatg

SEQ ID NO: 15905 - DNA, 203 bp, Homo sapiens
ggcgcgccagtccttcaggctccagttgtgttagttgtgttagttgtgttagttgtgttagttgtgttagttgtgttagttgtgttagttgtgttagttgtgttaccggccgtagttgtgttaccggccgtagttgtgttaccggccgtagttgtgttaccggccgtagttgtgttagttgtgttagtcgactcggaccgatg

SEQ ID NO: 15906 - DNA, 203 bp, Homo sapiens
ggcgcgccagtcctcgctccactcgttgtgttagttgtgttagttgtgttagttgtgttagttgtgttagttgtgttagttgtgttagttgtgttagttgtgttagccgtcaattcctttaaagttgtgttagttgtgttagttgtgttagttgtgttagttgtgttagttgtgttagttgtgttagtcgactcggaccgatg

SEQ ID NO: 15907 - DNA, 203 bp, Homo sapiens
ggcgcgccagtcctctccagcgctgttgtgttagttgtgttagttgtgttagttgtgttagttgtgttagttgtgttagttgtgttagttgtgttagttgtgttagctgcccggcgggtcatagttgtgttagttgtgttagttgtgttagttgtgttagttgtgttagttgtgttagttgtgttagtcgactcggaccgatg

SEQ ID NO: 15908 - DNA, 203 bp, Homo sapiens
ggcgcgccagtcctgaatgctccagttgtgttagttgtgttagttgtgttagttgtgttagttgtgttagttgtgttagttgtgttagttgtgttagttgtgttagctgtaccggccgtgcgagttgtgttagttgtgttagttgtgttagttgtgttagttgtgttagttgtgttagttgtgttagtcgactcggaccgatg

SEQ ID NO: 15909 - DNA, 203 bp, Homo sapiens
ggcgcgccagtcctgtctccacatgttgtgttagttgtgttagttgtgttagttgtgttagttgtgttagttgtgttagttgtgttagttgtgttagttgtgttagttgcccggcgggtgttagttgtgttagttgtgttagttgtgttagttgtgttagttgtgttagttgtgttagttgtgttagtcgactcggaccgatg

SEQ ID NO: 15910 - DNA, 203 bp, Homo sapiens
ggcgcgccagtcctgctccaggtcgttgtgttagttgtgttagttgtgttagttgtgttagttgtgttagttgtgttagttgtgttagttgtgttagttgtgttagttgtatactccctgttagttgtgttagttgtgttagttgtgttagttgtgttagttgtgttagttgtgttagttgtgttagtcgactcggaccgatg

SEQ ID NO: 15911 - DNA, 203 bp, Homo sapiens
ggcgcgccagtccttctccagctggttgtgttagttgtgttagttgtgttagttgtgttagttgtgttagttgtgttagttgtgttagttgtgttagttgtgttagttgtcaattccttgttagttgtgttagttgtgttagttgtgttagttgtgttagttgtgttagttgtgttagttgtgttagtcgactcggaccgatg

SEQ ID NO: 15912 - DNA, 203 bp, Homo sapiens
ggcgcgccagtcctgctcctgtcggttgtgttagttgtgttagttgtgttagttgtgttagttgtgttagttgtgttagttgtgttagttgtgttagttgtgttagttgtccggcgggtgttagttgtgttagttgtgttagttgtgttagttgtgttagttgtgttagttgtgttagttgtgttagtcgactcggaccgatg

SEQ ID NO: 15913 - DNA, 203 bp, Homo sapiens
ggcgcgccagtcctgcagctccctgttgtgttagttgtgttagttgtgttagttgtgttagttgtgttagttgtgttagttgtgttagttgtgttagttgtgttagttgtgcggcgggtgttagttgtgttagttgtgttagttgtgttagttgtgttagttgtgttagttgtgttagttgtgttagtcgactcggaccgatg

SEQ ID NO: 15914 - DNA, 203 bp, Homo sapiens
ggcgcgccagtcctatctccaccggttgtgttagttgtgttagttgtgttagttgtgttagttgtgttagttgtgttagttgtgttagttgtgttagttgtgttagttgtgcttggcgtgttagttgtgttagttgtgttagttgtgttagttgtgttagttgtgttagttgtgttagttgtgttagtcgactcggaccgatg

SEQ ID NO: 15915 - DNA, 203 bp, Homo sapiens
ggcgcgccagtcctagctcctcacgttgtgttagttgtgttagttgtgttagttgtgttagttgtgttagttgtgttagttgtgttagttgtgttagttgtgttagttgtggaatcggtgttagttgtgttagttgtgttagttgtgttagttgtgttagttgtgttagttgtgttagttgtgttagtcgactcggaccgatg

SEQ ID NO: 15916 - DNA, 203 bp, Homo sapiens
ggcgcgccagtcctctccataccagttgtgttagttgtgttagttgtgttagttgtgttagttgtgttagttgtgttagttgtgttagttgtgttagttgtgttagttgtgtactctgtgttagttgtgttagttgtgttagttgtgttagttgtgttagttgtgttagttgtgttagttgtgttagtcgactcggaccgatg

SEQ ID NO: 15917 - DNA, 203 bp, Homo sapiens
ggcgcgccagtcctctcctaacgggttgtgttagttgtgttagttgtgttagttgtgttagttgtgttagttgtgttagttgtgttagttgtgttagttgtgttagttgtgtattctgtgttagttgtgttagttgtgttagttgtgttagttgtgttagttgtgttagttgtgttagttgtgttagtcgactcggaccgatg

SEQ ID NO: 15918 - DNA, 203 bp, Homo sapiens
ggcgcgccagtcctaggtcactccgttgtgttagttgtgttagttgtgttagttgtgttagttgtgttagttgtgttagttgtgttagttgtgttagttgtgttagttgtgtcggctgtgttagttgtgttagttgtgttagttgtgttagttgtgttagttgtgttagttgtgttagttgtgttagtcgactcggaccgatg

SEQ ID NO: 15919 - DNA, 203 bp, Homo sapiens
ggcgcgccagtcctagtttgctccgttgtgttagttgtgttagttgtgttagttgtgttagttgtgttagttgtgttagttgtgttagttgtgttagttgtgttagttgtgttagttgtgttaccggccgtagttgtgttaccggccgtagttgtgttaccggccgtagttgtgttaccggccgtagtcgactcggaccgatg

SEQ ID NO: 15920 - DNA, 203 bp, Homo sapiens
ggcgcgccagtccttgctccaggagttgtgttagttgtgttagttgtgttagttgtgttagttgtgttagttgtgttagttgtgttagttgtgttagttgtgttagttgtgttagttgtgttacggccggtagttgtgttacggccggtagttgtgttacggccggtagttgtgttagttgtgttagtcgactcggaccgatg

SEQ ID NO: 15921 - DNA, 203 bp, Homo sapiens
ggcgcgccagtcctagtgctccaggttgtgttagttgtgttagttgtgttagttgtgttagttgtgttagttgtgttagttgtgttagttgtgttagttgtgttagttgtgttagttgtgttagttgtgttagttgtgttacccgccggagttgtgttacccgccggagttgtgttagttgtgttagtcgactcggaccgatg

SEQ ID NO: 15922 - DNA, 203 bp, Homo sapiens
ggcgcgccagtcctgatcgctcctgttgtgttagttgtgttagttgtgttagttgtgttagttgtgttagttgtgttagttgtgttagttgtgttagttgtgttagttgtgttagttgtgttagttgtgttagttgtgttaccggccgtagttgtgttaccggccgtagttgtgttaccggccgtagtcgactcggaccgatg

SEQ ID NO: 15923 - DNA, 203 bp, Homo sapiens
ggcgcgccagtcctgggctccattgttgtgttagttgtgttagttgtgttagttgtgttagttgtgttagttgtgttagttgtgttagttgtgttagttgtgttagttgtgttagttgtgttagttgtgttagttgtgttacggccggtagttgtgttacggccggtagttgtgttagttgtgttagtcgactcggaccgatg

SEQ ID NO: 15924 - DNA, 203 bp, Homo sapiens
ggcgcgccagtccttctccacgaggttgtgttagttgtgttagttgtgttagttgtgttagttgtgttagttgtgttagttgtgttagttgtgttagttgtgttagttgtgttagttgtgttagttgtgttagttgtgttagttgtgttagttgtgttaccggccgtagttgtgttaccggccgtagtcgactcggaccgatg

SEQ ID NO: 15925 - DNA, 203 bp, Homo sapiens
ggcgcgccagtccttctccatacggttgtgttagttgtgttagttgtgttagttgtgttagttgtgttagttgtgttagttgtgttagttgtgttagttgtgttagttgtgttagttgtgttagttgtgttagttgtgttagttgtgttagttgtgttccggcgggtagttgtgttccggcgggtagtcgactcggaccgatg

SEQ ID NO: 15926 - DNA, 203 bp, Homo sapiens
ggcgcgccagtcctgggtggctccgttgtgttagttgtgttagttgtgttagttgtgttagttgtgttagttgtgttagttgtgttagttgtgttagttgtgttagttgtgttagttgtgttagttgtgttagttgtgttagttgtgttagttgtgtttactcccttagttgtgttagttgtgttagtcgactcggaccgatg

SEQ ID NO: 15927 - DNA, 203 bp, Homo sapiens
ggcgcgccagtcctgctcctagaagttgtgttagttgtgttagttgtgttagttgtgttagttgtgttagttgtgttagttgtgttagttgtgttagttgtgttagttgtgttagttgtgttagttgtgttagttgtgttagttgtgttagttgtgtttactcccttagttgtgtttactcccttagtcgactcggaccgatg

SEQ ID NO: 15928 - DNA, 203 bp, Homo sapiens
ggcgcgccagtcctaggttctcccgttgtgttagttgtgttagttgtgttagttgtgttagttgtgttagttgtgttagttgtgttagttgtgttagttgtgttagttgtgttagttgtgttagttgtgttagttgtgttagttgtgttagttgtgttttcttggcaaattgtgttagttgtgttagtcgactcggaccgatg

SEQ ID NO: 15929 - DNA, 203 bp, Homo sapiens
ggcgcgccagtcctcaagctcctcgttgtgttagttgtgttagttgtgttagttgtgttagttgtgttagttgtgttagttgtgttagttgtgttagttgtgttagttgtgttagttgtgttagttgtgttagttgtgttcacggaatcgagaatgttcacggaatcgagaatgttagttgtgttagtcgactcggaccgatg

SEQ ID NO: 15930 - DNA, 203 bp, Homo sapiens
ggcgcgccagtcctctccaagtatgttgtgttagttgtgttagttgtgttagttgtgttagttgtgttagttgtgttagttgtgttagttgtgttagttgtgttagttgtgttagttgtgttagttgtgttagttgtgttccggcgggtagttgtgttccggcgggtagttgtgttccggcgggtagtcgactcggaccgatg

SEQ ID NO: 15931 - DNA, 203 bp, Homo sapiens
ggcgcgccagtcctatctccatgcgttgtgttagttgtgttagttgtgttagttgtgttagttgtgttagttgtgttagttgtgttagttgtgttagttgtgttagttgtgttagttgtgttagttgtgttagttgtgtttaaaggaattgacgtgtttaaaggaattgacgtgttagttgtgttagtcgactcggaccgatg

SEQ ID NO: 15932 - DNA, 203 bp, Homo sapiens
ggcgcgccagtccttacgcactccgttgtgttagttgtgttagttgtgttagttgtgttagttgtgttagttgtgttagttgtgttagttgtgttagttgtgttagttgtgttagttgtgttagttgtgttagttgtgtttactcccttagttgtgtttactcccttagttgtgttagttgtgttagtcgactcggaccgatg

SEQ ID NO: 15933 - DNA, 203 bp, Homo sapiens
ggcgcgccagtcctatctctccaagttgtgttagttgtgttagttgtgttagttgtgttagttgtgttagttgtgttagttgtgttagttgtgttagttgtgttagttgtgttagttgtgttagttgtgttagttgtgtttactcccttagttgtgtttactcccttagttgtgtttactcccttagtcgactcggaccgatg

SEQ ID NO: 15934 - DNA, 203 bp, Homo sapiens
ggcgcgccagtcctcctgctccacgttgtgttagttgtgttagttgtgttagttgtgttagttgtgttagttgtgttagttgtgttagttgtgttagttgtgttagttgtgttagttgtgttagttgtgttagttgtgttttctcgattccgtgtgttttctcgattccgtgtgttagttgtgttagtcgactcggaccgatg

SEQ ID NO: 15935 - DNA, 203 bp, Homo sapiens
ggcgcgccagtcctctcctctgacgttgtgttagttgtgttagttgtgttagttgtgttagttgtgttagttgtgttagttgtgttagttgtgttagttgtgttagttgtgttagttgtgttagttgtgttagttgtgttttcttggcaaattgtgttttcttggcaaattgtgttagttgtgttagtcgactcggaccgatg

SEQ ID NO: 15936 - DNA, 203 bp, Homo sapiens
ggcgcgccagtcctctcccagtgagttgtgttagttgtgttagttgtgttagttgtgttagttgtgttagttgtgttagttgtgttagttgtgttagttgtgttagttgtgttagttgtgtttaaaggaattgacgtgtttaaaggaattgacgtgtttaaaggaattgacgtgttagttgtgttagtcgactcggaccgatg

SEQ ID NO: 15937 - DNA, 203 bp, Homo sapiens
ggcgcgccagtcctctgccactccgttgtgttagttgtgttagttgtgttagttgtgttagttgtgttagttgtgttagttgtgttagttgtgttagttgtgttagttgtgttagttgtgttttcttggcaaattgtgttttcttggcaaattgtgttttcttggcaaattgtgttagttgtgttagtcgactcggaccgatg

SEQ ID NO: 15938 - DNA, 203 bp, Homo sapiens
ggcgcgccagtcctcagtggagacgttgtgttagttgtgttagttgtgttagttgtgttagttgtgttagttgtgttagttgtgttagttgtgttagttgtgttcactgtaccggccgtgcgtactgtgttagttgtgttagttgtgttagttgtgttagttgtgttagttgtgttagttgtgttagtcgactcggaccgatg

SEQ ID NO: 15939 - DNA, 203 bp, Homo sapiens
ggcgcgccagtcctggagcacgatgttgtgttagttgtgttagttgtgttagttgtgttagttgtgttagttgtgttagttgtgttagttgtgttagttgtgttcactgtaccggccgtgcgtattgtgttagttgtgttagttgtgttagttgtgttagttgtgttagttgtgttagttgtgttagtcgactcggaccgatg

SEQ ID NO: 15940 - DNA, 203 bp, Homo sapiens
ggcgcgccagtcctggagtgcgttgttgtgttagttgtgttagttgtgttagttgtgttagttgtgttagttgtgttagttgtgttagttgtgttagttgtgttttccgtcaattcctttaagtttgtgttagttgtgttagttgtgttagttgtgttagttgtgttagttgtgttagttgtgttagtcgactcggaccgatg

SEQ ID NO: 15941 - DNA, 203 bp, Homo sapiens
ggcgcgccagtcctgggaggccctgttgtgttagttgtgttagttgtgttagttgtgttagttgtgttagttgtgttagttgtgttagttgtgttagttgtgttttctcgattccgtgtgttttctcgattccgtgtgttttctcgattccgtgtgttttctcgattccgtgtgttagttgtgttagtcgactcggaccgatg

SEQ ID NO: 15942 - DNA, 203 bp, Homo sapiens
ggcgcgccagtcctgaggagctttgttgtgttagttgtgttagttgtgttagttgtgttagttgtgttagttgtgttagttgtgttagttgtgttagttgtgttttcttggcaaattgtgttttcttggcaaattgtgttttcttggcaaattgtgttttcttggcaaattgtgttagttgtgttagtcgactcggaccgatg

SEQ ID NO: 15943 - DNA, 203 bp, Homo sapiens
ggcgcgccagtcctcatacgggaggttgtgttagttgtgttagttgtgttagttgtgttagttgtgttagttgtgttagttgtgttagttgtgttagttgttttgcaaccatactccccccggaacctgttagttgtgttagttgtgttagttgtgttagttgtgttagttgtgttagttgtgttagtcgactcggaccgatg

SEQ ID NO: 15944 - DNA, 203 bp, Homo sapiens
ggcgcgccagtcctaacgggaggggttgtgttagttgtgttagttgtgttagttgtgttagttgtgttagttgtgttagttgtgttagttgtgttattcccggaagctgcccggcgggtcatgggaataacggttgtgttagttgtgttagttgtgttagttgtgttagttgtgttagttgtgttagtcgactcggaccgatg

SEQ ID NO: 15945 - DNA, 203 bp, Homo sapiens
ggcgcgccagtcctactgggagccgttgtgttagttgtgttagttgtgttagttgtgttagttgtgttagttgtgttagttgtgttagttgtgttgattaatgaaaacattcttggcaaatgctttcgctctgttgtgttagttgtgttagttgtgttagttgtgttagttgtgttagttgtgttagtcgactcggaccgatg

SEQ ID NO: 15946 - DNA, 203 bp, Homo sapiens
ggcgcgccagtcctgggagactgtgttgtgttagttgtgttagttgtgttagttgtgttagttgtgttagttgtgttagttgtgttagttgtgtttcgcagtttcactgtaccggccgtgcgtactcagacatgtgtgttagttgtgttagttgtgttagttgtgttagttgtgttagttgtgttagtcgactcggaccgatg

SEQ ID NO: 15947 - DNA, 203 bp, Homo sapiens
ggcgcgccagtcctggagctaatggttgtgttagttgtgttagttgtgttagttgtgttagttgtgttagttgtgttagttgtgttagttgtgtttcgcagtttcactgtaccggccgtgcgtactcagacatttgtgttagttgtgttagttgtgttagttgtgttagttgtgttagttgtgttagtcgactcggaccgatg

SEQ ID NO: 15948 - DNA, 203 bp, Homo sapiens
ggcgcgccagtcctaggagagggcgttgtgttagttgtgttagttgtgttagttgtgttagttgtgttagttgtgttagttgtgttagttgtgtttgcaccaccacccacggaatcgagaaagagctatcaatttgtgttagttgtgttagttgtgttagttgtgttagttgtgttagttgtgttagtcgactcggaccgatg

SEQ ID NO: 15949 - DNA, 203 bp, Homo sapiens
ggcgcgccagtcctaggtaggagcgttgtgttagttgtgttagttgtgttagttgtgttagttgtgttagttgtgttagttgtgttagttgtgtttttcccggaagctgcccggcgggtcatgggaataacgcttgtgttagttgtgttagttgtgttagttgtgttagttgtgttagttgtgttagtcgactcggaccgatg

SEQ ID NO: 15950 - DNA, 203 bp, Homo sapiens
ggcgcgccagtcctggagtcgcacgttgtgttagttgtgttagttgtgttagttgtgttagttgtgttagttgtgttagttgtgttagttgttggtttcccggaagctgcccggcgggtcatgggaataacgccgccgttagttgtgttagttgtgttagttgtgttagttgtgttagttgtgttagtcgactcggaccgatg

SEQ ID NO: 15951 - DNA, 203 bp, Homo sapiens
ggcgcgccagtccttgacaggagcgttgtgttagttgtgttagttgtgttagttgtgttagttgtgttagttgtgttagttgtgttagtttaagtttcagctttgcaaccatactccccccggaacccaaagactttgttagttgtgttagttgtgttagttgtgttagttgtgttagttgtgttagtcgactcggaccgatg

SEQ ID NO: 15952 - DNA, 203 bp, Homo sapiens
ggcgcgccagtcctccgaggagatgttgtgttagttgtgttagttgtgttagttgtgttagttgtgttagttgtgttagttgtgttagtttcctggtggtgcccttccgtcaattcctttaagtttcagctttgcaacttagttgtgttagttgtgttagttgtgttagttgtgttagttgtgttagtcgactcggaccgatg

SEQ ID NO: 15953 - DNA, 203 bp, Homo sapiens
ggcgcgccagtcctggagccgcttgttgtgttagttgtgttagttgtgttagttgtgttagttgtgttagttgtgttagttgtgttatcgttcttgattaatgaaaacattcttggcaaatgctttcgctctggtccgtctgttgtgttagttgtgttagttgtgttagttgtgttagttgtgttagtcgactcggaccgatg

SEQ ID NO: 15954 - DNA, 203 bp, Homo sapiens
ggcgcgccagtcctaggagctgcggttgtgttagttgtgttagttgtgttagttgtgttagttgtgttagttgtgttagttgtgttatgagccattcgcagtttcactgtaccggccgtgcgtactcagacatgcatggctgttgtgttagttgtgttagttgtgttagttgtgttagttgtgttagtcgactcggaccgatg

SEQ ID NO: 15955 - DNA, 203 bp, Homo sapiens
ggcgcgccagtcctttaggagcgcgttgtgttagttgtgttagttgtgttagttgtgttagttgtgttagttgtgttagttgtgttatgagccattcgcagtttcactgtaccggccgtgcgtactcagacatgcatggcttttgtgttagttgtgttagttgtgttagttgtgttagttgtgttagtcgactcggaccgatg

SEQ ID NO: 15956 - DNA, 203 bp, Homo sapiens
ggcgcgccagtcctcaataggagcgttgtgttagttgtgttagttgtgttagttgtgttagttgtgttagttgtgttagttgtgttcacggaatcgagaatgttcacggaatcgagaatgttcacggaatcgagaatgttcacggaatcgagaatgttcacggaatcgagaatgttagttgtgttagtcgactcggaccgatg

SEQ ID NO: 15957 - DNA, 203 bp, Homo sapiens
ggcgcgccagtcctgtccaaggaggttgtgttagttgtgttagttgtgttagttgtgttagttgtgttagttgtgttagttgtgttccactcctggtggtgcccttccgtcaattcctttaagtttcagctttgcaaccatattgtgttagttgtgttagttgtgttagttgtgttagttgtgttagtcgactcggaccgatg

SEQ ID NO: 15958 - DNA, 203 bp, Homo sapiens
ggcgcgccagtcctgctggagccggttgtgttagttgtgttagttgtgttagttgtgttagttgtgttagttgtgttagttgtgttccggcgggtagttgtgttccggcgggtagttgtgttccggcgggtagttgtgttccggcgggtagttgtgttccggcgggtagttgtgttagttgtgttagtcgactcggaccgatg

SEQ ID NO: 15959 - DNA, 203 bp, Homo sapiens
ggcgcgccagtcctgcaggagcatgttgtgttagttgtgttagttgtgttagttgtgttagttgtgttagttgtgttagttgtgttccggcgggtagttgtgttccggcgggtagttgtgttccggcgggtagttgtgttccggcgggtagttgtgttccggcgggtagttgtgttccggcgggtagtcgactcggaccgatg

SEQ ID NO: 15960 - DNA, 203 bp, Homo sapiens
ggcgcgccagtcctatggagaggtgttgtgttagttgtgttagttgtgttagttgtgttagttgtgttagttgtgttagttgtgttcctttaagtttcagctttgcaaccatactccccccggaacccaaagactttggtttttgtgttagttgtgttagttgtgttagttgtgttagttgtgttagtcgactcggaccgatg

SEQ ID NO: 15961 - DNA, 203 bp, Homo sapiens
ggcgcgccagtcctacgtcaggaggttgtgttagttgtgttagttgtgttagttgtgttagttgtgttagttgtgttagttgtgtttactcccttagttgtgtttactcccttagttgtgtttactcccttagttgtgtttactcccttagttgtgtttactcccttagttgtgttagttgtgttagtcgactcggaccgatg

SEQ ID NO: 15962 - DNA, 203 bp, Homo sapiens
ggcgcgccagtcctcatgtggagcgttgtgttagttgtgttagttgtgttagttgtgttagttgtgttagttgtgttagttgtttaatgagccattcgcagtttcactgtaccggccgtgcgtactcagacatgcatggcttaatcgttagttgtgttagttgtgttagttgtgttagttgtgttagtcgactcggaccgatg

SEQ ID NO: 15963 - DNA, 203 bp, Homo sapiens
ggcgcgccagtccttctggtggaggttgtgttagttgtgttagttgtgttagttgtgttagttgtgttagttgtgttccgtcaattcctttaagtttcagctttgcaaccatactccccccggaacccaaagactttggtttcccggaagctggtgttagttgtgttagttgtgttagttgtgttagtcgactcggaccgatg

SEQ ID NO: 15964 - DNA, 203 bp, Homo sapiens
ggcgcgccagtccttagcgcacaagttgtgttagttgtgttagttgtgttagttgtgttagttgtgttagttgttccaccaactaagaacggccatgcaccaccacccacggaatcgagaaagagctatcaatctgtcaatcctgtccgtgtcctgttagttgtgttagttgtgttagttgtgttagtcgactcggaccgatg

SEQ ID NO: 15965 - DNA, 203 bp, Homo sapiens
ggcgcgccagtccttgtgcgctacgttgtgttagttgtgttagttgtgttagttgtgttagttgtgttatcttcgaacctccgactttcgttcttgattaatgaaaacattcttggcaaatgctttcgctctggtccgtcttgcgccggtccaagaattgttgtgttagttgtgttagttgtgttagtcgactcggaccgatg

SEQ ID NO: 15966 - DNA, 203 bp, Homo sapiens
ggcgcgccagtccttcgtagcgcagttgtgttagttgtgttagttgtgttagttgtgttagttgtgttcaaattaagccgcaggctccactcctggtggtgcccttccgtcaattcctttaagtttcagctttgcaaccatactccccccggaacccaaagtgtgttagttgtgttagttgtgttagtcgactcggaccgatg

SEQ ID NO: 15967 - DNA, 203 bp, Homo sapiens
ggcgcgccagtcctcattgtatgcgttgtgttagttgtgttagttgtgttagttgtgttagttgtgttccggcgggtagttgtgttccggcgggtagttgtgttccggcgggtagttgtgttccggcgggtagttgtgttccggcgggtagttgtgttccggcgggtagttgtgttccggcgggtagtcgactcggaccgatg

SEQ ID NO: 15968 - DNA, 203 bp, Homo sapiens
ggcgcgccagtcctacattgtattgttgtgttagttgtgttagttgtgttagttgtgttagttgtgttggtgcccttccgtcaattcctttaagtttcagctttgcaaccatactccccccggaacccaaagactttggtttcccggaagctgcccggcggtgtgttagttgtgttagttgtgttagtcgactcggaccgatg

SEQ ID NO: 15969 - DNA, 203 bp, Homo sapiens
ggcgcgccagtcctatacaatcatgttgtgttagttgtgttagttgtgttagttgtgttagtttgatcgtcttcgaacctccgactttcgttcttgattaatgaaaacattcttggcaaatgctttcgctctggtccgtcttgcgccggtccaagaatttcacctttagttgtgttagttgtgttagtcgactcggaccgatg

SEQ ID NO: 15970 - DNA, 203 bp, Homo sapiens
ggcgcgccagtcctccaggtacaagttgtgttagttgtgttagttgtgttagttgtgtttatctgatcgtcttcgaacctccgactttcgttcttgattaatgaaaacattcttggcaaatgctttcgctctggtccgtcttgcgccggtccaagaatttcacctctagttgtgttagttgtgttagtcgactcggaccgatg

SEQ ID NO: 15971 - DNA, 203 bp, Homo sapiens
ggcgcgccagtcctacaggtaagcgttgtgttagttgtgttagttgtgttagttttcccgtgttgagtcaaattaagccgcaggctccactcctggtggtgcccttccgtcaattcctttaagtttcagctttgcaaccatactccccccggaacccaaagactttggtttcccgtagttgtgttagtcgactcggaccgatg

SEQ ID NO: 15972 - DNA, 203 bp, Homo sapiens
ggcgcgccagtcctagacaggtaggttgtgttagttgtgttagttgtgttatacgacggtatctgatcgtcttcgaacctccgactttcgttcttgattaatgaaaacattcttggcaaatgctttcgctctggtccgtcttgcgccggtccaagaatttcacctctagcggcgcaagttgtgttagtcgactcggaccgatg

SEQ ID NO: 15973 - DNA, 203 bp, Homo sapiens
ggcgcgccagtccttgccttttgggttgtgttagttgtgttagttgtgttcacggaatcgagaatgttcacggaatcgagaatgttcacggaatcgagaatgttcacggaatcgagaatgttcacggaatcgagaatgttcacggaatcgagaatgttcacggaatcgagaatgttagttgtgttagtcgactcggaccgatg

SEQ ID NO: 15974 - DNA, 203 bp, Homo sapiens
ggcgcgccagtcctcctcctctgcgttgtgttagttgtgttagttgtgttctacgacggtatctgatcgtcttcgaacctccgactttcgttcttgattaatgaaaacattcttggcaaatgctttcgctctggtccgtcttgcgccggtccaagaatttcacctctagcggcgcaatttgtgttagtcgactcggaccgatg

SEQ ID NO: 15975 - DNA, 203 bp, Homo sapiens
ggcgcgccagtcctaaggcagtctgttgtgttagttgtgttagttgtgttgcaggctccactcctggtggtgcccttccgtcaattcctttaagtttcagctttgcaaccatactccccccggaacccaaagactttggtttcccggaagctgcccggcgggtcatgggaataacgccttgtgttagtcgactcggaccgatg

SEQ ID NO: 15976 - DNA, 203 bp, Homo sapiens
ggcgcgccagtcctattgtgccacgttgtgttagttgtgttagttgtgtttactcccttagttgtgtttactcccttagttgtgtttactcccttagttgtgtttactcccttagttgtgtttactcccttagttgtgtttactcccttagttgtgtttactcccttagttgtgtttactcccttagtcgactcggaccgatg

SEQ ID NO: 15977 - DNA, 203 bp, Homo sapiens
ggcgcgccagtccttatgcctattgttgtgttagttgtgttagttgtgtttttcagctttgcaaccatactccccccggaacccaaagactttggtttcccggaagctgcccggcgggtcatgggaataacgccgccgcatcgccggtcggcatcgtttatggtcggaactacgacggttgtgttagtcgactcggaccgatg

SEQ ID NO: 15978 - DNA, 203 bp, Homo sapiens
ggcgcgccagtcctgactaggcaagttgtgttcgtcaattcctttatgttcgtcaattcctttatgttcgtcaattcctttatgttcgtcaattcctttatgttcgtcaattcctttatgttcgtcaattcctttatgttcgtcaattcctttatgttcgtcaattcctttatgttagttgtgttagtcgactcggaccgatg

SEQ ID NO: 15979 - DNA, 203 bp, Homo sapiens
ggcgcgccagtcctctcctcctatgttgtgtttactcccttagttgtgtttactcccttagttgtgtttactcccttagttgtgtttactcccttagttgtgtttactcccttagttgtgtttactcccttagttgtgtttactcccttagttgtgtttactcccttagttgtgtttactcccttagtcgactcggaccgatg

SEQ ID NO: 15980 - DNA, 203 bp, Homo sapiens
ggcgcgccagtcctttaggcagcctaccggccgtctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 15981 - DNA, 203 bp, Homo sapiens
ggcgcgccagtcctcttacctgggtaccggccgtctgacatttctgacatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 15982 - DNA, 203 bp, Homo sapiens
ggcgcgccagtcctgaccctcctataccggccgtctgacatttctgacatttctgacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 15983 - DNA, 203 bp, Homo sapiens
ggcgcgccagtcctcctccatagctaccggccgtctgacatttctgacatttctgacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 15984 - DNA, 203 bp, Homo sapiens
ggcgcgccagtcctatgcctatggtcacggaatcgagaaatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 15985 - DNA, 203 bp, Homo sapiens
ggcgcgccagtcctctgccttcaatcccactcaaaatccaaaatcactaccagccactatctgctagaccggcgggtcgaataggtccggcgggtcaaaatatgccggcgggtgacattagtccggcgggtatcaatctcccggcgggtttataccgcccggcgggtacatatactccggcgggtaaacgactcggaccgatg

SEQ ID NO: 15986 - DNA, 203 bp, Homo sapiens
ggcgcgccagtcctcaggaggtgttcccactcaaaatccaaaatcactaccagccactatctgctagacctagagtgcgaataggtaaataaaaccaaaatatgccggcgggtgacattagtccggcgggtatcaatctcccggcgggtttataccgcccggcgggtacatatactccggcgggtaaacgactcggaccgatg

SEQ ID NO: 15987 - DNA, 203 bp, Homo sapiens
ggcgcgccagtcctgcaatacctgtcccactcaaaatccaaaatcactaccagccactatctgctagacctagagtgcgaataggtaaataaaaccaaaatatggggtaaatagacattagtaccggccgtatcaatctcaccggccgtttataccgcaccggccgtacatatactaccggccgtaaacgactcggaccgatg

SEQ ID NO: 15988 - DNA, 203 bp, Homo sapiens
ggcgcgccagtcctttgcctacagtcccactcaaaatccaaaatcactaccagccactatctgctagacctagagtgcgaataggtaaataaaaccaaaatatggggtaaatagacattagttagagttcaatcaatctcaacaaccatttataccgcaccggccgtacatatactaccggccgtaaacgactcggaccgatg

SEQ ID NO: 15989 - DNA, 203 bp, Homo sapiens
ggcgcgccagtccttcaaggaggctcccactcaaaatccaaaatcactaccagccactatctgctagacctagagtgcgaataggtaaataaaaccaaaatatggggtaaatagacattagttagagttcaatcaatctcaacaaccatttataccgccaattcaatacatatactaccggccgtaaacgactcggaccgatg

SEQ ID NO: 15990 - DNA, 203 bp, Homo sapiens
ggcgcgccagtcctgtttacctgttcccactcaaaatccaaaatcactaccagccactatctgctagacctagagtgcgaataggtaaataaaaccaaaatatggggtaaatagacattagttagagttcaatcaatctcaacaaccatttataccgcccggcgggtacatatactccggcgggtaaacgactcggaccgatg

SEQ ID NO: 15991 - DNA, 203 bp, Homo sapiens
ggcgcgccagtcctcaaaggcaattcccactcaaaatccaaaatcactaccagccactatctgctagacctagagtgcgaataggtaaataaaaccaaaatatggggtaaatagacattagttagagttcaatcaatctccacggaatcgagaaccgccacggaatcgagaatactataaatcttaaacgactcggaccgatg

SEQ ID NO: 15992 - DNA, 203 bp, Homo sapiens
ggcgcgccagtcctagagtacctgtcccactcaaaatccaaaatcactaccagccactatctgctagacctagagtgcgaataggtaaataaaaccaaaatatggggtaaatagacattagttagagttcaatcaatctctactcccatttataccgctactcccatacatatacttactcccttaaacgactcggaccgatg

SEQ ID NO: 15993 - DNA, 203 bp, Homo sapiens
ggcgcgccagtcctacgtggaggatcccactcaaaatccaaaatcactaccagccactatctgctagacctagagtgcgaataggtaaataaaaccaaaatatggggtaaatagacattagttagagttcaatcaatctcttcttggcaaaataccgcttcttggcaaaatatactttcttggcaaaacgactcggaccgatg

SEQ ID NO: 15994 - DNA, 203 bp, Homo sapiens
ggcgcgccagtccttcaaaaggcatcccactcaaaatccaaaatcactaccagccactatctgctagacctagagtgcgaataggttactcccaccaaaatatgtactccctagacattagttactccccaatcaatctctactcccatttataccgctactcccatacatatacttactcccttaaacgactcggaccgatg

SEQ ID NO: 15995 - DNA, 203 bp, Homo sapiens
ggcgcgccagtcctaatcctccattcccactccacggaatcgagaactaccacggaatcgagaatagacacggaatcgagaaaggtcacggaatcgagaatatgcacggaatcgagaatagtcacggaatcgagaatctccacggaatcgagaaccgccacggaatcgagaatactataaatcttaaacgactcggaccgatg

SEQ ID NO: 15996 - DNA, 203 bp, Homo sapiens
ggcgcgccagtcctcggtttcatatccggcgggtctgacatttctgacatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 15997 - DNA, 203 bp, Homo sapiens
ggcgcgccagtcctgggagttgcctccggcgggtctgacatttctgacatttctgacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 15998 - DNA, 203 bp, Homo sapiens
ggcgcgccagtcctcacgggagtctccttcctaccggccgtgcctgggccaccggccgttgctgtggaaccggccgtggggccctgaccggccgtctgagcaccaccggccgtagcctgcctaccggccgtacccctagcaccggccgtggggaggcaaccggccgtaggccaggcaccggccgtggtcgactcggaccgatg

SEQ ID NO: 15999 - DNA, 203 bp, Homo sapiens
ggcgcgccagtcctcgacgggagttccttcctcacggaatcgagaaggcccacggaatcgagaatggacacggaatcgagaacctgcacggaatcgagaacacccacggaatcgagaagcctcacggaatcgagaatagccacggaatcgagaaggcacacggaatcgagaaaggctacctcgggggtcgactcggaccgatg

SEQ ID NO: 16000 - DNA, 203 bp, Homo sapiens
ggcgcgccagtcctactccctgtgtccttcctccggcgggtgcctgggccccggcgggttgctgtggaccggcgggtggggccctgccggcgggtctgagcaccccggcgggtagcctgcctccggcgggtacccctagcccggcgggtggggaggcaccggcgggtaggccaggcccggcgggtggtcgactcggaccgatg

SEQ ID NO: 16001 - DNA, 203 bp, Homo sapiens
ggcgcgccagtcctattactcccgtccttcctctgcacctggcctgggccacacccaagtgctgtggacgtcaattcctttacctgcgtcaattcctttacacccgtcaattcctttagcctcgtcaattcctttatagccgtcaattcctttaggcacgtcaattcctttaaggctacctcgggggtcgactcggaccgatg

SEQ ID NO: 16002 - DNA, 203 bp, Homo sapiens
ggcgcgccagtcctatcgtttgactccttcctctgcacctggcctgggccacacccaagtgctgtggactggcccgaggggccctgcacgtggccctgagcacccacggaatcgagaagcctcacggaatcgagaatagccacggaatcgagaaggcacacggaatcgagaaaggctacctcgggggtcgactcggaccgatg

SEQ ID NO: 16003 - DNA, 203 bp, Homo sapiens
ggcgcgccagtccttgaaacgagttccttcctctgcacctggcctgggccacacccaagtgctgtggactggcccgaggggccctgcacgtggccctgagcacctactcccgtagcctgccttactcccagacccctagctactcccaaggggaggcatactcccgcaggccaggctactcccggggtcgactcggaccgatg

SEQ ID NO: 16004 - DNA, 203 bp, Homo sapiens
ggcgcgccagtcctgaaacgactttccttcctctgcacctggcctgggccacacccaagtgctgtggactggcccgaggggccctgcacgtggccctgagcacctctcagcgtagcctgcctagtccctagacccctagcaccggccgtggggaggcaaccggccgtaggccaggcaccggccgtggtcgactcggaccgatg

SEQ ID NO: 16005 - DNA, 203 bp, Homo sapiens
ggcgcgccagtcctagtcgtttggtccttcctctgcacctggcctgggccacacccaagtgctgtggactggcccgaggggccctgcacgtggccctgagcacctctcagcgtagcctgcctagtccctagacccctagccagctccaaggggaggcacctccaagcaggccaggctactcccggggtcgactcggaccgatg

SEQ ID NO: 16006 - DNA, 203 bp, Homo sapiens
ggcgcgccagtcctcaaacgaggttccttcctctgcacctggcctgggccacacccaagtgctgtggactggcccgaggggccctgcacgtggccctgagcacctctcagcgtagcctgcctagtccctagacccctagccagctccaaggggaggcacgtcaattcctttaaggctacctcgggggtcgactcggaccgatg

SEQ ID NO: 16007 - DNA, 203 bp, Homo sapiens
ggcgcgccagtcctgcaaaacgactccttcctctgcacctggcctgggccacacccaagtgctgtggactggcccgaggggccctgcacgtggccctgagcacctctcagcgtagcctgcctagtccctagacccctagccagctccaaggggaggcattcttggcaaagccaggcttcttggcaaatcgactcggaccgatg

SEQ ID NO: 16008 - DNA, 203 bp, Homo sapiens
ggcgcgccagtcctcgagtcgttttccttcctctgcacctggcctgggccacacccaagtgctgtggactggcccgaggggccctgcacgtggccctgagcacctctcagcgtagcctgcctagtccctagacccctagccgtcaattcctttaggcacgtcaattcctttaaggctacctcgggggtcgactcggaccgatg

SEQ ID NO: 16009 - DNA, 203 bp, Homo sapiens
ggcgcgccagtcctcgaaacgaactccttcctctgcacctggcctgggccacacccaagtgctgtggactggcccgaggggccctgcacgtggccctgagcacctctcagcgtagcctgcctagtccctagacccctagctactcccaaggggaggcatactcccgcaggccaggctactcccggggtcgactcggaccgatg

SEQ ID NO: 16010 - DNA, 203 bp, Homo sapiens
ggcgcgccagtccttgcaaacgattccttcctctgcacctggcctgggccacacccaagtgctgtggactggcccgaggggccctgcacgtggccctgagcacctctcagcgtagcctgcctcacggaatcgagaatagccacggaatcgagaaggcacacggaatcgagaaaggctacctcgggggtcgactcggaccgatg

SEQ ID NO: 16011 - DNA, 203 bp, Homo sapiens
ggcgcgccagtcctcgctggtcaatccttcctctgcacctggcctgggccacacccaagtgctgtggactggcccgaggggccctgcacgtggccctgagcacctctcagcgtagcctgcctcgtcaattcctttatagccgtcaattcctttaggcacgtcaattcctttaaggctacctcgggggtcgactcggaccgatg

SEQ ID NO: 16012 - DNA, 203 bp, Homo sapiens
ggcgcgccagtccttaccagctgctccttcctctgcacctggcctgggccacacccaagtgctgtggactggcccgaggggccctgccggcgggtctgagcaccccggcgggtagcctgcctccggcgggtacccctagcccggcgggtggggaggcaccggcgggtaggccaggcccggcgggtggtcgactcggaccgatg

SEQ ID NO: 16013 - DNA, 203 bp, Homo sapiens
ggcgcgccagtcctgtgattaaggtccttcctctgcacctggcctgggccacacccaagtgctgtggattcttggcaaaggccctgttcttggcaaagagcaccttcttggcaaacctgcctttcttggcaaaccctagcttcttggcaaaggaggcattcttggcaaagccaggcttcttggcaaatcgactcggaccgatg

SEQ ID NO: 16014 - DNA, 203 bp, Homo sapiens
ggcgcgccagtccttcttaatttgtctcacggaatcgagaattctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16015 - DNA, 203 bp, Homo sapiens
ggcgcgccagtcctcttaatgccgtctcacggaatcgagaattctgacatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16016 - DNA, 203 bp, Homo sapiens
ggcgcgccagtcctggatctcccatctcgtcaattcctttattctgacatttctgacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 16017 - DNA, 203 bp, Homo sapiens
ggcgcgccagtccttctagcgccctctgacaccggccgtatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16018 - DNA, 203 bp, Homo sapiens
ggcgcgccagtcctgggcgcatgttctgacataccggccgtttctgacataccggccgtttctgacataccggccgtttctgacataccggccgtttctgacataccggccgtttctgacataccggccgtttctgacataccggccgtttctgacataccggccgtttctgacataccggccgtttccgactcggaccgatg

SEQ ID NO: 16019 - DNA, 203 bp, Homo sapiens
ggcgcgccagtccttggcgccctctctgacataccggccgtttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16020 - DNA, 203 bp, Homo sapiens
ggcgcgccagtcctgcgcccaacctctgacataccggccgtttctgacatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16021 - DNA, 203 bp, Homo sapiens
ggcgcgccagtcctgcgccctgtctctgacatcacggaatcgagaaacatcacggaatcgagaaacatcacggaatcgagaaacatcacggaatcgagaaacatcacggaatcgagaaacatcacggaatcgagaaacatcacggaatcgagaaacatttctgacatttctgacatttctgacatttccgactcggaccgatg

SEQ ID NO: 16022 - DNA, 203 bp, Homo sapiens
ggcgcgccagtcctgagattgttctctgacatcacggaatcgagaaacatcacggaatcgagaaacatcacggaatcgagaaacatcacggaatcgagaaacatttctgacatttctgacatcacggaatcgagaaacatcacggaatcgagaaacatttctgacatttctgacatttctgacatttccgactcggaccgatg

SEQ ID NO: 16023 - DNA, 203 bp, Homo sapiens
ggcgcgccagtcctcgaacaatgctctgacatcacggaatcgagaaacatcacggaatcgagaaacatcacggaatcgagaaacatcacggaatcgagaaacatttctgacatttctgacatcacggaatcgagaaacatttctgacatttctgacatcacggaatcgagaaacatttctgacatttccgactcggaccgatg

SEQ ID NO: 16024 - DNA, 203 bp, Homo sapiens
ggcgcgccagtcctactcgccaactctgacatcacggaatcgagaaacatcacggaatcgagaaacatcacggaatcgagaaacatttctgacatttctgacatcacggaatcgagaaacatcacggaatcgagaaacatttctgacatttctgacatttctgacatttctgacatttctgacatttccgactcggaccgatg

SEQ ID NO: 16025 - DNA, 203 bp, Homo sapiens
ggcgcgccagtcctacgttggccttctgacatcacggaatcgagaaacatcacggaatcgagaaacatcacggaatcgagaaacatttctgacatttctgacatcacggaatcgagaaacatttctgacatttctgacatttctgacatttctgacatcacggaatcgagaaacatttctgacatttccgactcggaccgatg

SEQ ID NO: 16026 - DNA, 203 bp, Homo sapiens
ggcgcgccagtcctttggcgaaagtctgacatcacggaatcgagaaacatcacggaatcgagaaacatcacggaatcgagaaacatttctgacatttctgacatttctgacatttctgacatcacggaatcgagaaacatcacggaatcgagaaacatttctgacatttctgacatttctgacatttccgactcggaccgatg

SEQ ID NO: 16027 - DNA, 203 bp, Homo sapiens
ggcgcgccagtccttggccaaccctctgacatcacggaatcgagaaacatcacggaatcgagaaacatcacggaatcgagaaacatttctgacatttctgacatttctgacatttctgacatcacggaatcgagaaacatttctgacatttctgacatcacggaatcgagaaacatttctgacatttccgactcggaccgatg

SEQ ID NO: 16028 - DNA, 203 bp, Homo sapiens
ggcgcgccagtcctgttggcgctctctgacatcacggaatcgagaaacatcacggaatcgagaaacatcacggaatcgagaaacatttctgacatttctgacatttctgacatttctgacatcacggaatcgagaaacatttctgacatttctgacatttctgacatttctgacatttctgacatttccgactcggaccgatg

SEQ ID NO: 16029 - DNA, 203 bp, Homo sapiens
ggcgcgccagtcctaagccaaatatctgacatcacggaatcgagaaacatcacggaatcgagaaacatcacggaatcgagaaacatttctgacatttctgacatttctgacatttctgacatttctgacatttctgacatttctgacatttctgacatttctgacatttctgacatttctgacatttccgactcggaccgatg

SEQ ID NO: 16030 - DNA, 203 bp, Homo sapiens
ggcgcgccagtcctggccaaaccctctgacatcacggaatcgagaaacatcacggaatcgagaaacatttctgacatttctgacatcacggaatcgagaaacatcacggaatcgagaaacatttctgacatttctgacatcacggaatcgagaaacatttctgacatttctgacatttctgacatttccgactcggaccgatg

SEQ ID NO: 16031 - DNA, 203 bp, Homo sapiens
ggcgcgccagtcctatttggcgactctgacatcacggaatcgagaaacatcacggaatcgagaaacatttctgacatttctgacatcacggaatcgagaaacatcacggaatcgagaaacatttctgacatttctgacatttctgacatttctgacatttctgacatttctgacatttctgacatttccgactcggaccgatg

SEQ ID NO: 16032 - DNA, 203 bp, Homo sapiens
ggcgcgccagtcctcgttggcgcgtctgacatcacggaatcgagaaacatcacggaatcgagaaacatttctgacatttctgacatcacggaatcgagaaacatttctgacatttctgacatcacggaatcgagaaacatcacggaatcgagaaacatttctgacatttctgacatttctgacatttccgactcggaccgatg

SEQ ID NO: 16033 - DNA, 203 bp, Homo sapiens
ggcgcgccagtccttcttgccaaatctgacatcacggaatcgagaaacatttctgacatttctgacatcacggaatcgagaaacatcacggaatcgagaaacatcacggaatcgagaaacatcacggaatcgagaaacatcacggaatcgagaaacatttctgacatttctgacatttctgacatttccgactcggaccgatg

SEQ ID NO: 16034 - DNA, 203 bp, Homo sapiens
ggcgcgccagtcctttggctgccatctgacatcacggaatcgagaaacatttctgacatttctgacatcacggaatcgagaaacatcacggaatcgagaaacatttctgacatttctgacatcacggaatcgagaaacatcacggaatcgagaaacatcacggaatcgagaaacatttctgacatttccgactcggaccgatg

SEQ ID NO: 16035 - DNA, 203 bp, Homo sapiens
ggcgcgccagtccttttggcctgatctgacatcacggaatcgagaaacatttctgacatttctgacatcacggaatcgagaaacatcacggaatcgagaaacatttctgacatttctgacatcacggaatcgagaaacatttctgacatttctgacatcacggaatcgagaaacatttctgacatttccgactcggaccgatg

SEQ ID NO: 16036 - DNA, 203 bp, Homo sapiens
ggcgcgccagtcctgccaaacttctctgacatcacggaatcgagaaacatttctgacatttctgacatcacggaatcgagaaacatcacggaatcgagaaacatttctgacatttctgacatcacggaatcgagaaacatttctgacatttctgacatttctgacatttctgacatttctgacatttccgactcggaccgatg

SEQ ID NO: 16037 - DNA, 203 bp, Homo sapiens
ggcgcgccagtcctagtgagacactctgacatcacggaatcgagaaacatttctgacatttctgacatcacggaatcgagaaacatttctgacatttctgacatcacggaatcgagaaacatcacggaatcgagaaacatttctgacatttctgacatcacggaatcgagaaacatttctgacatttccgactcggaccgatg

SEQ ID NO: 16038 - DNA, 203 bp, Homo sapiens
ggcgcgccagtcctgtctgtgtcttctgacatcacggaatcgagaaacatttctgacatttctgacatcacggaatcgagaaacatttctgacatttctgacatttctgacatttctgacatcacggaatcgagaaacatttctgacatttctgacatcacggaatcgagaaacatttctgacatttccgactcggaccgatg

SEQ ID NO: 16039 - DNA, 203 bp, Homo sapiens
ggcgcgccagtcctccgtgtctgatctgacatcacggaatcgagaaacatttctgacatttctgacatttctgacatttctgacatcacggaatcgagaaacatcacggaatcgagaaacatttctgacatttctgacatcacggaatcgagaaacatcacggaatcgagaaacatttctgacatttccgactcggaccgatg

SEQ ID NO: 16040 - DNA, 203 bp, Homo sapiens
ggcgcgccagtcctactgtgtctatctgacatcacggaatcgagaaacatttctgacatttctgacatttctgacatttctgacatcacggaatcgagaaacatcacggaatcgagaaacatttctgacatttctgacatttctgacatttctgacatcacggaatcgagaaacatttctgacatttccgactcggaccgatg

SEQ ID NO: 16041 - DNA, 203 bp, Homo sapiens
ggcgcgccagtcctagtgtctgtgtctgacatcacggaatcgagaaacatttctgacatttctgacatttctgacatttctgacatcacggaatcgagaaacatcacggaatcgagaaacatttctgacatttctgacatttctgacatttctgacatttctgacatttctgacatttctgacatttccgactcggaccgatg

SEQ ID NO: 16042 - DNA, 203 bp, Homo sapiens
ggcgcgccagtcctctcgcgcccatctgacatcacggaatcgagaaacatttctgacatttctgacatttctgacatttctgacatttctgacatttctgacatcacggaatcgagaaacatttctgacatttctgacatttctgacatttctgacatttctgacatttctgacatttctgacatttccgactcggaccgatg

SEQ ID NO: 16043 - DNA, 203 bp, Homo sapiens
ggcgcgccagtccttatcgcgggatctgacatcacggaatcgagaaacatttctgacatttctgacatttctgacatttctgacatttctgacatttctgacatttctgacatttctgacatttctgacatttctgacatcacggaatcgagaaacatcacggaatcgagaaacatttctgacatttccgactcggaccgatg

SEQ ID NO: 16044 - DNA, 203 bp, Homo sapiens
ggcgcgccagtcctctcgcgggactctgacatcacggaatcgagaaacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16045 - DNA, 203 bp, Homo sapiens
ggcgcgccagtcctctgcccgcgttctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16046 - DNA, 203 bp, Homo sapiens
ggcgcgccagtcctgcccgcctaatctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16047 - DNA, 203 bp, Homo sapiens
ggcgcgccagtcctaggcgggtcctctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16048 - DNA, 203 bp, Homo sapiens
ggcgcgccagtcctagttagatcatctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16049 - DNA, 203 bp, Homo sapiens
ggcgcgccagtcctgagccgggcttctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16050 - DNA, 203 bp, Homo sapiens
ggcgcgccagtcctcgccggtctctctgacatccggcgggtttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16051 - DNA, 203 bp, Homo sapiens
ggcgcgccagtccttacttgccggtctgacatcgtcaattcctttaacatcgtcaattcctttaacatcgtcaattcctttaacatcgtcaattcctttaacatcgtcaattcctttaacatcgtcaattcctttaacatcgtcaattcctttaacatttctgacatttctgacatttctgacatttccgactcggaccgatg

SEQ ID NO: 16052 - DNA, 203 bp, Homo sapiens
ggcgcgccagtcctctggtgccggtctgacatcgtcaattcctttaacatcgtcaattcctttaacatcgtcaattcctttaacatcgtcaattcctttaacatcgtcaattcctttaacatcgtcaattcctttaacatttctgacatttctgacatttctgacatttctgacatttctgacatttccgactcggaccgatg

SEQ ID NO: 16053 - DNA, 203 bp, Homo sapiens
ggcgcgccagtccttgccggtcgttctgacatcgtcaattcctttaacatcgtcaattcctttaacatcgtcaattcctttaacatcgtcaattcctttaacatcgtcaattcctttaacatttctgacatttctgacatcgtcaattcctttaacatttctgacatttctgacatttctgacatttccgactcggaccgatg

SEQ ID NO: 16054 - DNA, 203 bp, Homo sapiens
ggcgcgccagtcctaggcagccggtctgacatcgtcaattcctttaacatcgtcaattcctttaacatcgtcaattcctttaacatcgtcaattcctttaacatttctgacatttctgacatcgtcaattcctttaacatcgtcaattcctttaacatcgtcaattcctttaacatttctgacatttccgactcggaccgatg

SEQ ID NO: 16055 - DNA, 203 bp, Homo sapiens
ggcgcgccagtcctgataccggcgtctgacatcgtcaattcctttaacatcgtcaattcctttaacatcgtcaattcctttaacatcgtcaattcctttaacatttctgacatttctgacatcgtcaattcctttaacatttctgacatttctgacatcgtcaattcctttaacatttctgacatttccgactcggaccgatg

SEQ ID NO: 16056 - DNA, 203 bp, Homo sapiens
ggcgcgccagtcctccggctaatctctgacatcgtcaattcctttaacatcgtcaattcctttaacatcgtcaattcctttaacatcgtcaattcctttaacatttctgacatttctgacatcgtcaattcctttaacatttctgacatttctgacatttctgacatttctgacatttctgacatttccgactcggaccgatg

SEQ ID NO: 16057 - DNA, 203 bp, Homo sapiens
ggcgcgccagtccttcgccggcattctgacatcgtcaattcctttaacatcgtcaattcctttaacatcgtcaattcctttaacatcgtcaattcctttaacatttctgacatttctgacatttctgacatttctgacatcgtcaattcctttaacatcgtcaattcctttaacatttctgacatttccgactcggaccgatg

SEQ ID NO: 16058 - DNA, 203 bp, Homo sapiens
ggcgcgccagtcctacgtaccggctctgacatcgtcaattcctttaacatcgtcaattcctttaacatcgtcaattcctttaacatcgtcaattcctttaacatttctgacatttctgacatttctgacatttctgacatttctgacatttctgacatcgtcaattcctttaacatttctgacatttccgactcggaccgatg

SEQ ID NO: 16059 - DNA, 203 bp, Homo sapiens
ggcgcgccagtcctaccgtccggctctgacatcgtcaattcctttaacatcgtcaattcctttaacatcgtcaattcctttaacatttctgacatttctgacatcgtcaattcctttaacatcgtcaattcctttaacatcgtcaattcctttaacatttctgacatttctgacatttctgacatttccgactcggaccgatg

SEQ ID NO: 16060 - DNA, 203 bp, Homo sapiens
ggcgcgccagtcctaacaaccggctctgacatcgtcaattcctttaacatcgtcaattcctttaacatcgtcaattcctttaacatttctgacatttctgacatcgtcaattcctttaacatcgtcaattcctttaacatttctgacatttctgacatcgtcaattcctttaacatttctgacatttccgactcggaccgatg

SEQ ID NO: 16061 - DNA, 203 bp, Homo sapiens
ggcgcgccagtcctcgccggcacttctgacatcgtcaattcctttaacatcgtcaattcctttaacatcgtcaattcctttaacatttctgacatttctgacatcgtcaattcctttaacatcgtcaattcctttaacatttctgacatttctgacatttctgacatttctgacatttctgacatttccgactcggaccgatg

SEQ ID NO: 16062 - DNA, 203 bp, Homo sapiens
ggcgcgccagtcctgaagccggcttctgacatcgtcaattcctttaacatcgtcaattcctttaacatcgtcaattcctttaacatttctgacatttctgacatcgtcaattcctttaacatttctgacatttctgacatttctgacatttctgacatttctgacatttctgacatttctgacatttccgactcggaccgatg

SEQ ID NO: 16063 - DNA, 203 bp, Homo sapiens
ggcgcgccagtcctttcgagcgggtctgacatcgtcaattcctttaacatcgtcaattcctttaacatcgtcaattcctttaacatttctgacatttctgacatttctgacatttctgacatttctgacatttctgacatcgtcaattcctttaacatttctgacatttctgacatttctgacatttccgactcggaccgatg

SEQ ID NO: 16064 - DNA, 203 bp, Homo sapiens
ggcgcgccagtcctatcgagctgttctgacatcgtcaattcctttaacatcgtcaattcctttaacatttctgacatttctgacatcgtcaattcctttaacatcgtcaattcctttaacatttctgacatttctgacatcgtcaattcctttaacatcgtcaattcctttaacatttctgacatttccgactcggaccgatg

SEQ ID NO: 16065 - DNA, 203 bp, Homo sapiens
ggcgcgccagtcctttcgagcttatctgacatcgtcaattcctttaacatcgtcaattcctttaacatttctgacatttctgacatcgtcaattcctttaacatcgtcaattcctttaacatttctgacatttctgacatcgtcaattcctttaacatttctgacatttctgacatttctgacatttccgactcggaccgatg

SEQ ID NO: 16066 - DNA, 203 bp, Homo sapiens
ggcgcgccagtccttatcgagctctctgacatcgtcaattcctttaacatcgtcaattcctttaacatttctgacatttctgacatcgtcaattcctttaacatcgtcaattcctttaacatttctgacatttctgacatttctgacatttctgacatcgtcaattcctttaacatttctgacatttccgactcggaccgatg

SEQ ID NO: 16067 - DNA, 203 bp, Homo sapiens
ggcgcgccagtcctaagctcgacgtctgacatcgtcaattcctttaacatcgtcaattcctttaacatttctgacatttctgacatcgtcaattcctttaacatttctgacatttctgacatcgtcaattcctttaacatttctgacatttctgacatttctgacatttctgacatttctgacatttccgactcggaccgatg

SEQ ID NO: 16068 - DNA, 203 bp, Homo sapiens
ggcgcgccagtcctggctcgaccatctgacatcgtcaattcctttaacatcgtcaattcctttaacatttctgacatttctgacatcgtcaattcctttaacatttctgacatttctgacatttctgacatttctgacatcgtcaattcctttaacatcgtcaattcctttaacatttctgacatttccgactcggaccgatg

SEQ ID NO: 16069 - DNA, 203 bp, Homo sapiens
ggcgcgccagtcctgagacgctgctctgacatcgtcaattcctttaacatcgtcaattcctttaacatttctgacatttctgacatttctgacatttctgacatttctgacatttctgacatcgtcaattcctttaacatttctgacatttctgacatcgtcaattcctttaacatttctgacatttccgactcggaccgatg

SEQ ID NO: 16070 - DNA, 203 bp, Homo sapiens
ggcgcgccagtcctatagcgtctatctgacatcgtcaattcctttaacatcgtcaattcctttaacatttctgacatttctgacatttctgacatttctgacatttctgacatttctgacatttctgacatttctgacatcgtcaattcctttaacatttctgacatttctgacatttctgacatttccgactcggaccgatg

SEQ ID NO: 16071 - DNA, 203 bp, Homo sapiens
ggcgcgccagtccttgcgtctaagtctgacatcgtcaattcctttaacatcgtcaattcctttaacatttctgacatttctgacatttctgacatttctgacatttctgacatttctgacatttctgacatttctgacatttctgacatttctgacatcgtcaattcctttaacatttctgacatttccgactcggaccgatg

SEQ ID NO: 16072 - DNA, 203 bp, Homo sapiens
ggcgcgccagtcctcgggcgtctttctgacatcgtcaattcctttaacatttctgacatttctgacatcgtcaattcctttaacatcgtcaattcctttaacatcgtcaattcctttaacatttctgacatttctgacatcgtcaattcctttaacatttctgacatttctgacatttctgacatttccgactcggaccgatg

SEQ ID NO: 16073 - DNA, 203 bp, Homo sapiens
ggcgcgccagtcctgcgtctttaatctgacatcgtcaattcctttaacatttctgacatttctgacatcgtcaattcctttaacatcgtcaattcctttaacatcgtcaattcctttaacatttctgacatttctgacatttctgacatttctgacatttctgacatttctgacatttctgacatttccgactcggaccgatg

SEQ ID NO: 16074 - DNA, 203 bp, Homo sapiens
ggcgcgccagtcctacaggcaaaatctgacatcgtcaattcctttaacatttctgacatttctgacatcgtcaattcctttaacatcgtcaattcctttaacatttctgacatttctgacatcgtcaattcctttaacatcgtcaattcctttaacatttctgacatttctgacatttctgacatttccgactcggaccgatg

SEQ ID NO: 16075 - DNA, 203 bp, Homo sapiens
ggcgcgccagtcctaccgatcggatctgacatcgtcaattcctttaacatttctgacatttctgacatcgtcaattcctttaacatcgtcaattcctttaacatttctgacatttctgacatttctgacatttctgacatcgtcaattcctttaacatttctgacatttctgacatttctgacatttccgactcggaccgatg

SEQ ID NO: 16076 - DNA, 203 bp, Homo sapiens
ggcgcgccagtcctacatgtcggatctgacatcgtcaattcctttaacatttctgacatttctgacatcgtcaattcctttaacatcgtcaattcctttaacatttctgacatttctgacatttctgacatttctgacatttctgacatttctgacatcgtcaattcctttaacatttctgacatttccgactcggaccgatg

SEQ ID NO: 16077 - DNA, 203 bp, Homo sapiens
ggcgcgccagtcctcctactcggatctgacatcgtcaattcctttaacatttctgacatttctgacatcgtcaattcctttaacatttctgacatttctgacatcgtcaattcctttaacatcgtcaattcctttaacatcgtcaattcctttaacatcgtcaattcctttaacatttctgacatttccgactcggaccgatg

SEQ ID NO: 16078 - DNA, 203 bp, Homo sapiens
ggcgcgccagtcctcgatctcggatctgacatcgtcaattcctttaacatttctgacatttctgacatcgtcaattcctttaacatttctgacatttctgacatcgtcaattcctttaacatcgtcaattcctttaacatttctgacatttctgacatttctgacatttctgacatttctgacatttccgactcggaccgatg

SEQ ID NO: 16079 - DNA, 203 bp, Homo sapiens
ggcgcgccagtccttccgaatgcctctgacatcgtcaattcctttaacatttctgacatttctgacatcgtcaattcctttaacatttctgacatttctgacatcgtcaattcctttaacatttctgacatttctgacatcgtcaattcctttaacatttctgacatttctgacatttctgacatttccgactcggaccgatg

SEQ ID NO: 16080 - DNA, 203 bp, Homo sapiens
ggcgcgccagtcctgtagctcggatctgacatcgtcaattcctttaacatttctgacatttctgacatcgtcaattcctttaacatttctgacatttctgacatttctgacatttctgacatcgtcaattcctttaacatcgtcaattcctttaacatcgtcaattcctttaacatttctgacatttccgactcggaccgatg

SEQ ID NO: 16081 - DNA, 203 bp, Homo sapiens
ggcgcgccagtccttccgacgccctctgacatcgtcaattcctttaacatttctgacatttctgacatcgtcaattcctttaacatttctgacatttctgacatttctgacatttctgacatttctgacatttctgacatcgtcaattcctttaacatcgtcaattcctttaacatttctgacatttccgactcggaccgatg

SEQ ID NO: 16082 - DNA, 203 bp, Homo sapiens
ggcgcgccagtcctcgtcgccggatctgacatcgtcaattcctttaacatttctgacatttctgacatcgtcaattcctttaacatttctgacatttctgacatttctgacatttctgacatttctgacatttctgacatttctgacatttctgacatcgtcaattcctttaacatttctgacatttccgactcggaccgatg

SEQ ID NO: 16083 - DNA, 203 bp, Homo sapiens
ggcgcgccagtccttccggtctgatctgacatcgtcaattcctttaacatttctgacatttctgacatcgtcaattcctttaacatttctgacatttctgacatttctgacatttctgacatttctgacatttctgacatttctgacatttctgacatttctgacatttctgacatttctgacatttccgactcggaccgatg

SEQ ID NO: 16084 - DNA, 203 bp, Homo sapiens
ggcgcgccagtcctaagtgcgccctctgacatcgtcaattcctttaacatttctgacatttctgacatttctgacatttctgacatcgtcaattcctttaacatcgtcaattcctttaacatttctgacatttctgacatttctgacatttctgacatcgtcaattcctttaacatttctgacatttccgactcggaccgatg

SEQ ID NO: 16085 - DNA, 203 bp, Homo sapiens
ggcgcgccagtcctcgtagatagttctgacatcgtcaattcctttaacatttctgacatttctgacatttctgacatttctgacatcgtcaattcctttaacatttctgacatttctgacatcgtcaattcctttaacatcgtcaattcctttaacatttctgacatttctgacatttctgacatttccgactcggaccgatg

SEQ ID NO: 16086 - DNA, 203 bp, Homo sapiens
ggcgcgccagtccttaacaatctttctgacatcgtcaattcctttaacatttctgacatttctgacatttctgacatttctgacatcgtcaattcctttaacatttctgacatttctgacatcgtcaattcctttaacatttctgacatttctgacatcgtcaattcctttaacatttctgacatttccgactcggaccgatg

SEQ ID NO: 16087 - DNA, 203 bp, Homo sapiens
ggcgcgccagtcctctaacaatcgtctgacatcgtcaattcctttaacatttctgacatttctgacatttctgacatttctgacatcgtcaattcctttaacatttctgacatttctgacatttctgacatttctgacatcgtcaattcctttaacatcgtcaattcctttaacatttctgacatttccgactcggaccgatg

SEQ ID NO: 16088 - DNA, 203 bp, Homo sapiens
ggcgcgccagtcctccttgtgggttctgacatcgtcaattcctttaacatttctgacatttctgacatttctgacatttctgacatcgtcaattcctttaacatttctgacatttctgacatttctgacatttctgacatttctgacatttctgacatcgtcaattcctttaacatttctgacatttccgactcggaccgatg

SEQ ID NO: 16089 - DNA, 203 bp, Homo sapiens
ggcgcgccagtccttaacccacattctgacatcgtcaattcctttaacatttctgacatttctgacatttctgacatttctgacatttctgacatttctgacatcgtcaattcctttaacatcgtcaattcctttaacatcgtcaattcctttaacatttctgacatttctgacatttctgacatttccgactcggaccgatg

SEQ ID NO: 16090 - DNA, 203 bp, Homo sapiens
ggcgcgccagtcctttgttgccgttctgacatcgtcaattcctttaacatttctgacatttctgacatttctgacatttctgacatttctgacatttctgacatcgtcaattcctttaacatttctgacatttctgacatcgtcaattcctttaacatcgtcaattcctttaacatttctgacatttccgactcggaccgatg

SEQ ID NO: 16091 - DNA, 203 bp, Homo sapiens
ggcgcgccagtccttacggctccctctgacatcgtcaattcctttaacatttctgacatttctgacatttctgacatttctgacatttctgacatttctgacatttctgacatttctgacatcgtcaattcctttaacatcgtcaattcctttaacatcgtcaattcctttaacatttctgacatttccgactcggaccgatg

SEQ ID NO: 16092 - DNA, 203 bp, Homo sapiens
ggcgcgccagtcctccgaggccgttctgacatcgtcaattcctttaacatttctgacatttctgacatttctgacatttctgacatttctgacatttctgacatttctgacatttctgacatcgtcaattcctttaacatttctgacatttctgacatcgtcaattcctttaacatttctgacatttccgactcggaccgatg

SEQ ID NO: 16093 - DNA, 203 bp, Homo sapiens
ggcgcgccagtcctggccacggcttctgacatcgtcaattcctttaacatttctgacatttctgacatttctgacatttctgacatttctgacatttctgacatttctgacatttctgacatcgtcaattcctttaacatttctgacatttctgacatttctgacatttctgacatttctgacatttccgactcggaccgatg

SEQ ID NO: 16094 - DNA, 203 bp, Homo sapiens
ggcgcgccagtcctttggccgtattctgacatcgtcaattcctttaacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16095 - DNA, 203 bp, Homo sapiens
ggcgcgccagtccttggacggcagtctgacattactcccatttctgacattactcccatttctgacattactcccatttctgacattactcccatttctgacattactcccatttctgacattactcccatttctgacattactcccatttctgacattactcccatttctgacattactcccatttccgactcggaccgatg

SEQ ID NO: 16096 - DNA, 203 bp, Homo sapiens
ggcgcgccagtcctaggtacggcatctgacattactcccatttctgacatttctgacatttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16097 - DNA, 203 bp, Homo sapiens
ggcgcgccagtcctatgccgtcgttctgacattactcccatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16098 - DNA, 203 bp, Homo sapiens
ggcgcgccagtcctgccgtacacttctgacatttcaccggccgttgacatttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16099 - DNA, 203 bp, Homo sapiens
ggcgcgccagtcctctacagccgttctgacatttcacggaatcgagaaatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16100 - DNA, 203 bp, Homo sapiens
ggcgcgccagtcctgccgtagatatctgacatttcacggaatcgagaaatttctgacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16101 - DNA, 203 bp, Homo sapiens
ggcgcgccagtcctaacggcacgatctgacatttcccggcgggttgacatttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16102 - DNA, 203 bp, Homo sapiens
ggcgcgccagtcctagagaacggctctgacatttctgacaccggccgtatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16103 - DNA, 203 bp, Homo sapiens
ggcgcgccagtccttagaaacggctctgacatttctgacatcacggaatcgagaaacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16104 - DNA, 203 bp, Homo sapiens
ggcgcgccagtcctagaggccgtgtctgacatttctgacatcacggaatcgagaaacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16105 - DNA, 203 bp, Homo sapiens
ggcgcgccagtcctgccgtgttgttctgacatttctgacatcgtcaattcctttaacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16106 - DNA, 203 bp, Homo sapiens
ggcgcgccagtcctggccgtgtcatctgacatttctgacatcgtcaattcctttaacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16107 - DNA, 203 bp, Homo sapiens
ggcgcgccagtcctagtgccgttttctgacatttctgacatcgtcaattcctttaacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16108 - DNA, 203 bp, Homo sapiens
ggcgcgccagtcctgtaacggcggtctgacatttctgacatcgtcaattcctttaacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 16109 - DNA, 203 bp, Homo sapiens
ggcgcgccagtcctgattgccgtatctgacatttctgacattactcccatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16110 - DNA, 203 bp, Homo sapiens
ggcgcgccagtcctcaaggacggctctgacatttctgacattccggcgggttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16111 - DNA, 203 bp, Homo sapiens
ggcgcgccagtcctcgctgacggctctgacatttctgacatttcaccggccgttgacatttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16112 - DNA, 203 bp, Homo sapiens
ggcgcgccagtcctcttgccgtactctgacatttctgacatttccacggaatcgagaatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16113 - DNA, 203 bp, Homo sapiens
ggcgcgccagtcctctcacacggctctgacatttctgacatttcccggcgggttgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16114 - DNA, 203 bp, Homo sapiens
ggcgcgccagtcctcaacggctgttctgacatttctgacatttccgtcaattcctttatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16115 - DNA, 203 bp, Homo sapiens
ggcgcgccagtccttcacggcaaatctgacatttctgacatttctcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaattttccgactcggaccgatg

SEQ ID NO: 16116 - DNA, 203 bp, Homo sapiens
ggcgcgccagtccttgcacggcgttctgacatttctgacatttctgaaagtttcagctttgcaaccatactccccccggaacccaaagactttggtttcccggaagctgcccggcgggtcatgggaataacgccgccgcatcgccggtcggcatcgtttatggtcggaactacgacggtatacatttccgactcggaccgatg

SEQ ID NO: 16117 - DNA, 203 bp, Homo sapiens
ggcgcgccagtcctcctgaacggctctgacatttctgacatttctgacaaccggccgttttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16118 - DNA, 203 bp, Homo sapiens
ggcgcgccagtcctctgtgccgtgtctgacatttctgacatttctgacaactacgacggtatctgatcgtcttcgaacctccgactttcgttcttgattaatgaaaacattcttggcaaatgctttcgctctggtccgtcttgcgccggtccaagaatttcacctctagcggcgcaatacgacatttccgactcggaccgatg

SEQ ID NO: 16119 - DNA, 203 bp, Homo sapiens
ggcgcgccagtcctcgtggccgtttctgacatttctgacatttctgacaagaggagcgagcgaccaaaggaaccataactgatttaatgagccattcgcagtttcactgtaccggccgtgcgtactcagacatgcatggcttaatctttgagacaagcatatgctactggcaggatcaatgacatttccgactcggaccgatg

SEQ ID NO: 16120 - DNA, 203 bp, Homo sapiens
ggcgcgccagtcctgccgtatgtttctgacatttctgacatttctgacaccggcgggttttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16121 - DNA, 203 bp, Homo sapiens
ggcgcgccagtcctagacggcgtctctgacatttctgacatttctgacagtttcagctttgcaaccatactccccccggaacccaaagactttggtttcccggaagctgcccggcgggtcatgggaataacgccgccgcatcgccggtcggcatcgtttatggtcggaactacgacggttgacatttccgactcggaccgatg

SEQ ID NO: 16122 - DNA, 203 bp, Homo sapiens
ggcgcgccagtcctatacggctggtctgacatttctgacatttctgacataccggccgtttctgacataccggccgtttctgacataccggccgtttctgacataccggccgtttctgacataccggccgtttctgacatttctgacatttctgacatttctgacatttctgacataccggccgtttccgactcggaccgatg

SEQ ID NO: 16123 - DNA, 203 bp, Homo sapiens
ggcgcgccagtccttgccgtaggctctgacatttctgacatttctgacataccggccgtttctgacataccggccgtttctgacataccggccgtttctgacataccggccgtttctgacatttctgacatttctgacataccggccgtttctgacataccggccgtttctgacataccggccgtttccgactcggaccgatg

SEQ ID NO: 16124 - DNA, 203 bp, Homo sapiens
ggcgcgccagtccttacggctaaatctgacatttctgacatttctgacataccggccgtttctgacataccggccgtttctgacataccggccgtttctgacataccggccgtttctgacatttctgacatttctgacataccggccgtttctgacataccggccgtttctgacatttctgacatttccgactcggaccgatg

SEQ ID NO: 16125 - DNA, 203 bp, Homo sapiens
ggcgcgccagtccttaacggcccatctgacatttctgacatttctgacataccggccgtttctgacataccggccgtttctgacataccggccgtttctgacataccggccgtttctgacatttctgacatttctgacatttctgacatttctgacatttctgacatttctgacatttctgacatttccgactcggaccgatg

SEQ ID NO: 16126 - DNA, 203 bp, Homo sapiens
ggcgcgccagtcctgcttagccgttctgacatttctgacatttctgacataccggccgtttctgacataccggccgtttctgacataccggccgtttctgacatttctgacatttctgacataccggccgtttctgacataccggccgtttctgacataccggccgtttctgacataccggccgtttccgactcggaccgatg

SEQ ID NO: 16127 - DNA, 203 bp, Homo sapiens
ggcgcgccagtcctctacggcatttctgacatttctgacatttctgacataccggccgtttctgacataccggccgtttctgacataccggccgtttctgacatttctgacatttctgacataccggccgtttctgacataccggccgtttctgacataccggccgtttctgacatttctgacatttccgactcggaccgatg

SEQ ID NO: 16128 - DNA, 203 bp, Homo sapiens
ggcgcgccagtcctgccgtgaacctctgacatttctgacatttctgacataccggccgtttctgacataccggccgtttctgacataccggccgtttctgacatttctgacatttctgacataccggccgtttctgacatttctgacatttctgacataccggccgtttctgacataccggccgtttccgactcggaccgatg

SEQ ID NO: 16129 - DNA, 203 bp, Homo sapiens
ggcgcgccagtcctgcagacggcgtctgacatttctgacatttctgacataccggccgtttctgacataccggccgtttctgacataccggccgtttctgacatttctgacatttctgacataccggccgtttctgacatttctgacatttctgacatttctgacatttctgacatttctgacatttccgactcggaccgatg

SEQ ID NO: 16130 - DNA, 203 bp, Homo sapiens
ggcgcgccagtcctcgtgacggcgtctgacatttctgacatttctgacataccggccgtttctgacataccggccgtttctgacataccggccgtttctgacatttctgacatttctgacatttctgacatttctgacataccggccgtttctgacataccggccgtttctgacataccggccgtttccgactcggaccgatg

SEQ ID NO: 16131 - DNA, 203 bp, Homo sapiens
ggcgcgccagtcctatatgccgtttctgacatttctgacatttctgacataccggccgtttctgacataccggccgtttctgacataccggccgtttctgacatttctgacatttctgacatttctgacatttctgacataccggccgtttctgacatttctgacatttctgacataccggccgtttccgactcggaccgatg

SEQ ID NO: 16132 - DNA, 203 bp, Homo sapiens
ggcgcgccagtcctacggcacacctctgacatttctgacatttctgacataccggccgtttctgacataccggccgtttctgacataccggccgtttctgacatttctgacatttctgacatttctgacatttctgacataccggccgtttctgacatttctgacatttctgacatttctgacatttccgactcggaccgatg

SEQ ID NO: 16133 - DNA, 203 bp, Homo sapiens
ggcgcgccagtcctcccttgccgttctgacatttctgacatttctgacataccggccgtttctgacataccggccgtttctgacataccggccgtttctgacatttctgacatttctgacatttctgacatttctgacatttctgacatttctgacatttctgacatttctgacataccggccgtttccgactcggaccgatg

SEQ ID NO: 16134 - DNA, 203 bp, Homo sapiens
ggcgcgccagtcctcgccgtgctatctgacatttctgacatttctgacataccggccgtttctgacataccggccgtttctgacatttctgacatttctgacataccggccgtttctgacataccggccgtttctgacataccggccgtttctgacataccggccgtttctgacataccggccgtttccgactcggaccgatg

SEQ ID NO: 16135 - DNA, 203 bp, Homo sapiens
ggcgcgccagtcctcaggtgggtctctgacatttctgacatttctgacataccggccgtttctgacataccggccgtttctgacatttctgacatttctgacataccggccgtttctgacataccggccgtttctgacataccggccgtttctgacataccggccgtttctgacatttctgacatttccgactcggaccgatg

SEQ ID NO: 16136 - DNA, 203 bp, Homo sapiens
ggcgcgccagtcctatggtgggcctctgacatttctgacatttctgacataccggccgtttctgacataccggccgtttctgacatttctgacatttctgacataccggccgtttctgacataccggccgtttctgacataccggccgtttctgacatttctgacatttctgacatttctgacatttccgactcggaccgatg

SEQ ID NO: 16137 - DNA, 203 bp, Homo sapiens
ggcgcgccagtcctcttggtgggctctgacatttctgacatttctgacataccggccgtttctgacataccggccgtttctgacatttctgacatttctgacataccggccgtttctgacataccggccgtttctgacatttctgacatttctgacatttctgacatttctgacataccggccgtttccgactcggaccgatg

SEQ ID NO: 16138 - DNA, 203 bp, Homo sapiens
ggcgcgccagtcctgttagggccgtctgacatttctgacatttctgacataccggccgtttctgacataccggccgtttctgacatttctgacatttctgacataccggccgtttctgacatttctgacatttctgacatttctgacatttctgacatttctgacatttctgacataccggccgtttccgactcggaccgatg

SEQ ID NO: 16139 - DNA, 203 bp, Homo sapiens
ggcgcgccagtcctttgccctaagtctgacatttctgacatttctgacataccggccgtttctgacataccggccgtttctgacatttctgacatttctgacataccggccgtttctgacatttctgacatttctgacatttctgacatttctgacatttctgacatttctgacatttctgacatttccgactcggaccgatg

SEQ ID NO: 16140 - DNA, 203 bp, Homo sapiens
ggcgcgccagtcctgccctaatcatctgacatttctgacatttctgacataccggccgtttctgacataccggccgtttctgacatttctgacatttctgacatttctgacatttctgacataccggccgtttctgacataccggccgtttctgacataccggccgtttctgacatttctgacatttccgactcggaccgatg

SEQ ID NO: 16141 - DNA, 203 bp, Homo sapiens
ggcgcgccagtcctttgttagggctctgacatttctgacatttctgacataccggccgtttctgacataccggccgtttctgacatttctgacatttctgacatttctgacatttctgacataccggccgtttctgacataccggccgtttctgacatttctgacatttctgacatttctgacatttccgactcggaccgatg

SEQ ID NO: 16142 - DNA, 203 bp, Homo sapiens
ggcgcgccagtcctagtatcccggtctgacatttctgacatttctgacataccggccgtttctgacataccggccgtttctgacatttctgacatttctgacatttctgacatttctgacataccggccgtttctgacatttctgacatttctgacataccggccgtttctgacatttctgacatttccgactcggaccgatg

SEQ ID NO: 16143 - DNA, 203 bp, Homo sapiens
ggcgcgccagtcctctttgcccggtctgacatttctgacatttctgacataccggccgtttctgacataccggccgtttctgacatttctgacatttctgacatttctgacatttctgacataccggccgtttctgacatttctgacatttctgacatttctgacatttctgacataccggccgtttccgactcggaccgatg

SEQ ID NO: 16144 - DNA, 203 bp, Homo sapiens
ggcgcgccagtcctttgggcccggtctgacatttctgacatttctgacataccggccgtttctgacataccggccgtttctgacatttctgacatttctgacatttctgacatttctgacatttctgacatttctgacataccggccgtttctgacataccggccgtttctgacataccggccgtttccgactcggaccgatg

SEQ ID NO: 16145 - DNA, 203 bp, Homo sapiens
ggcgcgccagtcctaagcgcgctgtctgacatttctgacatttctgacataccggccgtttctgacataccggccgtttctgacatttctgacatttctgacatttctgacatttctgacatttctgacatttctgacatttctgacatttctgacataccggccgtttctgacatttctgacatttccgactcggaccgatg

SEQ ID NO: 16146 - DNA, 203 bp, Homo sapiens
ggcgcgccagtcctagaggcgcgctctgacatttctgacatttctgacataccggccgtttctgacataccggccgtttctgacatttctgacatttctgacatttctgacatttctgacatttctgacatttctgacatttctgacatttctgacatttctgacatttctgacataccggccgtttccgactcggaccgatg

SEQ ID NO: 16147 - DNA, 203 bp, Homo sapiens
ggcgcgccagtcctcaactgactctctgacatttctgacatttctgacataccggccgtttctgacataccggccgtttctgacatttctgacatttctgacatttctgacatttctgacatttctgacatttctgacatttctgacatttctgacatttctgacatttctgacatttctgacatttccgactcggaccgatg

SEQ ID NO: 16148 - DNA, 203 bp, Homo sapiens
ggcgcgccagtcctcatgagtcagtctgacatttctgacatttctgacataccggccgtttctgacatttctgacatttctgacataccggccgtttctgacataccggccgtttctgacataccggccgtttctgacataccggccgtttctgacataccggccgtttctgacataccggccgtttccgactcggaccgatg

SEQ ID NO: 16149 - DNA, 203 bp, Homo sapiens
ggcgcgccagtcctgagtcatggatctgacatttctgacatttctgacataccggccgtttctgacatttctgacatttctgacataccggccgtttctgacataccggccgtttctgacataccggccgtttctgacataccggccgtttctgacataccggccgtttctgacatttctgacatttccgactcggaccgatg

SEQ ID NO: 16150 - DNA, 203 bp, Homo sapiens
ggcgcgccagtcctatctgactcgtctgacatttctgacatttctgacataccggccgtttctgacatttctgacatttctgacataccggccgtttctgacataccggccgtttctgacataccggccgtttctgacataccggccgtttctgacatttctgacatttctgacataccggccgtttccgactcggaccgatg

SEQ ID NO: 16151 - DNA, 203 bp, Homo sapiens
ggcgcgccagtccttgactcaagatctgacatttctgacatttctgacataccggccgtttctgacatttctgacatttctgacataccggccgtttctgacataccggccgtttctgacataccggccgtttctgacatttctgacatttctgacataccggccgtttctgacataccggccgtttccgactcggaccgatg

SEQ ID NO: 16152 - DNA, 203 bp, Homo sapiens
ggcgcgccagtcctggagtcatattctgacatttctgacatttctgacataccggccgtttctgacatttctgacatttctgacataccggccgtttctgacataccggccgtttctgacataccggccgtttctgacatttctgacatttctgacatttctgacatttctgacataccggccgtttccgactcggaccgatg

SEQ ID NO: 16153 - DNA, 203 bp, Homo sapiens
ggcgcgccagtccttgactcactttctgacatttctgacatttctgacataccggccgtttctgacatttctgacatttctgacataccggccgtttctgacataccggccgtttctgacatttctgacatttctgacataccggccgtttctgacataccggccgtttctgacatttctgacatttccgactcggaccgatg

SEQ ID NO: 16154 - DNA, 203 bp, Homo sapiens
ggcgcgccagtcctgagtcagcactctgacatttctgacatttctgacataccggccgtttctgacatttctgacatttctgacataccggccgtttctgacataccggccgtttctgacatttctgacatttctgacataccggccgtttctgacatttctgacatttctgacataccggccgtttccgactcggaccgatg

SEQ ID NO: 16155 - DNA, 203 bp, Homo sapiens
ggcgcgccagtcctagagtcagtttctgacatttctgacatttctgacataccggccgtttctgacatttctgacatttctgacataccggccgtttctgacataccggccgtttctgacatttctgacatttctgacatttctgacatttctgacataccggccgtttctgacataccggccgtttccgactcggaccgatg

SEQ ID NO: 16156 - DNA, 203 bp, Homo sapiens
ggcgcgccagtccttgcgagtcagtctgacatttctgacatttctgacataccggccgtttctgacatttctgacatttctgacataccggccgtttctgacataccggccgtttctgacatttctgacatttctgacatttctgacatttctgacataccggccgtttctgacatttctgacatttccgactcggaccgatg

SEQ ID NO: 16157 - DNA, 203 bp, Homo sapiens
ggcgcgccagtcctcgagtcagcgtctgacatttctgacatttctgacataccggccgtttctgacatttctgacatttctgacataccggccgtttctgacataccggccgtttctgacatttctgacatttctgacatttctgacatttctgacatttctgacatttctgacatttctgacatttccgactcggaccgatg

SEQ ID NO: 16158 - DNA, 203 bp, Homo sapiens
ggcgcgccagtcctccgagtcatttctgacatttctgacatttctgacataccggccgtttctgacatttctgacatttctgacataccggccgtttctgacatttctgacatttctgacataccggccgtttctgacataccggccgtttctgacataccggccgtttctgacatttctgacatttccgactcggaccgatg

SEQ ID NO: 16159 - DNA, 203 bp, Homo sapiens
ggcgcgccagtcctgcgtcgaaggtctgacatttctgacatttctgacataccggccgtttctgacatttctgacatttctgacataccggccgtttctgacatttctgacatttctgacataccggccgtttctgacataccggccgtttctgacatttctgacatttctgacatttctgacatttccgactcggaccgatg

SEQ ID NO: 16160 - DNA, 203 bp, Homo sapiens
ggcgcgccagtcctagctcgaagttctgacatttctgacatttctgacataccggccgtttctgacatttctgacatttctgacataccggccgtttctgacatttctgacatttctgacataccggccgtttctgacatttctgacatttctgacataccggccgtttctgacataccggccgtttccgactcggaccgatg

SEQ ID NO: 16161 - DNA, 203 bp, Homo sapiens
ggcgcgccagtcctctcgaaggtttctgacatttctgacatttctgacataccggccgtttctgacatttctgacatttctgacataccggccgtttctgacatttctgacatttctgacataccggccgtttctgacatttctgacatttctgacatttctgacatttctgacataccggccgtttccgactcggaccgatg

SEQ ID NO: 16162 - DNA, 203 bp, Homo sapiens
ggcgcgccagtcctccagtcgaagtctgacatttctgacatttctgacataccggccgtttctgacatttctgacatttctgacataccggccgtttctgacatttctgacatttctgacataccggccgtttctgacatttctgacatttctgacatttctgacatttctgacatttctgacatttccgactcggaccgatg

SEQ ID NO: 16163 - DNA, 203 bp, Homo sapiens
ggcgcgccagtcctcaatcgaaagtctgacatttctgacatttctgacataccggccgtttctgacatttctgacatttctgacatttctgacatttctgacataccggccgtttctgacataccggccgtttctgacatttctgacatttctgacataccggccgtttctgacatttctgacatttccgactcggaccgatg

SEQ ID NO: 16164 - DNA, 203 bp, Homo sapiens
ggcgcgccagtcctgtcgaaaatctctgacatttctgacatttctgacataccggccgtttctgacatttctgacatttctgacatttctgacatttctgacataccggccgtttctgacataccggccgtttctgacatttctgacatttctgacatttctgacatttctgacataccggccgtttccgactcggaccgatg

SEQ ID NO: 16165 - DNA, 203 bp, Homo sapiens
ggcgcgccagtccttcgaaaagcgtctgacatttctgacatttctgacataccggccgtttctgacatttctgacatttctgacatttctgacatttctgacataccggccgtttctgacataccggccgtttctgacatttctgacatttctgacatttctgacatttctgacatttctgacatttccgactcggaccgatg

SEQ ID NO: 16166 - DNA, 203 bp, Homo sapiens
ggcgcgccagtccttatcgaaatgtctgacatttctgacatttctgacataccggccgtttctgacatttctgacatttctgacatttctgacatttctgacataccggccgtttctgacatttctgacatttctgacataccggccgtttctgacataccggccgtttctgacatttctgacatttccgactcggaccgatg

SEQ ID NO: 16167 - DNA, 203 bp, Homo sapiens
ggcgcgccagtcctaatttcgatctctgacatttctgacatttctgacataccggccgtttctgacatttctgacatttctgacatttctgacatttctgacataccggccgtttctgacatttctgacatttctgacatttctgacatttctgacataccggccgtttctgacatttctgacatttccgactcggaccgatg

SEQ ID NO: 16168 - DNA, 203 bp, Homo sapiens
ggcgcgccagtcctatttcgattttctgacatttctgacatttctgacataccggccgtttctgacatttctgacatttctgacatttctgacatttctgacataccggccgtttctgacatttctgacatttctgacatttctgacatttctgacatttctgacatttctgacatttctgacatttccgactcggaccgatg

SEQ ID NO: 16169 - DNA, 203 bp, Homo sapiens
ggcgcgccagtcctgtacattctgtctgacatttctgacatttctgacataccggccgtttctgacatttctgacatttctgacatttctgacatttctgacatttctgacatttctgacataccggccgtttctgacataccggccgtttctgacatttctgacatttctgacataccggccgtttccgactcggaccgatg

SEQ ID NO: 16170 - DNA, 203 bp, Homo sapiens
ggcgcgccagtcctgcgccgtcactctgacatttctgacatttctgacataccggccgtttctgacatttctgacatttctgacatttctgacatttctgacatttctgacatttctgacataccggccgtttctgacatttctgacatttctgacataccggccgtttctgacatttctgacatttccgactcggaccgatg

SEQ ID NO: 16171 - DNA, 203 bp, Homo sapiens
ggcgcgccagtcctcggcgctctgtctgacatttctgacatttctgacatcacggaatcgagaaacatcacggaatcgagaaacatcacggaatcgagaaacatcacggaatcgagaaacatcacggaatcgagaaacatcacggaatcgagaaacatttctgacatttctgacatttctgacatttccgactcggaccgatg

SEQ ID NO: 16172 - DNA, 203 bp, Homo sapiens
ggcgcgccagtcctcagtcgcgagtctgacatttctgacatttctgacatcacggaatcgagaaacatcacggaatcgagaaacatcacggaatcgagaaacatttctgacatttctgacatcacggaatcgagaaacatcacggaatcgagaaacatttctgacatttctgacatttctgacatttccgactcggaccgatg

SEQ ID NO: 16173 - DNA, 203 bp, Homo sapiens
ggcgcgccagtccttcgcgacggctctgacatttctgacatttctgacatcacggaatcgagaaacatcacggaatcgagaaacatttctgacatttctgacatcacggaatcgagaaacatttctgacatttctgacatcacggaatcgagaaacatcacggaatcgagaaacatttctgacatttccgactcggaccgatg

SEQ ID NO: 16174 - DNA, 203 bp, Homo sapiens
ggcgcgccagtccttcgtgtaatctctgacatttctgacatttctgacatcacggaatcgagaaacatcacggaatcgagaaacatttctgacatttctgacatttctgacatttctgacatttctgacatttctgacatcacggaatcgagaaacatttctgacatttctgacatttctgacatttccgactcggaccgatg

SEQ ID NO: 16175 - DNA, 203 bp, Homo sapiens
ggcgcgccagtccttatccgaccatctgacatttctgacatttctgacatcacggaatcgagaaacatcacggaatcgagaaacatttctgacatttctgacatttctgacatttctgacatttctgacatttctgacatttctgacatttctgacatttctgacatttctgacatttctgacatttccgactcggaccgatg

SEQ ID NO: 16176 - DNA, 203 bp, Homo sapiens
ggcgcgccagtcctcgcggatacttctgacatttctgacatttctgacatcacggaatcgagaaacatttctgacatttctgacatcacggaatcgagaaacatcacggaatcgagaaacatcacggaatcgagaaacatttctgacatttctgacatcacggaatcgagaaacatttctgacatttccgactcggaccgatg

SEQ ID NO: 16177 - DNA, 203 bp, Homo sapiens
ggcgcgccagtccttatcggatactctgacatttctgacatttctgacatcacggaatcgagaaacatttctgacatttctgacatcacggaatcgagaaacatcacggaatcgagaaacatttctgacatttctgacatcacggaatcgagaaacatttctgacatttctgacatttctgacatttccgactcggaccgatg

SEQ ID NO: 16178 - DNA, 203 bp, Homo sapiens
ggcgcgccagtcctatccgcaagctctgacatttctgacatttctgacatcacggaatcgagaaacatttctgacatttctgacatcacggaatcgagaaacatcacggaatcgagaaacatttctgacatttctgacatttctgacatttctgacatcacggaatcgagaaacatttctgacatttccgactcggaccgatg

SEQ ID NO: 16179 - DNA, 203 bp, Homo sapiens
ggcgcgccagtcctccggattgagtctgacatttctgacatttctgacatcacggaatcgagaaacatttctgacatttctgacatttctgacatttctgacatcacggaatcgagaaacatcacggaatcgagaaacatttctgacatttctgacatttctgacatttctgacatttctgacatttccgactcggaccgatg

SEQ ID NO: 16180 - DNA, 203 bp, Homo sapiens
ggcgcgccagtcctcggatctgtatctgacatttctgacatttctgacatcacggaatcgagaaacatttctgacatttctgacatttctgacatttctgacatcacggaatcgagaaacatttctgacatttctgacatttctgacatttctgacatcacggaatcgagaaacatttctgacatttccgactcggaccgatg

SEQ ID NO: 16181 - DNA, 203 bp, Homo sapiens
ggcgcgccagtcctaaatccgggatctgacatttctgacatttctgacatcacggaatcgagaaacatttctgacatttctgacatttctgacatttctgacatcacggaatcgagaaacatttctgacatttctgacatttctgacatttctgacatttctgacatttctgacatttctgacatttccgactcggaccgatg

SEQ ID NO: 16182 - DNA, 203 bp, Homo sapiens
ggcgcgccagtcctatccggtggatctgacatttctgacatttctgacatcacggaatcgagaaacatttctgacatttctgacatttctgacatttctgacatttctgacatttctgacatttctgacatttctgacatcacggaatcgagaaacatttctgacatttctgacatttctgacatttccgactcggaccgatg

SEQ ID NO: 16183 - DNA, 203 bp, Homo sapiens
ggcgcgccagtccttcaggcggattctgacatttctgacatttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16184 - DNA, 203 bp, Homo sapiens
ggcgcgccagtcctcaatccgtcgtctgacatttctgacatttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16185 - DNA, 203 bp, Homo sapiens
ggcgcgccagtccttatccgattgtctgacatttctgacatttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16186 - DNA, 203 bp, Homo sapiens
ggcgcgccagtcctatccgttgcctctgacatttctgacatttctgacatccggcgggtttctgacatccggcgggtttctgacatccggcgggtttctgacatccggcgggtttctgacatccggcgggtttctgacatccggcgggtttctgacatccggcgggtttctgacatttctgacatttccgactcggaccgatg

SEQ ID NO: 16187 - DNA, 203 bp, Homo sapiens
ggcgcgccagtcctacaaatccggtctgacatttctgacatttctgacatccggcgggtttctgacatccggcgggtttctgacatccggcgggtttctgacatccggcgggtttctgacatccggcgggtttctgacatccggcgggtttctgacatttctgacatttctgacatccggcgggtttccgactcggaccgatg

SEQ ID NO: 16188 - DNA, 203 bp, Homo sapiens
ggcgcgccagtcctgatccgtatttctgacatttctgacatttctgacatccggcgggtttctgacatccggcgggtttctgacatccggcgggtttctgacatccggcgggtttctgacatccggcgggtttctgacatccggcgggtttctgacatttctgacatttctgacatttctgacatttccgactcggaccgatg

SEQ ID NO: 16189 - DNA, 203 bp, Homo sapiens
ggcgcgccagtcctgccggatacatctgacatttctgacatttctgacatccggcgggtttctgacatccggcgggtttctgacatccggcgggtttctgacatccggcgggtttctgacatccggcgggtttctgacatttctgacatttctgacatccggcgggtttctgacatccggcgggtttccgactcggaccgatg

SEQ ID NO: 16190 - DNA, 203 bp, Homo sapiens
ggcgcgccagtcctaacggtctgttctgacatttctgacatttctgacatccggcgggtttctgacatccggcgggtttctgacatccggcgggtttctgacatccggcgggtttctgacatttctgacatttctgacatttctgacatttctgacatccggcgggtttctgacatttctgacatttccgactcggaccgatg

SEQ ID NO: 16191 - DNA, 203 bp, Homo sapiens
ggcgcgccagtcctagcttctggttctgacatttctgacatttctgacatccggcgggtttctgacatccggcgggtttctgacatccggcgggtttctgacatccggcgggtttctgacatttctgacatttctgacatttctgacatttctgacatttctgacatttctgacatccggcgggtttccgactcggaccgatg

SEQ ID NO: 16192 - DNA, 203 bp, Homo sapiens
ggcgcgccagtcctaggtcaagtttctgacatttctgacatttctgacatccggcgggtttctgacatccggcgggtttctgacatccggcgggtttctgacatttctgacatttctgacatccggcgggtttctgacatttctgacatttctgacatttctgacatttctgacatccggcgggtttccgactcggaccgatg

SEQ ID NO: 16193 - DNA, 203 bp, Homo sapiens
ggcgcgccagtccttgctcaggattctgacatttctgacatttctgacatccggcgggtttctgacatccggcgggtttctgacatccggcgggtttctgacatttctgacatttctgacatttctgacatttctgacatttctgacatttctgacatccggcgggtttctgacatttctgacatttccgactcggaccgatg

SEQ ID NO: 16194 - DNA, 203 bp, Homo sapiens
ggcgcgccagtccttgtctgcaaatctgacatttctgacatttctgacatccggcgggtttctgacatccggcgggtttctgacatccggcgggtttctgacatttctgacatttctgacatttctgacatttctgacatttctgacatttctgacatttctgacatttctgacatccggcgggtttccgactcggaccgatg

SEQ ID NO: 16195 - DNA, 203 bp, Homo sapiens
ggcgcgccagtccttaggtcaccatctgacatttctgacatttctgacatccggcgggtttctgacatccggcgggtttctgacatccggcgggtttctgacatttctgacatttctgacatttctgacatttctgacatttctgacatttctgacatttctgacatttctgacatttctgacatttccgactcggaccgatg

SEQ ID NO: 16196 - DNA, 203 bp, Homo sapiens
ggcgcgccagtccttgtaccgtcatctgacatttctgacatttctgacatccggcgggtttctgacatccggcgggtttctgacatttctgacatttctgacatccggcgggtttctgacatccggcgggtttctgacatccggcgggtttctgacatccggcgggtttctgacatccggcgggtttccgactcggaccgatg

SEQ ID NO: 16197 - DNA, 203 bp, Homo sapiens
ggcgcgccagtcctttgagcttgttctgacatttctgacatttctgacatccggcgggtttctgacatccggcgggtttctgacatttctgacatttctgacatccggcgggtttctgacatccggcgggtttctgacatccggcgggtttctgacatccggcgggtttctgacatttctgacatttccgactcggaccgatg

SEQ ID NO: 16198 - DNA, 203 bp, Homo sapiens
ggcgcgccagtcctaagagcttgatctgacatttctgacatttctgacatccggcgggtttctgacatccggcgggtttctgacatttctgacatttctgacatccggcgggtttctgacatccggcgggtttctgacatccggcgggtttctgacatttctgacatttctgacatccggcgggtttccgactcggaccgatg

SEQ ID NO: 16199 - DNA, 203 bp, Homo sapiens
ggcgcgccagtcctaagcctgagatctgacatttctgacatttctgacatccggcgggtttctgacatccggcgggtttctgacatttctgacatttctgacatccggcgggtttctgacatccggcgggtttctgacatccggcgggtttctgacatttctgacatttctgacatttctgacatttccgactcggaccgatg

SEQ ID NO: 16200 - DNA, 203 bp, Homo sapiens
ggcgcgccagtccttcaccgtctgtctgacatttctgacatttctgacatccggcgggtttctgacatccggcgggtttctgacatttctgacatttctgacatccggcgggtttctgacatccggcgggtttctgacatttctgacatttctgacatccggcgggtttctgacatttctgacatttccgactcggaccgatg

SEQ ID NO: 16201 - DNA, 203 bp, Homo sapiens
ggcgcgccagtcctatcagtctagtctgacatttctgacatttctgacatccggcgggtttctgacatccggcgggtttctgacatttctgacatttctgacatccggcgggtttctgacatccggcgggtttctgacatttctgacatttctgacatttctgacatttctgacatttctgacatttccgactcggaccgatg

SEQ ID NO: 16202 - DNA, 203 bp, Homo sapiens
ggcgcgccagtcctagctgacctgtctgacatttctgacatttctgacatccggcgggtttctgacatccggcgggtttctgacatttctgacatttctgacatccggcgggtttctgacatttctgacatttctgacatttctgacatttctgacatccggcgggtttctgacatccggcgggtttccgactcggaccgatg

SEQ ID NO: 16203 - DNA, 203 bp, Homo sapiens
ggcgcgccagtccttgacggtttgtctgacatttctgacatttctgacatccggcgggtttctgacatccggcgggtttctgacatttctgacatttctgacatccggcgggtttctgacatttctgacatttctgacatttctgacatttctgacatttctgacatttctgacatccggcgggtttccgactcggaccgatg

SEQ ID NO: 16204 - DNA, 203 bp, Homo sapiens
ggcgcgccagtcctacactagctgtctgacatttctgacatttctgacatccggcgggtttctgacatccggcgggtttctgacatttctgacatttctgacatttctgacatttctgacatccggcgggtttctgacatccggcgggtttctgacatccggcgggtttctgacatttctgacatttccgactcggaccgatg

SEQ ID NO: 16205 - DNA, 203 bp, Homo sapiens
ggcgcgccagtcctcttcgtctgatctgacatttctgacatttctgacatccggcgggtttctgacatccggcgggtttctgacatttctgacatttctgacatttctgacatttctgacatccggcgggtttctgacatttctgacatttctgacatccggcgggtttctgacatttctgacatttccgactcggaccgatg

SEQ ID NO: 16206 - DNA, 203 bp, Homo sapiens
ggcgcgccagtcctcataccgtcttctgacatttctgacatttctgacatccggcgggtttctgacatccggcgggtttctgacatttctgacatttctgacatttctgacatttctgacatccggcgggtttctgacatttctgacatttctgacatttctgacatttctgacatccggcgggtttccgactcggaccgatg

SEQ ID NO: 16207 - DNA, 203 bp, Homo sapiens
ggcgcgccagtcctcttgactggttctgacatttctgacatttctgacatccggcgggtttctgacatccggcgggtttctgacatttctgacatttctgacatttctgacatttctgacatttctgacatttctgacatccggcgggtttctgacatccggcgggtttctgacatttctgacatttccgactcggaccgatg

SEQ ID NO: 16208 - DNA, 203 bp, Homo sapiens
ggcgcgccagtcctcttcaagacttctgacatttctgacatttctgacatccggcgggtttctgacatccggcgggtttctgacatttctgacatttctgacatttctgacatttctgacatttctgacatttctgacatttctgacatttctgacatttctgacatttctgacatccggcgggtttccgactcggaccgatg

SEQ ID NO: 16209 - DNA, 203 bp, Homo sapiens
ggcgcgccagtccttattcaagcttctgacatttctgacatttctgacatccggcgggtttctgacatttctgacatttctgacatccggcgggtttctgacatccggcgggtttctgacatccggcgggtttctgacatttctgacatttctgacatccggcgggtttctgacatttctgacatttccgactcggaccgatg

SEQ ID NO: 16210 - DNA, 203 bp, Homo sapiens
ggcgcgccagtccttgagtttacatctgacatttctgacatttctgacatccggcgggtttctgacatttctgacatttctgacatccggcgggtttctgacatccggcgggtttctgacatccggcgggtttctgacatttctgacatttctgacatttctgacatttctgacatccggcgggtttccgactcggaccgatg

SEQ ID NO: 16211 - DNA, 203 bp, Homo sapiens
ggcgcgccagtcctagtgagaatatctgacatttctgacatttctgacatccggcgggtttctgacatttctgacatttctgacatccggcgggtttctgacatccggcgggtttctgacatttctgacatttctgacatccggcgggtttctgacatccggcgggtttctgacatccggcgggtttccgactcggaccgatg

SEQ ID NO: 16212 - DNA, 203 bp, Homo sapiens
ggcgcgccagtcctttgtagactatctgacatttctgacatttctgacatccggcgggtttctgacatttctgacatttctgacatccggcgggtttctgacatccggcgggtttctgacatttctgacatttctgacatccggcgggtttctgacatttctgacatttctgacatttctgacatttccgactcggaccgatg

SEQ ID NO: 16213 - DNA, 203 bp, Homo sapiens
ggcgcgccagtccttaaagaccattctgacatttctgacatttctgacatccggcgggtttctgacatttctgacatttctgacatccggcgggtttctgacatccggcgggtttctgacatttctgacatttctgacatttctgacatttctgacatccggcgggtttctgacatttctgacatttccgactcggaccgatg

SEQ ID NO: 16214 - DNA, 203 bp, Homo sapiens
ggcgcgccagtcctagcctaagattctgacatttctgacatttctgacatccggcgggtttctgacatttctgacatttctgacatccggcgggtttctgacatttctgacatttctgacatccggcgggtttctgacatccggcgggtttctgacatccggcgggtttctgacatccggcgggtttccgactcggaccgatg

SEQ ID NO: 16215 - DNA, 203 bp, Homo sapiens
ggcgcgccagtcctctactgtctgtctgacatttctgacatttctgacatccggcgggtttctgacatttctgacatttctgacatccggcgggtttctgacatttctgacatttctgacatccggcgggtttctgacatttctgacatttctgacatttctgacatttctgacatccggcgggtttccgactcggaccgatg

SEQ ID NO: 16216 - DNA, 203 bp, Homo sapiens
ggcgcgccagtcctctcacaagattctgacatttctgacatttctgacatccggcgggtttctgacatttctgacatttctgacatccggcgggtttctgacatttctgacatttctgacatccggcgggtttctgacatttctgacatttctgacatttctgacatttctgacatttctgacatttccgactcggaccgatg

SEQ ID NO: 16217 - DNA, 203 bp, Homo sapiens
ggcgcgccagtcctaattctctgatctgacatttctgacatttctgacatccggcgggtttctgacatttctgacatttctgacatccggcgggtttctgacatttctgacatttctgacatttctgacatttctgacatccggcgggtttctgacatccggcgggtttctgacatccggcgggtttccgactcggaccgatg

SEQ ID NO: 16218 - DNA, 203 bp, Homo sapiens
ggcgcgccagtcctacgactagtgtctgacatttctgacatttctgacatccggcgggtttctgacatttctgacatttctgacatccggcgggtttctgacatttctgacatttctgacatttctgacatttctgacatccggcgggtttctgacatttctgacatttctgacatttctgacatttccgactcggaccgatg

SEQ ID NO: 16219 - DNA, 203 bp, Homo sapiens
ggcgcgccagtcctacgacaaggttctgacatttctgacatttctgacatccggcgggtttctgacatttctgacatttctgacatccggcgggtttctgacatttctgacatttctgacatttctgacatttctgacatttctgacatttctgacatccggcgggtttctgacatccggcgggtttccgactcggaccgatg

SEQ ID NO: 16220 - DNA, 203 bp, Homo sapiens
ggcgcgccagtccttagccttcgttctgacatttctgacatttctgacatccggcgggtttctgacatttctgacatttctgacatccggcgggtttctgacatttctgacatttctgacatttctgacatttctgacatttctgacatttctgacatccggcgggtttctgacatttctgacatttccgactcggaccgatg

SEQ ID NO: 16221 - DNA, 203 bp, Homo sapiens
ggcgcgccagtccttgcactggtgtctgacatttctgacatttctgacatccggcgggtttctgacatttctgacatttctgacatttctgacatttctgacatccggcgggtttctgacatccggcgggtttctgacatccggcgggtttctgacatccggcgggtttctgacatccggcgggtttccgactcggaccgatg

SEQ ID NO: 16222 - DNA, 203 bp, Homo sapiens
ggcgcgccagtcctcttcttgcgatctgacatttctgacatttctgacatccggcgggtttctgacatttctgacatttctgacatttctgacatttctgacatccggcgggtttctgacatccggcgggtttctgacatttctgacatttctgacatttctgacatttctgacatccggcgggtttccgactcggaccgatg

SEQ ID NO: 16223 - DNA, 203 bp, Homo sapiens
ggcgcgccagtcctcacaacttgatctgacatttctgacatttctgacatccggcgggtttctgacatttctgacatttctgacatttctgacatttctgacatccggcgggtttctgacatttctgacatttctgacatccggcgggtttctgacatccggcgggtttctgacatccggcgggtttccgactcggaccgatg

SEQ ID NO: 16224 - DNA, 203 bp, Homo sapiens
ggcgcgccagtcctttacaaggattctgacatttctgacatttctgacatccggcgggtttctgacatttctgacatttctgacatttctgacatttctgacatccggcgggtttctgacatttctgacatttctgacatccggcgggtttctgacatttctgacatttctgacatccggcgggtttccgactcggaccgatg

SEQ ID NO: 16225 - DNA, 203 bp, Homo sapiens
ggcgcgccagtccttagtttgcaatctgacatttctgacatttctgacatccggcgggtttctgacatttctgacatttctgacatttctgacatttctgacatccggcgggtttctgacatttctgacatttctgacatccggcgggtttctgacatttctgacatttctgacatttctgacatttccgactcggaccgatg

SEQ ID NO: 16226 - DNA, 203 bp, Homo sapiens
ggcgcgccagtccttcaagtgtagtctgacatttctgacatttctgacatccggcgggtttctgacatttctgacatttctgacatttctgacatttctgacatccggcgggtttctgacatttctgacatttctgacatttctgacatttctgacatccggcgggtttctgacatttctgacatttccgactcggaccgatg

SEQ ID NO: 16227 - DNA, 203 bp, Homo sapiens
ggcgcgccagtcctagaatcagagtctgacatttctgacatttctgacatccggcgggtttctgacatttctgacatttctgacatttctgacatttctgacatccggcgggtttctgacatttctgacatttctgacatttctgacatttctgacatttctgacatttctgacatttctgacatttccgactcggaccgatg

SEQ ID NO: 16228 - DNA, 203 bp, Homo sapiens
ggcgcgccagtcctcacttgcacttctgacatttctgacatttctgacatccggcgggtttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16229 - DNA, 203 bp, Homo sapiens
ggcgcgccagtccttcagtcgtcatctgacatttctgacatttctgacatccggcgggtttctgacatttctgacatttctgacatttctgacatttctgacatttctgacatttctgacatccggcgggtttctgacatttctgacatttctgacatttctgacatttctgacatccggcgggtttccgactcggaccgatg

SEQ ID NO: 16230 - DNA, 203 bp, Homo sapiens
ggcgcgccagtcctaacgaaagagtctgacatttctgacatttctgacatccggcgggtttctgacatttctgacatttctgacatttctgacatttctgacatttctgacatttctgacatttctgacatttctgacatccggcgggtttctgacatttctgacatttctgacatccggcgggtttccgactcggaccgatg

SEQ ID NO: 16231 - DNA, 203 bp, Homo sapiens
ggcgcgccagtcctaacagacagttctgacatttctgacatttctgacatccggcgggtttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16232 - DNA, 203 bp, Homo sapiens
ggcgcgccagtcctaatcttgcaatctgacatttctgacatttctgacatccggcgggtttctgacatttctgacatttctgacatttctgacatttctgacatttctgacatttctgacatttctgacatttctgacatttctgacatttctgacatccggcgggtttctgacatttctgacatttccgactcggaccgatg

SEQ ID NO: 16233 - DNA, 203 bp, Homo sapiens
ggcgcgccagtccttgtaaaccgttctgacatttctgacatttctgacatccggcgggtttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16234 - DNA, 203 bp, Homo sapiens
ggcgcgccagtcctaactgatccttctgacatttctgacatttctgacatcgtcaattcctttaacatcgtcaattcctttaacatcgtcaattcctttaacatcgtcaattcctttaacatcgtcaattcctttaacatcgtcaattcctttaacatcgtcaattcctttaacatttctgacatttccgactcggaccgatg

SEQ ID NO: 16235 - DNA, 203 bp, Homo sapiens
ggcgcgccagtccttgatcagttttctgacatttctgacatttctgacatcgtcaattcctttaacatcgtcaattcctttaacatcgtcaattcctttaacatcgtcaattcctttaacatcgtcaattcctttaacatcgtcaattcctttaacatttctgacatttctgacatttctgacatttccgactcggaccgatg

SEQ ID NO: 16236 - DNA, 203 bp, Homo sapiens
ggcgcgccagtcctttctggtacatctgacatttctgacatttctgacatcgtcaattcctttaacatcgtcaattcctttaacatcgtcaattcctttaacatcgtcaattcctttaacatcgtcaattcctttaacatttctgacatttctgacatcgtcaattcctttaacatttctgacatttccgactcggaccgatg

SEQ ID NO: 16237 - DNA, 203 bp, Homo sapiens
ggcgcgccagtcctcttagctctatctgacatttctgacatttctgacatcgtcaattcctttaacatcgtcaattcctttaacatcgtcaattcctttaacatcgtcaattcctttaacatttctgacatttctgacatcgtcaattcctttaacatcgtcaattcctttaacatttctgacatttccgactcggaccgatg

SEQ ID NO: 16238 - DNA, 203 bp, Homo sapiens
ggcgcgccagtcctctaagattcttctgacatttctgacatttctgacatcgtcaattcctttaacatcgtcaattcctttaacatcgtcaattcctttaacatcgtcaattcctttaacatttctgacatttctgacatttctgacatttctgacatttctgacatttctgacatttctgacatttccgactcggaccgatg

SEQ ID NO: 16239 - DNA, 203 bp, Homo sapiens
ggcgcgccagtcctttaacagctttctgacatttctgacatttctgacatcgtcaattcctttaacatcgtcaattcctttaacatcgtcaattcctttaacatttctgacatttctgacatcgtcaattcctttaacatcgtcaattcctttaacatcgtcaattcctttaacatttctgacatttccgactcggaccgatg

SEQ ID NO: 16240 - DNA, 203 bp, Homo sapiens
ggcgcgccagtcctatggtagccatctgacatttctgacatttctgacatcgtcaattcctttaacatcgtcaattcctttaacatcgtcaattcctttaacatttctgacatttctgacatcgtcaattcctttaacatcgtcaattcctttaacatttctgacatttctgacatttctgacatttccgactcggaccgatg

SEQ ID NO: 16241 - DNA, 203 bp, Homo sapiens
ggcgcgccagtcctaccaaccttttctgacatttctgacatttctgacatcgtcaattcctttaacatcgtcaattcctttaacatcgtcaattcctttaacatttctgacatttctgacatcgtcaattcctttaacatttctgacatttctgacatcgtcaattcctttaacatttctgacatttccgactcggaccgatg

SEQ ID NO: 16242 - DNA, 203 bp, Homo sapiens
ggcgcgccagtcctatggttaagatctgacatttctgacatttctgacatcgtcaattcctttaacatcgtcaattcctttaacatcgtcaattcctttaacatttctgacatttctgacatttctgacatttctgacatcgtcaattcctttaacatcgtcaattcctttaacatttctgacatttccgactcggaccgatg

SEQ ID NO: 16243 - DNA, 203 bp, Homo sapiens
ggcgcgccagtccttgcttgactatctgacatttctgacatttctgacatcgtcaattcctttaacatcgtcaattcctttaacatcgtcaattcctttaacatttctgacatttctgacatttctgacatttctgacatttctgacatttctgacatttctgacatttctgacatttctgacatttccgactcggaccgatg

SEQ ID NO: 16244 - DNA, 203 bp, Homo sapiens
ggcgcgccagtccttgctcagatatctgacatttctgacatttctgacatcgtcaattcctttaacatcgtcaattcctttaacatttctgacatttctgacatcgtcaattcctttaacatcgtcaattcctttaacatcgtcaattcctttaacatcgtcaattcctttaacatttctgacatttccgactcggaccgatg

SEQ ID NO: 16245 - DNA, 203 bp, Homo sapiens
ggcgcgccagtcctaaagaggttatctgacatttctgacatttctgacatcgtcaattcctttaacatcgtcaattcctttaacatttctgacatttctgacatcgtcaattcctttaacatcgtcaattcctttaacatttctgacatttctgacatttctgacatttctgacatttctgacatttccgactcggaccgatg

SEQ ID NO: 16246 - DNA, 203 bp, Homo sapiens
ggcgcgccagtccttagtcagacttctgacatttctgacatttctgacatcgtcaattcctttaacatcgtcaattcctttaacatttctgacatttctgacatcgtcaattcctttaacatttctgacatttctgacatcgtcaattcctttaacatcgtcaattcctttaacatttctgacatttccgactcggaccgatg

SEQ ID NO: 16247 - DNA, 203 bp, Homo sapiens
ggcgcgccagtcctagtgacctcttctgacatttctgacatttctgacatcgtcaattcctttaacatcgtcaattcctttaacatttctgacatttctgacatcgtcaattcctttaacatttctgacatttctgacatttctgacatttctgacatcgtcaattcctttaacatttctgacatttccgactcggaccgatg

SEQ ID NO: 16248 - DNA, 203 bp, Homo sapiens
ggcgcgccagtccttgcttaagcatctgacatttctgacatttctgacatcgtcaattcctttaacatcgtcaattcctttaacatttctgacatttctgacatttctgacatttctgacatcgtcaattcctttaacatcgtcaattcctttaacatcgtcaattcctttaacatttctgacatttccgactcggaccgatg

SEQ ID NO: 16249 - DNA, 203 bp, Homo sapiens
ggcgcgccagtccttgagaggtcatctgacatttctgacatttctgacatcgtcaattcctttaacatcgtcaattcctttaacatttctgacatttctgacatttctgacatttctgacatcgtcaattcctttaacatcgtcaattcctttaacatttctgacatttctgacatttctgacatttccgactcggaccgatg

SEQ ID NO: 16250 - DNA, 203 bp, Homo sapiens
ggcgcgccagtcctaaccttcttgtctgacatttctgacatttctgacatcgtcaattcctttaacatcgtcaattcctttaacatttctgacatttctgacatttctgacatttctgacatcgtcaattcctttaacatttctgacatttctgacatcgtcaattcctttaacatttctgacatttccgactcggaccgatg

SEQ ID NO: 16251 - DNA, 203 bp, Homo sapiens
ggcgcgccagtccttacagagtagtctgacatttctgacatttctgacatcgtcaattcctttaacatcgtcaattcctttaacatttctgacatttctgacatttctgacatttctgacatttctgacatttctgacatcgtcaattcctttaacatcgtcaattcctttaacatttctgacatttccgactcggaccgatg

SEQ ID NO: 16252 - DNA, 203 bp, Homo sapiens
ggcgcgccagtcctaaggtgagtgtctgacatttctgacatttctgacatcgtcaattcctttaacatcgtcaattcctttaacatttctgacatttctgacatttctgacatttctgacatttctgacatttctgacatttctgacatttctgacatcgtcaattcctttaacatttctgacatttccgactcggaccgatg

SEQ ID NO: 16253 - DNA, 203 bp, Homo sapiens
ggcgcgccagtcctatcttagctttctgacatttctgacatttctgacatcgtcaattcctttaacatttctgacatttctgacatcgtcaattcctttaacatcgtcaattcctttaacatcgtcaattcctttaacatttctgacatttctgacatcgtcaattcctttaacatttctgacatttccgactcggaccgatg

SEQ ID NO: 16254 - DNA, 203 bp, Homo sapiens
ggcgcgccagtcctcactagcttatctgacatttctgacatttctgacatcgtcaattcctttaacatttctgacatttctgacatcgtcaattcctttaacatcgtcaattcctttaacatttctgacatttctgacatcgtcaattcctttaacatcgtcaattcctttaacatttctgacatttccgactcggaccgatg

SEQ ID NO: 16255 - DNA, 203 bp, Homo sapiens
ggcgcgccagtccttagcttgctgtctgacatttctgacatttctgacatcgtcaattcctttaacatttctgacatttctgacatcgtcaattcctttaacatcgtcaattcctttaacatttctgacatttctgacatcgtcaattcctttaacatttctgacatttctgacatttctgacatttccgactcggaccgatg

SEQ ID NO: 16256 - DNA, 203 bp, Homo sapiens
ggcgcgccagtcctcaggactcgttctgacatttctgacatttctgacatcgtcaattcctttaacatttctgacatttctgacatcgtcaattcctttaacatttctgacatttctgacatcgtcaattcctttaacatcgtcaattcctttaacatcgtcaattcctttaacatttctgacatttccgactcggaccgatg

SEQ ID NO: 16257 - DNA, 203 bp, Homo sapiens
ggcgcgccagtccttgcagtagcttctgacatttctgacatttctgacatcgtcaattcctttaacatttctgacatttctgacatcgtcaattcctttaacatttctgacatttctgacatcgtcaattcctttaacatttctgacatttctgacatcgtcaattcctttaacatttctgacatttccgactcggaccgatg

SEQ ID NO: 16258 - DNA, 203 bp, Homo sapiens
ggcgcgccagtcctagactgtgcttctgacatttctgacatttctgacatcgtcaattcctttaacatttctgacatttctgacatcgtcaattcctttaacatttctgacatttctgacatcgtcaattcctttaacatttctgacatttctgacatttctgacatttctgacatttctgacatttccgactcggaccgatg

SEQ ID NO: 16259 - DNA, 203 bp, Homo sapiens
ggcgcgccagtcctaaaactctcatctgacatttctgacatttctgacatcgtcaattcctttaacatttctgacatttctgacatcgtcaattcctttaacatttctgacatttctgacatttctgacatttctgacatcgtcaattcctttaacatttctgacatttctgacatttctgacatttccgactcggaccgatg

SEQ ID NO: 16260 - DNA, 203 bp, Homo sapiens
ggcgcgccagtcctaagtaggacttctgacatttctgacatttctgacatcgtcaattcctttaacatttctgacatttctgacatcgtcaattcctttaacatttctgacatttctgacatttctgacatttctgacatttctgacatttctgacatcgtcaattcctttaacatttctgacatttccgactcggaccgatg

SEQ ID NO: 16261 - DNA, 203 bp, Homo sapiens
ggcgcgccagtcctatgaggactgtctgacatttctgacatttctgacatcgtcaattcctttaacatttctgacatttctgacatttctgacatttctgacatcgtcaattcctttaacatttctgacatttctgacatcgtcaattcctttaacatttctgacatttctgacatttctgacatttccgactcggaccgatg

SEQ ID NO: 16262 - DNA, 203 bp, Homo sapiens
ggcgcgccagtcctcaacactctgtctgacatttctgacatttctgacatcgtcaattcctttaacatttctgacatttctgacatttctgacatttctgacatcgtcaattcctttaacatttctgacatttctgacatttctgacatttctgacatcgtcaattcctttaacatttctgacatttccgactcggaccgatg

SEQ ID NO: 16263 - DNA, 203 bp, Homo sapiens
ggcgcgccagtccttaactggacttctgacatttctgacatttctgacatcgtcaattcctttaacatttctgacatttctgacatttctgacatttctgacatcgtcaattcctttaacatttctgacatttctgacatttctgacatttctgacatttctgacatttctgacatttctgacatttccgactcggaccgatg

SEQ ID NO: 16264 - DNA, 203 bp, Homo sapiens
ggcgcgccagtcctagcagtccattctgacatttctgacatttctgacatcgtcaattcctttaacatttctgacatttctgacatttctgacatttctgacatttctgacatttctgacatttctgacatttctgacatcgtcaattcctttaacatcgtcaattcctttaacatttctgacatttccgactcggaccgatg

SEQ ID NO: 16265 - DNA, 203 bp, Homo sapiens
ggcgcgccagtcctacatactgtgtctgacatttctgacatttctgacatgcaggctccactcctggtggtgcccttccgtcaattcctttaagtttcagctttgcaaccatactccccccggaacccaaagactttggtttcccggaagctgcccggcgggtcatgggaataacgccctgacatttccgactcggaccgatg

SEQ ID NO: 16266 - DNA, 203 bp, Homo sapiens
ggcgcgccagtcctacatgatcattctgacatttctgacatttctgacattaccggccgttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16267 - DNA, 203 bp, Homo sapiens
ggcgcgccagtcctaaagctaaagtctgacatttctgacatttctgacattaccggccgttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16268 - DNA, 203 bp, Homo sapiens
ggcgcgccagtcctaccagaactttctgacatttctgacatttctgacattactcccatttctgacattactcccatttctgacattactcccatttctgacattactcccatttctgacattactcccatttctgacattactcccatttctgacattactcccatttctgacattactcccatttccgactcggaccgatg

SEQ ID NO: 16269 - DNA, 203 bp, Homo sapiens
ggcgcgccagtccttaaggttgattctgacatttctgacatttctgacattactcccatttctgacattactcccatttctgacattactcccatttctgacattactcccatttctgacattactcccatttctgacattactcccatttctgacatttctgacatttctgacatttctgacatttccgactcggaccgatg

SEQ ID NO: 16270 - DNA, 203 bp, Homo sapiens
ggcgcgccagtccttatgctcatatctgacatttctgacatttctgacattactcccatttctgacattactcccatttctgacattactcccatttctgacattactcccatttctgacattactcccatttctgacatttctgacatttctgacattactcccatttctgacatttctgacatttccgactcggaccgatg

SEQ ID NO: 16271 - DNA, 203 bp, Homo sapiens
ggcgcgccagtccttatgagcaaatctgacatttctgacatttctgacattactcccatttctgacattactcccatttctgacattactcccatttctgacattactcccatttctgacattactcccatttctgacatttctgacatttctgacatttctgacatttctgacattactcccatttccgactcggaccgatg

SEQ ID NO: 16272 - DNA, 203 bp, Homo sapiens
ggcgcgccagtcctttaagtgccatctgacatttctgacatttctgacattactcccatttctgacattactcccatttctgacattactcccatttctgacattactcccatttctgacatttctgacatttctgacattactcccatttctgacattactcccatttctgacattactcccatttccgactcggaccgatg

SEQ ID NO: 16273 - DNA, 203 bp, Homo sapiens
ggcgcgccagtcctatacagtttatctgacatttctgacatttctgacattactcccatttctgacattactcccatttctgacattactcccatttctgacattactcccatttctgacatttctgacatttctgacattactcccatttctgacattactcccatttctgacatttctgacatttccgactcggaccgatg

SEQ ID NO: 16274 - DNA, 203 bp, Homo sapiens
ggcgcgccagtcctttaaagtgtatctgacatttctgacatttctgacattactcccatttctgacattactcccatttctgacattactcccatttctgacattactcccatttctgacatttctgacatttctgacattactcccatttctgacatttctgacatttctgacattactcccatttccgactcggaccgatg

SEQ ID NO: 16275 - DNA, 203 bp, Homo sapiens
ggcgcgccagtccttatgaatctatctgacatttctgacatttctgacattactcccatttctgacattactcccatttctgacattactcccatttctgacattactcccatttctgacatttctgacatttctgacattactcccatttctgacatttctgacatttctgacatttctgacatttccgactcggaccgatg

SEQ ID NO: 16276 - DNA, 203 bp, Homo sapiens
ggcgcgccagtcctcctttcgtcttctgacatttctgacatttctgacattactcccatttctgacattactcccatttctgacattactcccatttctgacatttctgacatttctgacattactcccatttctgacattactcccatttctgacatttctgacatttctgacattactcccatttccgactcggaccgatg

SEQ ID NO: 16277 - DNA, 203 bp, Homo sapiens
ggcgcgccagtcctccttgagaaatctgacatttctgacatttctgacattactcccatttctgacattactcccatttctgacattactcccatttctgacatttctgacatttctgacattactcccatttctgacattactcccatttctgacatttctgacatttctgacatttctgacatttccgactcggaccgatg

SEQ ID NO: 16278 - DNA, 203 bp, Homo sapiens
ggcgcgccagtcctagcaagtaggtctgacatttctgacatttctgacattactcccatttctgacattactcccatttctgacattactcccatttctgacatttctgacatttctgacattactcccatttctgacatttctgacatttctgacattactcccatttctgacattactcccatttccgactcggaccgatg

SEQ ID NO: 16279 - DNA, 203 bp, Homo sapiens
ggcgcgccagtcctaacgacaaggtctgacatttctgacatttctgacattactcccatttctgacattactcccatttctgacattactcccatttctgacatttctgacatttctgacattactcccatttctgacatttctgacatttctgacattactcccatttctgacatttctgacatttccgactcggaccgatg

SEQ ID NO: 16280 - DNA, 203 bp, Homo sapiens
ggcgcgccagtcctacctactaggtctgacatttctgacatttctgacattactcccatttctgacattactcccatttctgacattactcccatttctgacatttctgacatttctgacattactcccatttctgacatttctgacatttctgacatttctgacatttctgacatttctgacatttccgactcggaccgatg

SEQ ID NO: 16281 - DNA, 203 bp, Homo sapiens
ggcgcgccagtccttaaggttaggtctgacatttctgacatttctgacattactcccatttctgacattactcccatttctgacattactcccatttctgacatttctgacatttctgacatttctgacatttctgacattactcccatttctgacattactcccatttctgacatttctgacatttccgactcggaccgatg

SEQ ID NO: 16282 - DNA, 203 bp, Homo sapiens
ggcgcgccagtcctacactctgaatctgacatttctgacatttctgacattactcccatttctgacattactcccatttctgacattactcccatttctgacatttctgacatttctgacatttctgacatttctgacatttctgacatttctgacattactcccatttctgacattactcccatttccgactcggaccgatg

SEQ ID NO: 16283 - DNA, 203 bp, Homo sapiens
ggcgcgccagtccttccagtgcattctgacatttctgacatttctgacattactcccatttctgacattactcccatttctgacattactcccatttctgacatttctgacatttctgacatttctgacatttctgacatttctgacatttctgacatttctgacatttctgacatttctgacatttccgactcggaccgatg

SEQ ID NO: 16284 - DNA, 203 bp, Homo sapiens
ggcgcgccagtcctacctcaagtgtctgacatttctgacatttctgacattactcccatttctgacattactcccatttctgacatttctgacatttctgacattactcccatttctgacattactcccatttctgacattactcccatttctgacattactcccatttctgacattactcccatttccgactcggaccgatg

SEQ ID NO: 16285 - DNA, 203 bp, Homo sapiens
ggcgcgccagtcctaaggtcctgttctgacatttctgacatttctgacattactcccatttctgacattactcccatttctgacatttctgacatttctgacattactcccatttctgacattactcccatttctgacattactcccatttctgacattactcccatttctgacatttctgacatttccgactcggaccgatg

SEQ ID NO: 16286 - DNA, 203 bp, Homo sapiens
ggcgcgccagtccttgtaaaggcttctgacatttctgacatttctgacattactcccatttctgacattactcccatttctgacatttctgacatttctgacattactcccatttctgacattactcccatttctgacatttctgacatttctgacattactcccatttctgacattactcccatttccgactcggaccgatg

SEQ ID NO: 16287 - DNA, 203 bp, Homo sapiens
ggcgcgccagtcctagtctttcattctgacatttctgacatttctgacattactcccatttctgacattactcccatttctgacatttctgacatttctgacattactcccatttctgacattactcccatttctgacatttctgacatttctgacattactcccatttctgacatttctgacatttccgactcggaccgatg

SEQ ID NO: 16288 - DNA, 203 bp, Homo sapiens
ggcgcgccagtcctaaacactgcttctgacatttctgacatttctgacattactcccatttctgacattactcccatttctgacatttctgacatttctgacattactcccatttctgacattactcccatttctgacatttctgacatttctgacatttctgacatttctgacattactcccatttccgactcggaccgatg

SEQ ID NO: 16289 - DNA, 203 bp, Homo sapiens
ggcgcgccagtcctctgtaaggattctgacatttctgacatttctgacattactcccatttctgacattactcccatttctgacatttctgacatttctgacattactcccatttctgacattactcccatttctgacatttctgacatttctgacatttctgacatttctgacatttctgacatttccgactcggaccgatg

SEQ ID NO: 16290 - DNA, 203 bp, Homo sapiens
ggcgcgccagtcctctgtctgtattctgacatttctgacatttctgacattactcccatttctgacattactcccatttctgacatttctgacatttctgacattactcccatttctgacatttctgacatttctgacattactcccatttctgacattactcccatttctgacattactcccatttccgactcggaccgatg

SEQ ID NO: 16291 - DNA, 203 bp, Homo sapiens
ggcgcgccagtcctctgacggtgatctgacatttctgacatttctgacattactcccatttctgacattactcccatttctgacatttctgacatttctgacattactcccatttctgacatttctgacatttctgacattactcccatttctgacatttctgacatttctgacattactcccatttccgactcggaccgatg

SEQ ID NO: 16292 - DNA, 203 bp, Homo sapiens
ggcgcgccagtcctaggtcttcagtctgacatttctgacatttctgacattactcccatttctgacattactcccatttctgacatttctgacatttctgacatttctgacatttctgacattactcccatttctgacattactcccatttctgacattactcccatttctgacatttctgacatttccgactcggaccgatg

SEQ ID NO: 16293 - DNA, 203 bp, Homo sapiens
ggcgcgccagtcctctttcttcagtctgacatttctgacatttctgacattactcccatttctgacattactcccatttctgacatttctgacatttctgacatttctgacatttctgacattactcccatttctgacattactcccatttctgacatttctgacatttctgacatttctgacatttccgactcggaccgatg

SEQ ID NO: 16294 - DNA, 203 bp, Homo sapiens
ggcgcgccagtcctaatcggtcagtctgacatttctgacatttctgacattactcccatttctgacattactcccatttctgacatttctgacatttctgacatttctgacatttctgacattactcccatttctgacatttctgacatttctgacattactcccatttctgacattactcccatttccgactcggaccgatg

SEQ ID NO: 16295 - DNA, 203 bp, Homo sapiens
ggcgcgccagtccttgtccaagaatctgacatttctgacatttctgacattactcccatttctgacattactcccatttctgacatttctgacatttctgacatttctgacatttctgacattactcccatttctgacatttctgacatttctgacattactcccatttctgacatttctgacatttccgactcggaccgatg

SEQ ID NO: 16296 - DNA, 203 bp, Homo sapiens
ggcgcgccagtcctagtcaactgatctgacatttctgacatttctgacattactcccatttctgacattactcccatttctgacatttctgacatttctgacatttctgacatttctgacattactcccatttctgacatttctgacatttctgacatttctgacatttctgacattactcccatttccgactcggaccgatg

SEQ ID NO: 16297 - DNA, 203 bp, Homo sapiens
ggcgcgccagtcctagtgaagccatctgacatttctgacatttctgacattactcccatttctgacattactcccatttctgacatttctgacatttctgacatttctgacatttctgacatttctgacatttctgacattactcccatttctgacatttctgacatttctgacattactcccatttccgactcggaccgatg

SEQ ID NO: 16298 - DNA, 203 bp, Homo sapiens
ggcgcgccagtccttacagttaagtctgacatttctgacatttctgacattactcccatttctgacattactcccatttctgacatttctgacatttctgacatttctgacatttctgacatttctgacatttctgacatttctgacatttctgacattactcccatttctgacattactcccatttccgactcggaccgatg

SEQ ID NO: 16299 - DNA, 203 bp, Homo sapiens
ggcgcgccagtcctatccttgccatctgacatttctgacatttctgacattactcccatttctgacatttctgacatttctgacattactcccatttctgacattactcccatttctgacattactcccatttctgacattactcccatttctgacattactcccatttctgacattactcccatttccgactcggaccgatg

SEQ ID NO: 16300 - DNA, 203 bp, Homo sapiens
ggcgcgccagtcctatcaaaggattctgacatttctgacatttctgacattactcccatttctgacatttctgacatttctgacattactcccatttctgacattactcccatttctgacattactcccatttctgacattactcccatttctgacattactcccatttctgacatttctgacatttccgactcggaccgatg

SEQ ID NO: 16301 - DNA, 203 bp, Homo sapiens
ggcgcgccagtcctctagtgagtttctgacatttctgacatttctgacattactcccatttctgacatttctgacatttctgacattactcccatttctgacattactcccatttctgacattactcccatttctgacattactcccatttctgacatttctgacatttctgacattactcccatttccgactcggaccgatg

SEQ ID NO: 16302 - DNA, 203 bp, Homo sapiens
ggcgcgccagtcctcagcagagcatctgacatttctgacatttctgacattactcccatttctgacatttctgacatttctgacattactcccatttctgacattactcccatttctgacattactcccatttctgacatttctgacatttctgacattactcccatttctgacattactcccatttccgactcggaccgatg

SEQ ID NO: 16303 - DNA, 203 bp, Homo sapiens
ggcgcgccagtcctccagtgagaatctgacatttctgacatttctgacattactcccatttctgacatttctgacatttctgacattactcccatttctgacattactcccatttctgacatttctgacatttctgacattactcccatttctgacattactcccatttctgacattactcccatttccgactcggaccgatg

SEQ ID NO: 16304 - DNA, 203 bp, Homo sapiens
ggcgcgccagtcctagatacactatctgacatttctgacatttctgacattactcccatttctgacatttctgacatttctgacattactcccatttctgacattactcccatttctgacatttctgacatttctgacattactcccatttctgacatttctgacatttctgacattactcccatttccgactcggaccgatg

SEQ ID NO: 16305 - DNA, 203 bp, Homo sapiens
ggcgcgccagtcctatcacaaaggtctgacatttctgacatttctgacattactcccatttctgacatttctgacatttctgacattactcccatttctgacattactcccatttctgacatttctgacatttctgacatttctgacatttctgacattactcccatttctgacatttctgacatttccgactcggaccgatg

SEQ ID NO: 16306 - DNA, 203 bp, Homo sapiens
ggcgcgccagtcctacctgttcgttctgacatttctgacatttctgacattactcccatttctgacatttctgacatttctgacattactcccatttctgacatttctgacatttctgacattactcccatttctgacattactcccatttctgacattactcccatttctgacatttctgacatttccgactcggaccgatg

SEQ ID NO: 16307 - DNA, 203 bp, Homo sapiens
ggcgcgccagtcctatccactgtttctgacatttctgacatttctgacattactcccatttctgacatttctgacatttctgacattactcccatttctgacatttctgacatttctgacattactcccatttctgacatttctgacatttctgacattactcccatttctgacattactcccatttccgactcggaccgatg

SEQ ID NO: 16308 - DNA, 203 bp, Homo sapiens
ggcgcgccagtcctcctttacaggtctgacatttctgacatttctgacattactcccatttctgacatttctgacatttctgacattactcccatttctgacatttctgacatttctgacattactcccatttctgacatttctgacatttctgacatttctgacatttctgacattactcccatttccgactcggaccgatg

SEQ ID NO: 16309 - DNA, 203 bp, Homo sapiens
ggcgcgccagtcctcctgatcatttctgacatttctgacatttctgacattactcccatttctgacatttctgacatttctgacattactcccatttctgacatttctgacatttctgacatttctgacatttctgacattactcccatttctgacattactcccatttctgacattactcccatttccgactcggaccgatg

SEQ ID NO: 16310 - DNA, 203 bp, Homo sapiens
ggcgcgccagtcctcctttctgattctgacatttctgacatttctgacattactcccatttctgacatttctgacatttctgacattactcccatttctgacatttctgacatttctgacatttctgacatttctgacatttctgacatttctgacattactcccatttctgacattactcccatttccgactcggaccgatg

SEQ ID NO: 16311 - DNA, 203 bp, Homo sapiens
ggcgcgccagtcctctcactctgatctgacatttctgacatttctgacattactcccatttctgacatttctgacatttctgacattactcccatttctgacatttctgacatttctgacatttctgacatttctgacatttctgacatttctgacatttctgacatttctgacattactcccatttccgactcggaccgatg

SEQ ID NO: 16312 - DNA, 203 bp, Homo sapiens
ggcgcgccagtcctatcagagatttctgacatttctgacatttctgacattactcccatttctgacatttctgacatttctgacattactcccatttctgacatttctgacatttctgacatttctgacatttctgacatttctgacatttctgacatttctgacatttctgacatttctgacatttccgactcggaccgatg

SEQ ID NO: 16313 - DNA, 203 bp, Homo sapiens
ggcgcgccagtcctatgaccagattctgacatttctgacatttctgacattactcccatttctgacatttctgacatttctgacatttctgacatttctgacattactcccatttctgacattactcccatttctgacattactcccatttctgacattactcccatttctgacattactcccatttccgactcggaccgatg

SEQ ID NO: 16314 - DNA, 203 bp, Homo sapiens
ggcgcgccagtcctcaagattctatctgacatttctgacatttctgacattactcccatttctgacatttctgacatttctgacatttctgacatttctgacattactcccatttctgacattactcccatttctgacattactcccatttctgacattactcccatttctgacatttctgacatttccgactcggaccgatg

SEQ ID NO: 16315 - DNA, 203 bp, Homo sapiens
ggcgcgccagtcctaacgcttacttctgacatttctgacatttctgacattactcccatttctgacatttctgacatttctgacatttctgacatttctgacattactcccatttctgacattactcccatttctgacatttctgacatttctgacattactcccatttctgacatttctgacatttccgactcggaccgatg

SEQ ID NO: 16316 - DNA, 203 bp, Homo sapiens
ggcgcgccagtcctccaaaagatttctgacatttctgacatttctgacattactcccatttctgacatttctgacatttctgacatttctgacatttctgacattactcccatttctgacatttctgacatttctgacattactcccatttctgacattactcccatttctgacattactcccatttccgactcggaccgatg

SEQ ID NO: 16317 - DNA, 203 bp, Homo sapiens
ggcgcgccagtcctttaagttttgtctgacatttctgacatttctgacattactcccatttctgacatttctgacatttctgacatttctgacatttctgacattactcccatttctgacatttctgacatttctgacattactcccatttctgacatttctgacatttctgacattactcccatttccgactcggaccgatg

SEQ ID NO: 16318 - DNA, 203 bp, Homo sapiens
ggcgcgccagtccttgcttactgttctgacatttctgacatttctgacattactcccatttctgacatttctgacatttctgacatttctgacatttctgacattactcccatttctgacatttctgacatttctgacatttctgacatttctgacatttctgacatttctgacattactcccatttccgactcggaccgatg

SEQ ID NO: 16319 - DNA, 203 bp, Homo sapiens
ggcgcgccagtccttggtaggatatctgacatttctgacatttctgacattactcccatttctgacatttctgacatttctgacatttctgacatttctgacattactcccatttctgacatttctgacatttctgacatttctgacatttctgacatttctgacatttctgacatttctgacatttccgactcggaccgatg

SEQ ID NO: 16320 - DNA, 203 bp, Homo sapiens
ggcgcgccagtccttctttgagcttctgacatttctgacatttctgacattactcccatttctgacatttctgacatttctgacatttctgacatttctgacatttctgacatttctgacattactcccatttctgacattactcccatttctgacattactcccatttctgacattactcccatttccgactcggaccgatg

SEQ ID NO: 16321 - DNA, 203 bp, Homo sapiens
ggcgcgccagtcctctcaaaactatctgacatttctgacatttctgacattactcccatttctgacatttctgacatttctgacatttctgacatttctgacatttctgacatttctgacattactcccatttctgacattactcccatttctgacatttctgacatttctgacattactcccatttccgactcggaccgatg

SEQ ID NO: 16322 - DNA, 203 bp, Homo sapiens
ggcgcgccagtcctaatacagcgatctgacatttctgacatttctgacattactcccatttctgacatttctgacatttctgacatttctgacatttctgacatttctgacatttctgacattactcccatttctgacattactcccatttctgacatttctgacatttctgacatttctgacatttccgactcggaccgatg

SEQ ID NO: 16323 - DNA, 203 bp, Homo sapiens
ggcgcgccagtccttcatggtttttctgacatttctgacatttctgacattactcccatttctgacatttctgacatttctgacatttctgacatttctgacatttctgacatttctgacattactcccatttctgacatttctgacatttctgacattactcccatttctgacattactcccatttccgactcggaccgatg

SEQ ID NO: 16324 - DNA, 203 bp, Homo sapiens
ggcgcgccagtcctctgagaacaatctgacatttctgacatttctgacattactcccatttctgacatttctgacatttctgacatttctgacatttctgacatttctgacatttctgacatttctgacatttctgacatttctgacatttctgacatttctgacatttctgacattactcccatttccgactcggaccgatg

SEQ ID NO: 16325 - DNA, 203 bp, Homo sapiens
ggcgcgccagtccttgttactggatctgacatttctgacatttctgacattactcccatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16326 - DNA, 203 bp, Homo sapiens
ggcgcgccagtcctcttgcacaaatctgacatttctgacatttctgacattaggagcgagcgaccaaaggaaccataactgatttaatgagccattcgcagtttcactgtaccggccgtgcgtactcagacatgcatggcttaatctttgagacaagcatatgctactggcaggatctctgacatttccgactcggaccgatg

SEQ ID NO: 16327 - DNA, 203 bp, Homo sapiens
ggcgcgccagtccttccatgagagtctgacatttctgacatttctgacattccggcgggttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16328 - DNA, 203 bp, Homo sapiens
ggcgcgccagtcctagtccatggatctgacatttctgacatttctgacattccggcgggttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16329 - DNA, 203 bp, Homo sapiens
ggcgcgccagtcctcaagtaactgtctgacatttctgacatttctgacattcgtcaattcctttacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16330 - DNA, 203 bp, Homo sapiens
ggcgcgccagtcctacgcttactttctgacatttctgacatttctgacattcttggcaaatctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16331 - DNA, 203 bp, Homo sapiens
ggcgcgccagtcctaaccgttaggtctgacatttctgacatttctgacatttacgacggtatctgatcgtcttcgaacctccgactttcgttcttgattaatgaaaacattcttggcaaatgctttcgctctggtccgtcttgcgccggtccaagaatttcacctctagcggcgcattctgacatttccgactcggaccgatg

SEQ ID NO: 16332 - DNA, 203 bp, Homo sapiens
ggcgcgccagtcctcactcagtcttctgacatttctgacatttctgacatttaggctccactcctggtggtgcccttccgtcaattcctttaagtttcagctttgcaaccatactccccccggaacccaaagactttggtttcccggaagctgcccggcgggtcatgggaataacgttctgacatttccgactcggaccgatg

SEQ ID NO: 16333 - DNA, 203 bp, Homo sapiens
ggcgcgccagtcctactcagtgcatctgacatttctgacatttctgacatttcaccggccgttgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16334 - DNA, 203 bp, Homo sapiens
ggcgcgccagtcctaaactgagattctgacatttctgacatttctgacatttcaccggccgttgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16335 - DNA, 203 bp, Homo sapiens
ggcgcgccagtcctaacctcagtttctgacatttctgacatttctgacatttcaccggccgttgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 16336 - DNA, 203 bp, Homo sapiens
ggcgcgccagtcctctttgaggtctctgacatttctgacatttctgacatttcccggcgggttgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16337 - DNA, 203 bp, Homo sapiens
ggcgcgccagtcctgaaaggtccttctgacatttctgacatttctgacatttcccggcgggttgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16338 - DNA, 203 bp, Homo sapiens
ggcgcgccagtcctaacgagcgtctctgacatttctgacatttctgacatttcccggcgggttgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16339 - DNA, 203 bp, Homo sapiens
ggcgcgccagtcctgagaccgacttctgacatttctgacatttctgacatttcggaattaaccagacaaatcgctccaccaactaagaacggccatgcaccaccacccacggaatcgagaaagagctatcaatctgtcaatcctgtccgtgtccgggccgggtgaggtttcccgtgttctgacatttccgactcggaccgatg

SEQ ID NO: 16340 - DNA, 203 bp, Homo sapiens
ggcgcgccagtcctgaccggtcattctgacatttctgacatttctgacatttctgaattaaccagacaaatcgctccaccaactaagaacggccatgcaccaccacccacggaatcgagaaagagctatcaatctgtcaatcctgtccgtgtccgggccgggtgaggtttccccatttctgacatttccgactcggaccgatg

SEQ ID NO: 16341 - DNA, 203 bp, Homo sapiens
ggcgcgccagtcctgaaccttgcttctgacatttctgacatttctgacatttctgacaaccggccgttttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16342 - DNA, 203 bp, Homo sapiens
ggcgcgccagtcctgagctgtatctctgacatttctgacatttctgacatttctgacacgtcaattcctttagacatttctgacatttctgacatttctgacatttctgacatttctgacatttctgacatttctgacatttctgacatttctgacatttctgacatttctgacattttcttggcaaacgactcggaccgatg

SEQ ID NO: 16343 - DNA, 203 bp, Homo sapiens
ggcgcgccagtcctgagttaccgttctgacatttctgacatttctgacatttctgacatactcctggtggtgcccttccgtcaattcctttaagtttcagctttgcaaccatactccccccggaacccaaagactttggtttcccggaagctgcccggcgggtcatgggctgacatttctgacatttccgactcggaccgatg

SEQ ID NO: 16344 - DNA, 203 bp, Homo sapiens
ggcgcgccagtcctacgacctctctctgacatttctgacatttctgacatttctgacatgcgaccaaaggaaccataactgatttaatgagccattcgcagtttcactgtaccggccgtgcgtactcagacatgcatggcttaatctttgagacaagcatatgctactgctgacatttctgacatttccgactcggaccgatg

SEQ ID NO: 16345 - DNA, 203 bp, Homo sapiens
ggcgcgccagtcctgacctctgcttctgacatttctgacatttctgacatttctgacattaccagacaaatcgctccaccaactaagaacggccatgcaccaccacccacggaatcgagaaagagctatcaatctgtcaatcctgtccgtgtccgggccgggtgaggttctgacatttctgacatttccgactcggaccgatg

SEQ ID NO: 16346 - DNA, 203 bp, Homo sapiens
ggcgcgccagtcctgactcagagatctgacatttctgacatttctgacatttctgacattaccggccgttctgacatttctgacatttctgacatttctgacatttctgacatttctgacatttctgacatttctgacatttctgacatttctgacatttctgacatttctgacatttctgacatttccgactcggaccgatg

SEQ ID NO: 16347 - DNA, 203 bp, Homo sapiens
ggcgcgccagtcctgacggtcatttctgacatttctgacatttctgacatttctgacattaccggccgttctgacatttctgacatttctgacatttctgacatttctgacatttctgacatttctgacatttctgacatttctgacatttctgacatttctgacatttctgacatttctgtactccccgactcggaccgatg

SEQ ID NO: 16348 - DNA, 203 bp, Homo sapiens
ggcgcgccagtcctgagcagctcatctgacatttctgacatttctgacatttctgacattcacggaatcgagaacatttctgacatttctgacatttctgacatttctgacatttctgacatttctgacatttctgacatttctgacatttctgacatttctgacatttctgacatttcccggcgggtcgactcggaccgatg

SEQ ID NO: 16349 - DNA, 203 bp, Homo sapiens
ggcgcgccagtcctacggtcatgatctgacatttctgacatttctgacatttctgacattccggcgggttctgacatttctgacatttctgacatttctgacatttctgacatttctgacatttctgacatttctgacatttctgacatttctgacatttctgacatttctgacatttctgtactccccgactcggaccgatg

SEQ ID NO: 16350 - DNA, 203 bp, Homo sapiens
ggcgcgccagtccttggattctgttctgacatttctgacatttctgacatttctgacattccggcgggttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16351 - DNA, 203 bp, Homo sapiens
ggcgcgccagtcctcagaagagtctctgacatttctgacatttctgacatttctgacattcgtcaattcctttacatttctgacatttctgacatttctgacatttctgacatttctgacatttctgacatttctgacatttctgacatttctgacatttctgacatttctgacatttcccggcgggtcgactcggaccgatg

SEQ ID NO: 16352 - DNA, 203 bp, Homo sapiens
ggcgcgccagtcctttgagtgagttctgacatttctgacatttctgacatttctgacattcttggcaaatctgacatttctgacatttctgacatttctgacatttctgacatttctgacatttctgacatttctgacatttctgacatttctgacatttctgacatttctgacatttctgacatttccgactcggaccgatg

SEQ ID NO: 16353 - DNA, 203 bp, Homo sapiens
ggcgcgccagtcctgaacagtctctctgacatttctgacatttctgacatttctgacattcttggcaaatctgacatttctgacatttctgacatttctgacatttctgacatttctgacatttctgacatttctgacatttctgacatttctgacatttctgacatttctgaccgtcaattcctttacgactcggaccgatg

SEQ ID NO: 16354 - DNA, 203 bp, Homo sapiens
ggcgcgccagtcctagagtagtcatctgacatttctgacatttctgacatttctgacatttactccctttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16355 - DNA, 203 bp, Homo sapiens
ggcgcgccagtcctttaactagtttctgacatttctgacatttctgacatttctgacatttccgtcaattcctttatttctgacatttctgacatttctgacatttctgacatttctgacatttctgacatttctgacatttctgacatttctgacatttctgacatttctgacatttctgtactccccgactcggaccgatg

SEQ ID NO: 16356 - DNA, 203 bp, Homo sapiens
ggcgcgccagtccttgactactcatctgacatttctgacatttctgacatttctgacatttctagacaaatcgctccaccaactaagaacggccatgcaccaccacccacggaatcgagaaagagctatcaatctgtcaatcctgtccgtgtccgggccgggtgaatttctgacatttctgacatttccgactcggaccgatg

SEQ ID NO: 16357 - DNA, 203 bp, Homo sapiens
ggcgcgccagtcctttcaagaagttctgacatttctgacatttctgacatttctgacatttctccaaaggaaccataactgatttaatgagccattcgcagtttcactgtaccggccgtgcgtactcagacatgcatggcttaatctttgagacaagcatatgctatttctgacatttctgacatttccgactcggaccgatg

SEQ ID NO: 16358 - DNA, 203 bp, Homo sapiens
ggcgcgccagtcctctacttaacatctgacatttctgacatttctgacatttctgacatttctccggcgggtgacatttctgacatttctgacatttctgacatttctgacatttctgacatttctgacatttctgacatttctgacatttctgacatttctgacatttctgacattttcttggcaaacgactcggaccgatg

SEQ ID NO: 16359 - DNA, 203 bp, Homo sapiens
ggcgcgccagtccttgagtagagttctgacatttctgacatttctgacatttctgacatttctgaaccggccgtcatttctgacatttctgacatttctgacatttctgacatttctgacatttctgacatttctgacatttctgacatttctgacatttctgacatttctgacatttcccggcgggtcgactcggaccgatg

SEQ ID NO: 16360 - DNA, 203 bp, Homo sapiens
ggcgcgccagtcctcctactactttctgacatttctgacatttctgacatttctgacatttctgaagtcaaattaagccgcaggctccactcctggtggtgcccttccgtcaattcctttaagtttcagctttgcaaccatactccccccggaacccaaagacacatttctgacatttctgacatttccgactcggaccgatg

SEQ ID NO: 16361 - DNA, 203 bp, Homo sapiens
ggcgcgccagtcctctctgaagtttctgacatttctgacatttctgacatttctgacatttctgacaaccggccgttttctgacatttctgacatttctgacatttctgacatttctgacatttctgacatttctgacatttctgacatttctgacatttctgacatttctgaccacggaatcgagaacgactcggaccgatg

SEQ ID NO: 16362 - DNA, 203 bp, Homo sapiens
ggcgcgccagtcctaacttctctatctgacatttctgacatttctgacatttctgacatttctgacacacggaatcgagaagacatttctgacatttctgacatttctgacatttctgacatttctgacatttctgacatttctgacatttctgacatttctgacatttctgacatttcaccggccgtcgactcggaccgatg

SEQ ID NO: 16363 - DNA, 203 bp, Homo sapiens
ggcgcgccagtcctaggtctgttgtctgacatttctgacatttctgacatttctgacatttctgacaccggcgggttttctgacatttctgacatttctgacatttctgacatttctgacatttctgacatttctgacatttctgacatttctgacatttctgacatttctgaccgtcaattcctttacgactcggaccgatg

SEQ ID NO: 16364 - DNA, 203 bp, Homo sapiens
ggcgcgccagtcctccaacaggcttctgacatttctgacatttctgacatttctgacatttctgacacggaatcgagaactgacatttctgacatttctgacatttctgacatttctgacatttctgacatttctgacatttctgacatttctgacatttctgacatttctgacattttcttggcaaacgactcggaccgatg

SEQ ID NO: 16365 - DNA, 203 bp, Homo sapiens
ggcgcgccagtccttagttaagaatctgacatttctgacatttctgacatttctgacatttctgacacgtcaattcctttagacatttctgacatttctgacatttctgacatttctgacatttctgacatttctgacatttctgacatttctgacatttctgacatttctgacatttcccggcgggtcgactcggaccgatg

SEQ ID NO: 16366 - DNA, 203 bp, Homo sapiens
ggcgcgccagtccttagatacaagtctgacatttctgacatttctgacatttctgacatttctgacataccggccgtttctgacataccggccgtttctgacataccggccgtttctgacataccggccgtttctgacataccggccgtttctgacataccggccgtttctgacatttctgacatttccgactcggaccgatg

SEQ ID NO: 16367 - DNA, 203 bp, Homo sapiens
ggcgcgccagtcctacaaagtacttctgacatttctgacatttctgacatttctgacatttctgacataccggccgtttctgacataccggccgtttctgacataccggccgtttctgacataccggccgtttctgacatttctgacatttctgacataccggccgtttctgacataccggccgtttccgactcggaccgatg

SEQ ID NO: 16368 - DNA, 203 bp, Homo sapiens
ggcgcgccagtcctaaagtaccattctgacatttctgacatttctgacatttctgacatttctgacataccggccgtttctgacataccggccgtttctgacataccggccgtttctgacatttctgacatttctgacataccggccgtttctgacatttctgacatttctgacataccggccgtttccgactcggaccgatg

SEQ ID NO: 16369 - DNA, 203 bp, Homo sapiens
ggcgcgccagtcctactgctttggtctgacatttctgacatttctgacatttctgacatttctgacataccggccgtttctgacataccggccgtttctgacatttctgacatttctgacataccggccgtttctgacataccggccgtttctgacataccggccgtttctgacatttctgacatttccgactcggaccgatg

SEQ ID NO: 16370 - DNA, 203 bp, Homo sapiens
ggcgcgccagtcctaacctttggttctgacatttctgacatttctgacatttctgacatttctgacataccggccgtttctgacataccggccgtttctgacatttctgacatttctgacataccggccgtttctgacataccggccgtttctgacatttctgacatttctgacataccggccgtttccgactcggaccgatg

SEQ ID NO: 16371 - DNA, 203 bp, Homo sapiens
ggcgcgccagtcctcaactacaggtctgacatttctgacatttctgacatttctgacatttctgacataccggccgtttctgacataccggccgtttctgacatttctgacatttctgacataccggccgtttctgacatttctgacatttctgacataccggccgtttctgacatttctgacatttccgactcggaccgatg

SEQ ID NO: 16372 - DNA, 203 bp, Homo sapiens
ggcgcgccagtcctgagctactcttctgacatttctgacatttctgacatttctgacatttctgacataccggccgtttctgacataccggccgtttctgacatttctgacatttctgacataccggccgtttctgacatttctgacatttctgacatttctgacatttctgacataccggccgtttccgactcggaccgatg

SEQ ID NO: 16373 - DNA, 203 bp, Homo sapiens
ggcgcgccagtcctagtccaggtttctgacatttctgacatttctgacatttctgacatttctgacataccggccgtttctgacataccggccgtttctgacatttctgacatttctgacataccggccgtttctgacatttctgacatttctgacatttctgacatttctgacatttctgacatttccgactcggaccgatg

SEQ ID NO: 16374 - DNA, 203 bp, Homo sapiens
ggcgcgccagtcctaaaagtacattctgacatttctgacatttctgacatttctgacatttctgacataccggccgtttctgacataccggccgtttctgacatttctgacatttctgacatttctgacatttctgacatttctgacatttctgacataccggccgtttctgacataccggccgtttccgactcggaccgatg

SEQ ID NO: 16375 - DNA, 203 bp, Homo sapiens
ggcgcgccagtcctacgactgttctctgacatttctgacatttctgacatttctgacatttctgacataccggccgtttctgacataccggccgtttctgacatttctgacatttctgacatttctgacatttctgacatttctgacatttctgacataccggccgtttctgacatttctgacatttccgactcggaccgatg

SEQ ID NO: 16376 - DNA, 203 bp, Homo sapiens
ggcgcgccagtcctgaatctggtgtctgacatttctgacatttctgacatttctgacatttctgacataccggccgtttctgacataccggccgtttctgacatttctgacatttctgacatttctgacatttctgacatttctgacatttctgacatttctgacatttctgacataccggccgtttccgactcggaccgatg

SEQ ID NO: 16377 - DNA, 203 bp, Homo sapiens
ggcgcgccagtcctcacagtggtttctgacatttctgacatttctgacatttctgacatttctgacataccggccgtttctgacatttctgacatttctgacataccggccgtttctgacataccggccgtttctgacataccggccgtttctgacatttctgacatttctgacataccggccgtttccgactcggaccgatg

SEQ ID NO: 16378 - DNA, 203 bp, Homo sapiens
ggcgcgccagtcctagtggtgctgtctgacatttctgacatttctgacatttctgacatttctgacataccggccgtttctgacatttctgacatttctgacataccggccgtttctgacataccggccgtttctgacatttctgacatttctgacataccggccgtttctgacataccggccgtttccgactcggaccgatg

SEQ ID NO: 16379 - DNA, 203 bp, Homo sapiens
ggcgcgccagtccttgaccacttctctgacatttctgacatttctgacatttctgacatttctgacataccggccgtttctgacatttctgacatttctgacataccggccgtttctgacataccggccgtttctgacatttctgacatttctgacataccggccgtttctgacatttctgacatttccgactcggaccgatg

SEQ ID NO: 16380 - DNA, 203 bp, Homo sapiens
ggcgcgccagtcctcaagagtggttctgacatttctgacatttctgacatttctgacatttctgacataccggccgtttctgacatttctgacatttctgacataccggccgtttctgacataccggccgtttctgacatttctgacatttctgacatttctgacatttctgacataccggccgtttccgactcggaccgatg

SEQ ID NO: 16381 - DNA, 203 bp, Homo sapiens
ggcgcgccagtccttcaagttctttctgacatttctgacatttctgacatttctgacatttctgacataccggccgtttctgacatttctgacatttctgacataccggccgtttctgacatttctgacatttctgacataccggccgtttctgacatttctgacatttctgacataccggccgtttccgactcggaccgatg

SEQ ID NO: 16382 - DNA, 203 bp, Homo sapiens
ggcgcgccagtcctttgtaccagttctgacatttctgacatttctgacatttctgacatttctgacataccggccgtttctgacatttctgacatttctgacataccggccgtttctgacatttctgacatttctgacataccggccgtttctgacatttctgacatttctgacatttctgacatttccgactcggaccgatg

SEQ ID NO: 16383 - DNA, 203 bp, Homo sapiens
ggcgcgccagtcctttggtgactgtctgacatttctgacatttctgacatttctgacatttctgacataccggccgtttctgacatttctgacatttctgacataccggccgtttctgacatttctgacatttctgacatttctgacatttctgacataccggccgtttctgacatttctgacatttccgactcggaccgatg

SEQ ID NO: 16384 - DNA, 203 bp, Homo sapiens
ggcgcgccagtcctagagctctggtctgacatttctgacatttctgacatttctgacatttctgacataccggccgtttctgacatttctgacatttctgacataccggccgtttctgacatttctgacatttctgacatttctgacatttctgacatttctgacatttctgacataccggccgtttccgactcggaccgatg

SEQ ID NO: 16385 - DNA, 203 bp, Homo sapiens
ggcgcgccagtcctatgagtacgttctgacatttctgacatttctgacatttctgacatttctgacataccggccgtttctgacatttctgacatttctgacatttctgacatttctgacataccggccgtttctgacataccggccgtttctgacataccggccgtttctgacatttctgacatttccgactcggaccgatg

SEQ ID NO: 16386 - DNA, 203 bp, Homo sapiens
ggcgcgccagtcctacgtactcgttctgacatttctgacatttctgacatttctgacatttctgacataccggccgtttctgacatttctgacatttctgacatttctgacatttctgacataccggccgtttctgacatttctgacatttctgacataccggccgtttctgacataccggccgtttccgactcggaccgatg

SEQ ID NO: 16387 - DNA, 203 bp, Homo sapiens
ggcgcgccagtcctttcaaccggttctgacatttctgacatttctgacatttctgacatttctgacataccggccgtttctgacatttctgacatttctgacatttctgacatttctgacataccggccgtttctgacatttctgacatttctgacataccggccgtttctgacatttctgacatttccgactcggaccgatg

SEQ ID NO: 16388 - DNA, 203 bp, Homo sapiens
ggcgcgccagtcctccatgaagattctgacatttctgacatttctgacatttctgacatttctgacataccggccgtttctgacatttctgacatttctgacatttctgacatttctgacatttctgacatttctgacataccggccgtttctgacataccggccgtttctgacataccggccgtttccgactcggaccgatg

SEQ ID NO: 16389 - DNA, 203 bp, Homo sapiens
ggcgcgccagtccttgaatcttcatctgacatttctgacatttctgacatttctgacatttctgacataccggccgtttctgacatttctgacatttctgacatttctgacatttctgacatttctgacatttctgacataccggccgtttctgacatttctgacatttctgacataccggccgtttccgactcggaccgatg

SEQ ID NO: 16390 - DNA, 203 bp, Homo sapiens
ggcgcgccagtcctttgaaagacttctgacatttctgacatttctgacatttctgacatttctgacataccggccgtttctgacatttctgacatttctgacatttctgacatttctgacatttctgacatttctgacataccggccgtttctgacatttctgacatttctgacatttctgacatttccgactcggaccgatg

SEQ ID NO: 16391 - DNA, 203 bp, Homo sapiens
ggcgcgccagtcctttagcctaaatctgacatttctgacatttctgacatttctgacatttctgacataccggccgtttctgacatttctgacatttctgacatttctgacatttctgacatttctgacatttctgacatttctgacatttctgacataccggccgtttctgacataccggccgtttccgactcggaccgatg

SEQ ID NO: 16392 - DNA, 203 bp, Homo sapiens
ggcgcgccagtcctacgtagacagtctgacatttctgacatttctgacatttctgacatttctgacataccggccgtttctgacatttctgacatttctgacatttctgacatttctgacatttctgacatttctgacatttctgacatttctgacataccggccgtttctgacatttctgacatttccgactcggaccgatg

SEQ ID NO: 16393 - DNA, 203 bp, Homo sapiens
ggcgcgccagtcctactgaccgagtctgacatttctgacatttctgacatttctgacatttctgacatactccccatttctgacatttctgacatttctgacatttctgacatttctgacatttctgacatttctgacatttctgacatttctgacatttctgacatttctgacatttcccggcgggtcgactcggaccgatg

SEQ ID NO: 16394 - DNA, 203 bp, Homo sapiens
ggcgcgccagtcctaagctagagttctgacatttctgacatttctgacatttctgacatttctgacatactccccccggaacccaaagactttggtttcccggaagctgcccggcgggtcatgggaataacgccgccgcatcgccggtcggcatcgtttattgacatttctgacatttctgacatttccgactcggaccgatg

SEQ ID NO: 16395 - DNA, 203 bp, Homo sapiens
ggcgcgccagtccttggcctgatttctgacatttctgacatttctgacatttctgacatttctgacatcacggaatcgagaaacatcacggaatcgagaaacatcacggaatcgagaaacatcacggaatcgagaaacatttctgacatttctgacatttctgacatttctgacatttctgacatttccgactcggaccgatg

SEQ ID NO: 16396 - DNA, 203 bp, Homo sapiens
ggcgcgccagtccttaaaccactatctgacatttctgacatttctgacatttctgacatttctgacatcacggaatcgagaaacatcacggaatcgagaaacatttctgacatttctgacatttctgacatttctgacatcacggaatcgagaaacatttctgacatttctgacatttctgacatttccgactcggaccgatg

SEQ ID NO: 16397 - DNA, 203 bp, Homo sapiens
ggcgcgccagtcctactagtggtttctgacatttctgacatttctgacatttctgacatttctgacatcacggaatcgagaaacatcacggaatcgagaaacatttctgacatttctgacatttctgacatttctgacatttctgacatttctgacatcacggaatcgagaaacatttctgacatttccgactcggaccgatg

SEQ ID NO: 16398 - DNA, 203 bp, Homo sapiens
ggcgcgccagtcctcctcagcatatctgacatttctgacatttctgacatttctgacatttctgacatcacggaatcgagaaacatttctgacatttctgacatcacggaatcgagaaacatttctgacatttctgacatcacggaatcgagaaacatttctgacatttctgacatttctgacatttccgactcggaccgatg

SEQ ID NO: 16399 - DNA, 203 bp, Homo sapiens
ggcgcgccagtcctcaaaggtgtttctgacatttctgacatttctgacatttctgacatttctgacatcacggaatcgagaaacatttctgacatttctgacatttctgacatttctgacatttctgacatttctgacatcacggaatcgagaaacatcacggaatcgagaaacatttctgacatttccgactcggaccgatg

SEQ ID NO: 16400 - DNA, 203 bp, Homo sapiens
ggcgcgccagtcctctacaccatgtctgacatttctgacatttctgacatttctgacatttctgacatcacggaatcgagaaacatttctgacatttctgacatttctgacatttctgacatttctgacatttctgacatcacggaatcgagaaacatttctgacatttctgacatttctgacatttccgactcggaccgatg

SEQ ID NO: 16401 - DNA, 203 bp, Homo sapiens
ggcgcgccagtcctattcttcatgtctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16402 - DNA, 203 bp, Homo sapiens
ggcgcgccagtcctcttactgatctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16403 - DNA, 203 bp, Homo sapiens
ggcgcgccagtcctaagagaactctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16404 - DNA, 203 bp, Homo sapiens
ggcgcgccagtccttcaactactctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16405 - DNA, 203 bp, Homo sapiens
ggcgcgccagtcctcacttgtatctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16406 - DNA, 203 bp, Homo sapiens
ggcgcgccagtccttatgaaggtctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16407 - DNA, 203 bp, Homo sapiens
ggcgcgccagtcctgagattctgatctgacatttctgacatttctgacatttctgacatttctgacatccggcgggtttctgacatccggcgggtttctgacatccggcgggtttctgacatccggcgggtttctgacatttctgacatttctgacatccggcgggtttctgacatttctgacatttccgactcggaccgatg

SEQ ID NO: 16408 - DNA, 203 bp, Homo sapiens
ggcgcgccagtcctttacactgtctctgacatttctgacatttctgacatttctgacatttctgacatccggcgggtttctgacatccggcgggtttctgacatccggcgggtttctgacatccggcgggtttctgacatttctgacatttctgacatttctgacatttctgacatttctgacatttccgactcggaccgatg

SEQ ID NO: 16409 - DNA, 203 bp, Homo sapiens
ggcgcgccagtccttgagttgttctctgacatttctgacatttctgacatttctgacatttctgacatccggcgggtttctgacatccggcgggtttctgacatccggcgggtttctgacatttctgacatttctgacatttctgacatttctgacatttctgacatttctgacatccggcgggtttccgactcggaccgatg

SEQ ID NO: 16410 - DNA, 203 bp, Homo sapiens
ggcgcgccagtcctgacagtatgatctgacatttctgacatttctgacatttctgacatttctgacatccggcgggtttctgacatccggcgggtttctgacatccggcgggtttctgacatttctgacatttctgacatttctgacatttctgacatttctgacatttctgacatttctgacatttccgactcggaccgatg

SEQ ID NO: 16411 - DNA, 203 bp, Homo sapiens
ggcgcgccagtccttaaaggtctctctgacatttctgacatttctgacatttctgacatttctgacatccggcgggtttctgacatccggcgggtttctgacatttctgacatttctgacatccggcgggtttctgacatccggcgggtttctgacatccggcgggtttctgacatttctgacatttccgactcggaccgatg

SEQ ID NO: 16412 - DNA, 203 bp, Homo sapiens
ggcgcgccagtcctgacttgtaagtctgacatttctgacatttctgacatttctgacatttctgacatccggcgggtttctgacatccggcgggtttctgacatttctgacatttctgacatccggcgggtttctgacatccggcgggtttctgacatttctgacatttctgacatccggcgggtttccgactcggaccgatg

SEQ ID NO: 16413 - DNA, 203 bp, Homo sapiens
ggcgcgccagtcctgactttgacttctgacatttctgacatttctgacatttctgacatttctgacatccggcgggtttctgacatccggcgggtttctgacatttctgacatttctgacatccggcgggtttctgacatccggcgggtttctgacatttctgacatttctgacatttctgacatttccgactcggaccgatg

SEQ ID NO: 16414 - DNA, 203 bp, Homo sapiens
ggcgcgccagtcctaactacgttctctgacatttctgacatttctgacatttctgacatttctgacatccggcgggtttctgacatccggcgggtttctgacatttctgacatttctgacatccggcgggtttctgacatttctgacatttctgacatccggcgggtttctgacatccggcgggtttccgactcggaccgatg

SEQ ID NO: 16415 - DNA, 203 bp, Homo sapiens
ggcgcgccagtcctgacgtactaatctgacatttctgacatttctgacatttctgacatttctgacatccggcgggtttctgacatccggcgggtttctgacatttctgacatttctgacatccggcgggtttctgacatttctgacatttctgacatccggcgggtttctgacatttctgacatttccgactcggaccgatg

SEQ ID NO: 16416 - DNA, 203 bp, Homo sapiens
ggcgcgccagtcctgaccaacttatctgacatttctgacatttctgacatttctgacatttctgacatccggcgggtttctgacatccggcgggtttctgacatttctgacatttctgacatccggcgggtttctgacatttctgacatttctgacatttctgacatttctgacatccggcgggtttccgactcggaccgatg

SEQ ID NO: 16417 - DNA, 203 bp, Homo sapiens
ggcgcgccagtcctgaggtagttttctgacatttctgacatttctgacatttctgacatttctgacatccggcgggtttctgacatccggcgggtttctgacatttctgacatttctgacatttctgacatttctgacatccggcgggtttctgacatttctgacatttctgacatccggcgggtttccgactcggaccgatg

SEQ ID NO: 16418 - DNA, 203 bp, Homo sapiens
ggcgcgccagtcctgacgttgtattctgacatttctgacatttctgacatttctgacatttctgacatccggcgggtttctgacatccggcgggtttctgacatttctgacatttctgacatttctgacatttctgacatccggcgggtttctgacatttctgacatttctgacatttctgacatttccgactcggaccgatg

SEQ ID NO: 16419 - DNA, 203 bp, Homo sapiens
ggcgcgccagtcctcttcacctcttctgacatttctgacatttctgacatttctgacatttctgacatccggcgggtttctgacatccggcgggtttctgacatttctgacatttctgacatttctgacatttctgacatttctgacatttctgacatttctgacatttctgacatccggcgggtttccgactcggaccgatg

SEQ ID NO: 16420 - DNA, 203 bp, Homo sapiens
ggcgcgccagtccttttgagtcgttctgacatttctgacatttctgacatttctgacatttctgacatccggcgggtttctgacatttctgacatttctgacatccggcgggtttctgacatccggcgggtttctgacatccggcgggtttctgacatccggcgggtttctgacatccggcgggtttccgactcggaccgatg

SEQ ID NO: 16421 - DNA, 203 bp, Homo sapiens
ggcgcgccagtcctaacaggtgagtctgacatttctgacatttctgacatttctgacatttctgacatccggcgggtttctgacatttctgacatttctgacatccggcgggtttctgacatccggcgggtttctgacatttctgacatttctgacatttctgacatttctgacatccggcgggtttccgactcggaccgatg

SEQ ID NO: 16422 - DNA, 203 bp, Homo sapiens
ggcgcgccagtcctctgttagaggtctgacatttctgacatttctgacatttctgacatttctgacatccggcgggtttctgacatttctgacatttctgacatccggcgggtttctgacatccggcgggtttctgacatttctgacatttctgacatttctgacatttctgacatttctgacatttccgactcggaccgatg

SEQ ID NO: 16423 - DNA, 203 bp, Homo sapiens
ggcgcgccagtcctctctgtgcagtctgacatttctgacatttctgacatttctgacatttctgacatccggcgggtttctgacatttctgacatttctgacatccggcgggtttctgacatttctgacatttctgacatccggcgggtttctgacatccggcgggtttctgacatttctgacatttccgactcggaccgatg

SEQ ID NO: 16424 - DNA, 203 bp, Homo sapiens
ggcgcgccagtcctttcagaacgttctgacatttctgacatttctgacatttctgacatttctgacatccggcgggtttctgacatttctgacatttctgacatttctgacatttctgacatccggcgggtttctgacatttctgacatttctgacatccggcgggtttctgacatccggcgggtttccgactcggaccgatg

SEQ ID NO: 16425 - DNA, 203 bp, Homo sapiens
ggcgcgccagtcctgaatctcacttctgacatttctgacatttctgacatttctgacatttctgacatccggcgggtttctgacatttctgacatttctgacatttctgacatttctgacatttctgacatttctgacatccggcgggtttctgacatccggcgggtttctgacatccggcgggtttccgactcggaccgatg

SEQ ID NO: 16426 - DNA, 203 bp, Homo sapiens
ggcgcgccagtccttcaaggcgtttctgacatttctgacatttctgacatttctgacatttctgacatccggcgggtttctgacatttctgacatttctgacatttctgacatttctgacatttctgacatttctgacatccggcgggtttctgacatttctgacatttctgacatccggcgggtttccgactcggaccgatg

SEQ ID NO: 16427 - DNA, 203 bp, Homo sapiens
ggcgcgccagtcctcaagaacatttctgacatttctgacatttctgacatttctgacatttctgacatccggcgggtttctgacatttctgacatttctgacatttctgacatttctgacatttctgacatttctgacatttctgacatttctgacatccggcgggtttctgacatccggcgggtttccgactcggaccgatg

SEQ ID NO: 16428 - DNA, 203 bp, Homo sapiens
ggcgcgccagtcctgacgttgaggtctgacatttctgacatttctgacatttctgacatttctgacatccggcgggtttctgacatttctgacatttctgacatttctgacatttctgacatttctgacatttctgacatttctgacatttctgacatccggcgggtttctgacatttctgacatttccgactcggaccgatg

SEQ ID NO: 16429 - DNA, 203 bp, Homo sapiens
ggcgcgccagtccttggcctttgatctgacatttctgacatttctgacatttctgacatttctgacatcgtcaattcctttaacatcgtcaattcctttaacatcgtcaattcctttaacatcgtcaattcctttaacatttctgacatttctgacatcgtcaattcctttaacatttctgacatttccgactcggaccgatg

SEQ ID NO: 16430 - DNA, 203 bp, Homo sapiens
ggcgcgccagtcctctcaaggccatctgacatttctgacatttctgacatttctgacatttctgacatcgtcaattcctttaacatcgtcaattcctttaacatcgtcaattcctttaacatcgtcaattcctttaacatttctgacatttctgacatttctgacatttctgacatttctgacatttccgactcggaccgatg

SEQ ID NO: 16431 - DNA, 203 bp, Homo sapiens
ggcgcgccagtccttccaccgacttctgacatttctgacatttctgacatttctgacatttctgacatcgtcaattcctttaacatcgtcaattcctttaacatcgtcaattcctttaacatttctgacatttctgacatttctgacatttctgacatttctgacatttctgacatttctgacatttccgactcggaccgatg

SEQ ID NO: 16432 - DNA, 203 bp, Homo sapiens
ggcgcgccagtcctatggactctatctgacatttctgacatttctgacatttctgacatttctgacatcgtcaattcctttaacatcgtcaattcctttaacatttctgacatttctgacatcgtcaattcctttaacatttctgacatttctgacatttctgacatttctgacatttctgacatttccgactcggaccgatg

SEQ ID NO: 16433 - DNA, 203 bp, Homo sapiens
ggcgcgccagtcctttaggactaatctgacatttctgacatttctgacatttctgacatttctgacatcgtcaattcctttaacatcgtcaattcctttaacatttctgacatttctgacatttctgacatttctgacatttctgacatttctgacatttctgacatttctgacatttctgacatttccgactcggaccgatg

SEQ ID NO: 16434 - DNA, 203 bp, Homo sapiens
ggcgcgccagtcctacgtttctggtctgacatttctgacatttctgacatttctgacatttctgacatcgtcaattcctttaacatttctgacatttctgacatcgtcaattcctttaacatcgtcaattcctttaacatcgtcaattcctttaacatttctgacatttctgacatttctgacatttccgactcggaccgatg

SEQ ID NO: 16435 - DNA, 203 bp, Homo sapiens
ggcgcgccagtcctcagtttctgctctgacatttctgacatttctgacatttctgacatttctgacatcgtcaattcctttaacatttctgacatttctgacatcgtcaattcctttaacatcgtcaattcctttaacatttctgacatttctgacatcgtcaattcctttaacatttctgacatttccgactcggaccgatg

SEQ ID NO: 16436 - DNA, 203 bp, Homo sapiens
ggcgcgccagtcctacgatacagctctgacatttctgacatttctgacatttctgacatttctgacatcgtcaattcctttaacatttctgacatttctgacatcgtcaattcctttaacatttctgacatttctgacatcgtcaattcctttaacatcgtcaattcctttaacatttctgacatttccgactcggaccgatg

SEQ ID NO: 16437 - DNA, 203 bp, Homo sapiens
ggcgcgccagtcctctctaactgctctgacatttctgacatttctgacatttctgacatttctgacatcgtcaattcctttaacatttctgacatttctgacatcgtcaattcctttaacatttctgacatttctgacatttctgacatttctgacatcgtcaattcctttaacatttctgacatttccgactcggaccgatg

SEQ ID NO: 16438 - DNA, 203 bp, Homo sapiens
ggcgcgccagtcctatgaaaaggctctgacatttctgacatttctgacatttctgacatttctgacatcgtcaattcctttaacatttctgacatttctgacatttctgacatttctgacatcgtcaattcctttaacatcgtcaattcctttaacatttctgacatttctgacatttctgacatttccgactcggaccgatg

SEQ ID NO: 16439 - DNA, 203 bp, Homo sapiens
ggcgcgccagtcctacctgtaggctctgacatttctgacatttctgacatttctgacatttctgacatcgtcaattcctttaacatttctgacatttctgacatttctgacatttctgacatcgtcaattcctttaacatttctgacatttctgacatttctgacatttctgacatttctgacatttccgactcggaccgatg

SEQ ID NO: 16440 - DNA, 203 bp, Homo sapiens
ggcgcgccagtcctctaagagtgctctgacatttctgacatttctgacatttctgacatttctgacatcgtcaattcctttaacatttctgacatttctgacatttctgacatttctgacatttctgacatttctgacatttctgacatttctgacatcgtcaattcctttaacatttctgacatttccgactcggaccgatg

SEQ ID NO: 16441 - DNA, 203 bp, Homo sapiens
ggcgcgccagtcctgagactgagctctgacatttctgacatttctgacatttctgacatttctgacattactcccatttctgacattactcccatttctgacattactcccatttctgacattactcccatttctgacatttctgacatttctgacattactcccatttctgacattactcccatttccgactcggaccgatg

SEQ ID NO: 16442 - DNA, 203 bp, Homo sapiens
ggcgcgccagtcctcttcagaagctctgacatttctgacatttctgacatttctgacatttctgacattactcccatttctgacattactcccatttctgacattactcccatttctgacattactcccatttctgacatttctgacatttctgacattactcccatttctgacatttctgacatttccgactcggaccgatg

SEQ ID NO: 16443 - DNA, 203 bp, Homo sapiens
ggcgcgccagtccttgacgaaagctctgacatttctgacatttctgacatttctgacatttctgacattactcccatttctgacattactcccatttctgacattactcccatttctgacattactcccatttctgacatttctgacatttctgacatttctgacatttctgacattactcccatttccgactcggaccgatg

SEQ ID NO: 16444 - DNA, 203 bp, Homo sapiens
ggcgcgccagtcctagaccggtgctctgacatttctgacatttctgacatttctgacatttctgacattactcccatttctgacattactcccatttctgacattactcccatttctgacattactcccatttctgacatttctgacatttctgacatttctgacatttctgacatttctgacatttccgactcggaccgatg

SEQ ID NO: 16445 - DNA, 203 bp, Homo sapiens
ggcgcgccagtccttagtttgagctctgacatttctgacatttctgacatttctgacatttctgacattactcccatttctgacattactcccatttctgacattactcccatttctgacatttctgacatttctgacattactcccatttctgacattactcccatttctgacatttctgacatttccgactcggaccgatg

SEQ ID NO: 16446 - DNA, 203 bp, Homo sapiens
ggcgcgccagtcctatgcactagctctgacatttctgacatttctgacatttctgacatttctgacattactcccatttctgacattactcccatttctgacattactcccatttctgacatttctgacatttctgacatttctgacatttctgacattactcccatttctgacattactcccatttccgactcggaccgatg

SEQ ID NO: 16447 - DNA, 203 bp, Homo sapiens
ggcgcgccagtcctgaacacctgctctgacatttctgacatttctgacatttctgacatttctgacattactcccatttctgacattactcccatttctgacattactcccatttctgacatttctgacatttctgacatttctgacatttctgacatttctgacatttctgacattactcccatttccgactcggaccgatg

SEQ ID NO: 16448 - DNA, 203 bp, Homo sapiens
ggcgcgccagtcctgactctcagctctgacatttctgacatttctgacatttctgacatttctgacattactcccatttctgacattactcccatttctgacattactcccatttctgacatttctgacatttctgacatttctgacatttctgacatttctgacatttctgacatttctgacatttccgactcggaccgatg

SEQ ID NO: 16449 - DNA, 203 bp, Homo sapiens
ggcgcgccagtcctacacagaggctctgacatttctgacatttctgacatttctgacatttctgacattactcccatttctgacattactcccatttctgacatttctgacatttctgacatttctgacatttctgacattactcccatttctgacattactcccatttctgacatttctgacatttccgactcggaccgatg

SEQ ID NO: 16450 - DNA, 203 bp, Homo sapiens
ggcgcgccagtcctgctgagagtatctgacatttctgacatttctgacatttctgacatttctgacattactcccatttctgacattactcccatttctgacatttctgacatttctgacatttctgacatttctgacattactcccatttctgacatttctgacatttctgacatttctgacatttccgactcggaccgatg

SEQ ID NO: 16451 - DNA, 203 bp, Homo sapiens
ggcgcgccagtcctgctagtctgttctgacatttctgacatttctgacatttctgacatttctgacattactcccatttctgacattactcccatttctgacatttctgacatttctgacatttctgacatttctgacatttctgacatttctgacatttctgacatttctgacattactcccatttccgactcggaccgatg

SEQ ID NO: 16452 - DNA, 203 bp, Homo sapiens
ggcgcgccagtcctgcagtacagctctgacatttctgacatttctgacatttctgacatttctgacattactcccatttctgacatttctgacatttctgacattactcccatttctgacattactcccatttctgacattactcccatttctgacattactcccatttctgacatttctgacatttccgactcggaccgatg

SEQ ID NO: 16453 - DNA, 203 bp, Homo sapiens
ggcgcgccagtcctgcaaccgtcatctgacatttctgacatttctgacatttctgacatttctgacattactcccatttctgacatttctgacatttctgacattactcccatttctgacattactcccatttctgacattactcccatttctgacatttctgacatttctgacattactcccatttccgactcggaccgatg

SEQ ID NO: 16454 - DNA, 203 bp, Homo sapiens
ggcgcgccagtcctgcttgagctttctgacatttctgacatttctgacatttctgacatttctgacattactcccatttctgacatttctgacatttctgacattactcccatttctgacattactcccatttctgacatttctgacatttctgacattactcccatttctgacatttctgacatttccgactcggaccgatg

SEQ ID NO: 16455 - DNA, 203 bp, Homo sapiens
ggcgcgccagtcctgcctcttaagtctgacatttctgacatttctgacatttctgacatttctgacattactcccatttctgacatttctgacatttctgacattactcccatttctgacattactcccatttctgacatttctgacatttctgacatttctgacatttctgacattactcccatttccgactcggaccgatg

SEQ ID NO: 16456 - DNA, 203 bp, Homo sapiens
ggcgcgccagtcctgctaagacgatctgacatttctgacatttctgacatttctgacatttctgacattactcccatttctgacatttctgacatttctgacattactcccatttctgacatttctgacatttctgacattactcccatttctgacatttctgacatttctgacatttctgacatttccgactcggaccgatg

SEQ ID NO: 16457 - DNA, 203 bp, Homo sapiens
ggcgcgccagtcctgcaacgtttctctgacatttctgacatttctgacatttctgacatttctgacattactcccatttctgacatttctgacatttctgacattactcccatttctgacatttctgacatttctgacatttctgacatttctgacattactcccatttctgacattactcccatttccgactcggaccgatg

SEQ ID NO: 16458 - DNA, 203 bp, Homo sapiens
ggcgcgccagtcctgctcgtcaggtctgacatttctgacatttctgacatttctgacatttctgacattactcccatttctgacatttctgacatttctgacattactcccatttctgacatttctgacatttctgacatttctgacatttctgacatttctgacatttctgacattactcccatttccgactcggaccgatg

SEQ ID NO: 16459 - DNA, 203 bp, Homo sapiens
ggcgcgccagtcctgcctgaccaatctgacatttctgacatttctgacatttctgacatttctgacattactcccatttctgacatttctgacatttctgacatttctgacatttctgacattactcccatttctgacattactcccatttctgacattactcccatttctgacatttctgacatttccgactcggaccgatg

SEQ ID NO: 16460 - DNA, 203 bp, Homo sapiens
ggcgcgccagtcctgcaaaggccttctgacatttctgacatttctgacatttctgacatttctgacattactcccatttctgacatttctgacatttctgacatttctgacatttctgacattactcccatttctgacattactcccatttctgacatttctgacatttctgacatttctgacatttccgactcggaccgatg

SEQ ID NO: 16461 - DNA, 203 bp, Homo sapiens
ggcgcgccagtcctgccttcagcttctgacatttctgacatttctgacatttctgacatttctgacattactcccatttctgacatttctgacatttctgacatttctgacatttctgacattactcccatttctgacatttctgacatttctgacatttctgacatttctgacatttctgacatttccgactcggaccgatg

SEQ ID NO: 16462 - DNA, 203 bp, Homo sapiens
ggcgcgccagtcctgctgaatggttctgacatttctgacatttctgacatttctgacatttctgacattactcccatttctgacatttctgacatttctgacatttctgacatttctgacatttctgacatttctgacattactcccatttctgacattactcccatttctgacattactcccatttccgactcggaccgatg

SEQ ID NO: 16463 - DNA, 203 bp, Homo sapiens
ggcgcgccagtcctgctactctagtctgacatttctgacatttctgacatttctgacatttctgacattactcccatttctgacatttctgacatttctgacatttctgacatttctgacatttctgacatttctgacattactcccatttctgacatttctgacatttctgacattactcccatttccgactcggaccgatg

SEQ ID NO: 16464 - DNA, 203 bp, Homo sapiens
ggcgcgccagtcctgctaacctcttctgacatttctgacatttctgacatttctgacatttctgacattactcccatttctgacatttctgacatttctgacatttctgacatttctgacatttctgacatttctgacatttctgacatttctgacattactcccatttctgacatttctgacatttccgactcggaccgatg

SEQ ID NO: 16465 - DNA, 203 bp, Homo sapiens
ggcgcgccagtcctgccttactgctctgacatttctgacatttctgacatttctgacatttctgacattactcccatttctgacatttctgacatttctgacatttctgacatttctgacatttctgacatttctgacatttctgacatttctgacatttctgacatttctgacattactcccatttccgactcggaccgatg

SEQ ID NO: 16466 - DNA, 203 bp, Homo sapiens
ggcgcgccagtcctgctcaagttgtctgacatttctgacatttctgacatttctgacatttctgacattactcccatttctgacatttctgacatttctgacatttctgacatttctgacatttctgacatttctgacatttctgacatttctgacatttctgacatttctgacatttctgacatttccgactcggaccgatg

SEQ ID NO: 16467 - DNA, 203 bp, Homo sapiens
ggcgcgccagtcctgctctgcaagtctgacatttctgacatttctgacatttctgacatttctgacattcacggaatcgagaacatttctgacatttctgacatttctgacatttctgacatttctgacatttctgacatttctgacatttctgacatttctgacatttctgacatttctgacatttccgactcggaccgatg

SEQ ID NO: 16468 - DNA, 203 bp, Homo sapiens
ggcgcgccagtcctgctaaaggattctgacatttctgacatttctgacatttctgacatttctgacattcacggaatcgagaacatttctgacatttctgacatttctgacatttctgacatttctgacatttctgacatttctgacatttctgacatttctgacatttctgaccgtcaattcctttacgactcggaccgatg

SEQ ID NO: 16469 - DNA, 203 bp, Homo sapiens
ggcgcgccagtcctgctcttaagatctgacatttctgacatttctgacatttctgacatttctgacattctccccccggaacccaaagactttggtttcccggaagctgcccggcgggtcatgggaataacgccgccgcatcgccggtcggcatcgttttctgacatttctgacatttctgacatttccgactcggaccgatg

SEQ ID NO: 16470 - DNA, 203 bp, Homo sapiens
ggcgcgccagtcctgcagtatgcatctgacatttctgacatttctgacatttctgacatttctgacattgaaccataactgatttaatgagccattcgcagtttcactgtaccggccgtgcgtactcagacatgcatggcttaatctttgagacaagcatctgacatttctgacatttctgacatttccgactcggaccgatg

SEQ ID NO: 16471 - DNA, 203 bp, Homo sapiens
ggcgcgccagtcctctgaatgaaatctgacatttctgacatttctgacatttctgacatttctgacatttaccggccgtctgacatttctgacatttctgacatttctgacatttctgacatttctgacatttctgacatttctgacatttctgacatttctgacatttctgacattttcttggcaaacgactcggaccgatg

SEQ ID NO: 16472 - DNA, 203 bp, Homo sapiens
ggcgcgccagtcctgagaatcgtatctgacatttctgacatttctgacatttctgacatttctgacatttactccctttctgacatttctgacatttctgacatttctgacatttctgacatttctgacatttctgacatttctgacatttctgacatttctgacatttctgacatttctgtactccccgactcggaccgatg

SEQ ID NO: 16473 - DNA, 203 bp, Homo sapiens
ggcgcgccagtcctgagtgaactgtctgacatttctgacatttctgacatttctgacatttctgacatttcaccataactgatttaatgagccattcgcagtttcactgtaccggccgtgcgtactcagacatgcatggcttaatctttgagacaagtttctgacatttctgacatttctgacatttccgactcggaccgatg

SEQ ID NO: 16474 - DNA, 203 bp, Homo sapiens
ggcgcgccagtcctaacagttctttctgacatttctgacatttctgacatttctgacatttctgacatttcattaagccgcaggctccactcctggtggtgcccttccgtcaattcctttaagtttcagctttgcaaccatactccccccggaaccctttctgacatttctgacatttctgacatttccgactcggaccgatg

SEQ ID NO: 16475 - DNA, 203 bp, Homo sapiens
ggcgcgccagtcctacaagtgctctctgacatttctgacatttctgacatttctgacatttctgacatttcgcccttccgtcaattcctttaagtttcagctttgcaaccatactccccccggaacccaaagactttggtttcccggaagctgcccgtttctgacatttctgacatttctgacatttccgactcggaccgatg

SEQ ID NO: 16476 - DNA, 203 bp, Homo sapiens
ggcgcgccagtccttcaacgtaggtctgacatttctgacatttctgacatttctgacatttctgacatttctcccttccgtcaattcctttaagtttcagctttgcaaccatactccccccggaacccaaagactttggtttcccggaagctgcccatttctgacatttctgacatttctgacatttccgactcggaccgatg

SEQ ID NO: 16477 - DNA, 203 bp, Homo sapiens
ggcgcgccagtcctttgacctttatctgacatttctgacatttctgacatttctgacatttctgacatttctccggcgggtgacatttctgacatttctgacatttctgacatttctgacatttctgacatttctgacatttctgacatttctgacatttctgacatttctgacatttcccggcgggtcgactcggaccgatg

SEQ ID NO: 16478 - DNA, 203 bp, Homo sapiens
ggcgcgccagtcctaagctaacactctgacatttctgacatttctgacatttctgacatttctgacatttctcgtcaattcctttattctgacatttctgacatttctgacatttctgacatttctgacatttctgacatttctgacatttctgacatttctgacatttctgacattttcttggcaaacgactcggaccgatg

SEQ ID NO: 16479 - DNA, 203 bp, Homo sapiens
ggcgcgccagtcctgtagtgctaatctgacatttctgacatttctgacatttctgacatttctgacatttctgaaccggccgtcatttctgacatttctgacatttctgacatttctgacatttctgacatttctgacatttctgacatttctgacatttctgacatttctgaccacggaatcgagaacgactcggaccgatg

SEQ ID NO: 16480 - DNA, 203 bp, Homo sapiens
ggcgcgccagtcctgtaaagtggttctgacatttctgacatttctgacatttctgacatttctgacatttctgacacaccaactaagaacggccatgcaccaccacccacggaatcgagaaagagctatcaatctgtcaatcctgtccgtgttgacatttctgacatttctgacatttctgacatttccgactcggaccgatg

SEQ ID NO: 16481 - DNA, 203 bp, Homo sapiens
ggcgcgccagtcctctgtgtacactctgacatttctgacatttctgacatttctgacatttctgacatttctgacacacggaatcgagaagacatttctgacatttctgacatttctgacatttctgacatttctgacatttctgacatttctgacatttctgacatttctgacatttctgacatttccgactcggaccgatg

SEQ ID NO: 16482 - DNA, 203 bp, Homo sapiens
ggcgcgccagtcctgtgaatgttgtctgacatttctgacatttctgacatttctgacatttctgacatttctgacacacggaatcgagaagacatttctgacatttctgacatttctgacatttctgacatttctgacatttctgacatttctgacatttctgacatttctgacatttctgtactccccgactcggaccgatg

SEQ ID NO: 16483 - DNA, 203 bp, Homo sapiens
ggcgcgccagtcctgtctgagaaatctgacatttctgacatttctgacatttctgacatttctgacatttctgacacggaatcgagaactgacatttctgacatttctgacatttctgacatttctgacatttctgacatttctgacatttctgacatttctgacatttctgacatttcaccggccgtcgactcggaccgatg

SEQ ID NO: 16484 - DNA, 203 bp, Homo sapiens
ggcgcgccagtcctgaccgagaactctgacatttctgacatttctgacatttctgacatttctgacatttctgacacggaatcgagaactgacatttctgacatttctgacatttctgacatttctgacatttctgacatttctgacatttctgacatttctgacatttctgacatttcccggcgggtcgactcggaccgatg

SEQ ID NO: 16485 - DNA, 203 bp, Homo sapiens
ggcgcgccagtcctgtctcatgactctgacatttctgacatttctgacatttctgacatttctgacatttctgacacgtcaattcctttagacatttctgacatttctgacatttctgacatttctgacatttctgacatttctgacatttctgacatttctgacatttctgaccgtcaattcctttacgactcggaccgatg

SEQ ID NO: 16486 - DNA, 203 bp, Homo sapiens
ggcgcgccagtcctctaagaagactctgacatttctgacatttctgacatttctgacatttctgacatttctgacagccgcaggctccactcctggtggtgcccttccgtcaattcctttaagtttcagctttgcaaccatactccccccggagacatttctgacatttctgacatttctgacatttccgactcggaccgatg

SEQ ID NO: 16487 - DNA, 203 bp, Homo sapiens
ggcgcgccagtcctgtaacggtattctgacatttctgacatttctgacatttctgacatttctgacatttctgacataccggccgtttctgacatttctgacatttctgacatttctgacatttctgacatttctgacatttctgacatttctgacatttctgacatttctgacattttcttggcaaacgactcggaccgatg

SEQ ID NO: 16488 - DNA, 203 bp, Homo sapiens
ggcgcgccagtcctgtccagaggctctgacatttctgacatttctgacatttctgacatttctgacatttctgacatactccccatttctgacatttctgacatttctgacatttctgacatttctgacatttctgacatttctgacatttctgacatttctgacatttctgacatttctgtactccccgactcggaccgatg

SEQ ID NO: 16489 - DNA, 203 bp, Homo sapiens
ggcgcgccagtcctgtagttagcttctgacatttctgacatttctgacatttctgacatttctgacatttctgacatactgatttaatgagccattcgcagtttcactgtaccggccgtgcgtactcagacatgcatggcttaatctttgactgacatttctgacatttctgacatttctgacatttccgactcggaccgatg

SEQ ID NO: 16490 - DNA, 203 bp, Homo sapiens
ggcgcgccagtcctgtggttgacttctgacatttctgacatttctgacatttctgacatttctgacatttctgacatccgcaggctccactcctggtggtgcccttccgtcaattcctttaagtttcagctttgcaaccatactccccccgctgacatttctgacatttctgacatttctgacatttccgactcggaccgatg

SEQ ID NO: 16491 - DNA, 203 bp, Homo sapiens
ggcgcgccagtcctctgacaaaactctgacatttctgacatttctgacatttctgacatttctgacatttctgacatttaacccaaagactttggtttcccggaagctgcccggcgggtcatgggaataacgccgccgcatcgccggtcttctgacatttctgacatttctgacatttctgacatttccgactcggaccgatg

SEQ ID NO: 16492 - DNA, 203 bp, Homo sapiens
ggcgcgccagtcctcagtaactactctgacatttctgacatttctgacatttctgacatttctgacatttctgacatttaccggccgtctgacatttctgacatttctgacatttctgacatttctgacatttctgacatttctgacatttctgacatttctgacatttctgacatttcaccggccgtcgactcggaccgatg

SEQ ID NO: 16493 - DNA, 203 bp, Homo sapiens
ggcgcgccagtcctgtgaactgtctctgacatttctgacatttctgacatttctgacatttctgacatttctgacatttcccgactttcgttcttgattaatgaaaacattcttggcaaatgctttcgctctggtccgtcttgcgccgtttctgacatttctgacatttctgacatttctgacatttccgactcggaccgatg

SEQ ID NO: 16494 - DNA, 203 bp, Homo sapiens
ggcgcgccagtcctgttcaagaactctgacatttctgacatttctgacatttctgacatttctgacatttctgacatttcgatttaatgagccattcgcagtttcactgtaccggccgtgcgtactcagacatgcatggcttaatctttttctgacatttctgacatttctgacatttctgacatttccgactcggaccgatg

SEQ ID NO: 16495 - DNA, 203 bp, Homo sapiens
ggcgcgccagtcctctaacgttactctgacatttctgacatttctgacatttctgacatttctgacatttctgacatttctaggctccactcctggtggtgcccttccgtcaattcctttaagtttcagctttgcaaccatactcccatttctgacatttctgacatttctgacatttctgacatttccgactcggaccgatg

SEQ ID NO: 16496 - DNA, 203 bp, Homo sapiens
ggcgcgccagtcctgtgagagccttctgacatttctgacatttctgacatttctgacatttctgacatttctgacatttctcccaaagactttggtttcccggaagctgcccggcgggtcatgggaataacgccgccgcatcgccggatttctgacatttctgacatttctgacatttctgacatttccgactcggaccgatg

SEQ ID NO: 16497 - DNA, 203 bp, Homo sapiens
ggcgcgccagtcctgtatggttgctctgacatttctgacatttctgacatttctgacatttctgacatttctgacatttctccggcgggtgacatttctgacatttctgacatttctgacatttctgacatttctgacatttctgacatttctgacatttctgacatttctgacatttctgacatttccgactcggaccgatg

SEQ ID NO: 16498 - DNA, 203 bp, Homo sapiens
ggcgcgccagtcctcagtccaaactctgacatttctgacatttctgacatttctgacatttctgacatttctgacatttctccggcgggtgacatttctgacatttctgacatttctgacatttctgacatttctgacatttctgacatttctgacatttctgacatttctgacatttctgtactccccgactcggaccgatg

SEQ ID NO: 16499 - DNA, 203 bp, Homo sapiens
ggcgcgccagtcctcctcggtcactctgacatttctgacatttctgacatttctgacatttctgacatttctgacatttctccggcgggtgacatttctgacatttctgacatttctgacatttctgacatttctgacatttctgacatttctgacatttctgacatttctgaccgtcaattcctttacgactcggaccgatg

SEQ ID NO: 16500 - DNA, 203 bp, Homo sapiens
ggcgcgccagtcctgagtagatactctgacatttctgacatttctgacatttctgacatttctgacatttctgacatttctgaactttcgttcttgattaatgaaaacattcttggcaaatgctttcgctctggtccgtcttgcgacatttctgacatttctgacatttctgacatttctgacatttccgactcggaccgatg

SEQ ID NO: 16501 - DNA, 203 bp, Homo sapiens
ggcgcgccagtcctgttcaccatttctgacatttctgacatttctgacatttctgacatttctgacatttctgacatttctgacaaagactttggtttcccggaagctgcccggcgggtcatgggaataacgccgccgcatcgccacatttctgacatttctgacatttctgacatttctgacatttccgactcggaccgatg

SEQ ID NO: 16502 - DNA, 203 bp, Homo sapiens
ggcgcgccagtcctcctctgctactctgacatttctgacatttctgacatttctgacatttctgacatttctgacatttctgacaaagactttggtttcccggaagctgcccggcgggtcatgggaataacgccgccgcatcgcgacatttctgacatttctgacatttctgacatttctgacatttccgactcggaccgatg

SEQ ID NO: 16503 - DNA, 203 bp, Homo sapiens
ggcgcgccagtcctgtgaccggtttctgacatttctgacatttctgacatttctgacatttctgacatttctgacatttctgacaaagactttggtttcccggaagctgcccggcgggtcatgggaataacgccgccgcatcgtgacatttctgacatttctgacatttctgacatttctgacatttccgactcggaccgatg

SEQ ID NO: 16504 - DNA, 203 bp, Homo sapiens
ggcgcgccagtcctactagtagactctgacatttctgacatttctgacatttctgacatttctgacatttctgacatttctgacaaatgagccattcgcagtttcactgtaccggccgtgcgtactcagacatgcatggcttatgacatttctgacatttctgacatttctgacatttctgacatttccgactcggaccgatg

SEQ ID NO: 16505 - DNA, 203 bp, Homo sapiens
ggcgcgccagtcctgactctgtactctgacatttctgacatttctgacatttctgacatttctgacatttctgacatttctgacaagaacggccatgcaccaccacccacggaatcgagaaagagctatcaatctgtcaatcctgacatttctgacatttctgacatttctgacatttctgacatttccgactcggaccgatg

SEQ ID NO: 16506 - DNA, 203 bp, Homo sapiens
ggcgcgccagtcctgctgaacaactctgacatttctgacatttctgacatttctgacatttctgacatttctgacatttctgacaccggccgtatttctgacatttctgacatttctgacatttctgacatttctgacatttctgacatttctgacatttctgacatttctgacattttcttggcaaacgactcggaccgatg

SEQ ID NO: 16507 - DNA, 203 bp, Homo sapiens
ggcgcgccagtcctgagtggtcactctgacatttctgacatttctgacatttctgacatttctgacatttctgacatttctgacacggaatcgagaactgacatttctgacatttctgacatttctgacatttctgacatttctgacatttctgacatttctgacatttctgacatttctgacatttccgactcggaccgatg

SEQ ID NO: 16508 - DNA, 203 bp, Homo sapiens
ggcgcgccagtcctgtcaacgtactctgacatttctgacatttctgacatttctgacatttctgacatttctgacatttctgacacggaatcgagaactgacatttctgacatttctgacatttctgacatttctgacatttctgacatttctgacatttctgacatttctgaccacggaatcgagaacgactcggaccgatg

SEQ ID NO: 16509 - DNA, 203 bp, Homo sapiens
ggcgcgccagtccttgctgagcactctgacatttctgacatttctgacatttctgacatttctgacatttctgacatttctgacataacggaatcgagaaacataacggaatcgagaaacataacggaatcgagaaacataacggaatcgagaaacataacggaatcgagaaacatttctgacatttccgactcggaccgatg

SEQ ID NO: 16510 - DNA, 203 bp, Homo sapiens
ggcgcgccagtcctgtgagtactctctgacatttctgacatttctgacatttctgacatttctgacatttctgacatttctgacataaggcgggtttctgacataaggcgggtttctgacataaggcgggtttctgacataaggcgggtttctgacataaggcgggtttctgacatttctgacatttccgactcggaccgatg

SEQ ID NO: 16511 - DNA, 203 bp, Homo sapiens
ggcgcgccagtccttgaatcctactctgacatttctgacatttctgacatttctgacatttctgacatttctgacatttctgacatacccgccgtttctgacatacccgccgtttctgacatacccgccgtttctgacatacccgccgtttctgacatacccgccgtttctgacatttctgacatttccgactcggaccgatg

SEQ ID NO: 16512 - DNA, 203 bp, Homo sapiens
ggcgcgccagtcctagtggtcaactctgacatttctgacatttctgacatttctgacatttctgacatttctgacatttctgacataccgatcgtttctgacataccgatcgtttctgacataccgatcgtttctgacataccgatcgtttctgacataccgatcgtttctgacatttctgacatttccgactcggaccgatg

SEQ ID NO: 16513 - DNA, 203 bp, Homo sapiens
ggcgcgccagtcctcagaagttactctgacatttctgacatttctgacatttctgacatttctgacatttctgacatttctgacataccgcacgtttctgacataccgcacgtttctgacataccgcacgtttctgacataccgcacgtttctgacataccgcacgtttctgacatttctgacatttccgactcggaccgatg

SEQ ID NO: 16514 - DNA, 203 bp, Homo sapiens
ggcgcgccagtcctgttaacagactctgacatttctgacatttctgacatttctgacatttctgacatttctgacatttctgacataccgcgcgtttctgacataccgcgcgtttctgacataccgcgcgtttctgacataccgcgcgtttctgacataccgcgcgtttctgacatttctgacatttccgactcggaccgatg

SEQ ID NO: 16515 - DNA, 203 bp, Homo sapiens
ggcgcgccagtccttgagcaccactctgacatttctgacatttctgacatttctgacatttctgacatttctgacatttctgacataccgctcgtttctgacataccgctcgtttctgacataccgctcgtttctgacataccgctcgtttctgacataccgctcgtttctgacatttctgacatttccgactcggaccgatg

SEQ ID NO: 16516 - DNA, 203 bp, Homo sapiens
ggcgcgccagtccttgcaagtaactctgacatttctgacatttctgacatttctgacatttctgacatttctgacatttctgacataccggaatcgagaaacataccggaatcgagaaacataccggaatcgagaaacataccggaatcgagaaacataccggaatcgagaaacatttctgacatttccgactcggaccgatg

SEQ ID NO: 16517 - DNA, 203 bp, Homo sapiens
ggcgcgccagtcctgtcagtagattctgacatttctgacatttctgacatttctgacatttctgacatttctgacatttctgacataccggccaattctgacataccggccaattctgacataccggccaattctgacataccggccaattctgacataccggccaattctgacatttctgacatttccgactcggaccgatg

SEQ ID NO: 16518 - DNA, 203 bp, Homo sapiens
ggcgcgccagtcctctaagttcactctgacatttctgacatttctgacatttctgacatttctgacatttctgacatttctgacataccggccagttctgacataccggccagttctgacataccggccagttctgacataccggccagttctgacataccggccagttctgacatttctgacatttccgactcggaccgatg

SEQ ID NO: 16519 - DNA, 203 bp, Homo sapiens
ggcgcgccagtcctattctgttcatctgacatttctgacatttctgacatttctgacatttctgacatttctgacatttctgacataccggccccttctgacataccggccccttctgacataccggccccttctgacataccggccccttctgacataccggccccttctgacatttctgacatttccgactcggaccgatg

SEQ ID NO: 16520 - DNA, 203 bp, Homo sapiens
ggcgcgccagtcctcaacgaatactctgacatttctgacatttctgacatttctgacatttctgacatttctgacatttctgacataccggccgcttctgacataccggccgcttctgacataccggccgcttctgacataccggccgcttctgacataccggccgcttctgacatttctgacatttccgactcggaccgatg

SEQ ID NO: 16521 - DNA, 203 bp, Homo sapiens
ggcgcgccagtcctatgaatcgaatctgacatttctgacatttctgacatttctgacatttctgacatttctgacatttctgacataccggccgtttctgacataccggccgtttctgacataccggccgtttctgacataccggccgtttctgacatttctgacatttctgacataccggccgtttccgactcggaccgatg

SEQ ID NO: 16522 - DNA, 203 bp, Homo sapiens
ggcgcgccagtcctgtttgaactctctgacatttctgacatttctgacatttctgacatttctgacatttctgacatttctgacataccggccgtttctgacataccggccgtttctgacataccggccgtttctgacatttctgacatttctgacatttctgacatttctgacataccggccgtttccgactcggaccgatg

SEQ ID NO: 16523 - DNA, 203 bp, Homo sapiens
ggcgcgccagtcctctcaccatgttctgacatttctgacatttctgacatttctgacatttctgacatttctgacatttctgacataccggccgtttctgacataccggccgtttctgacataccggccgtttctgacatttctgacatttctgacatttctgacatttctgacatttctgacatttccgactcggaccgatg

SEQ ID NO: 16524 - DNA, 203 bp, Homo sapiens
ggcgcgccagtcctttaggctcactctgacatttctgacatttctgacatttctgacatttctgacatttctgacatttctgacataccggccgtttctgacataccggccgtttctgacatttctgacatttctgacataccggccgtttctgacataccggccgtttctgacatttctgacatttccgactcggaccgatg

SEQ ID NO: 16525 - DNA, 203 bp, Homo sapiens
ggcgcgccagtcctcatgctctggtctgacatttctgacatttctgacatttctgacatttctgacatttctgacatttctgacataccggccgtttctgacataccggccgtttctgacatttctgacatttctgacatttctgacatttctgacataccggccgtttctgacatttctgacatttccgactcggaccgatg

SEQ ID NO: 16526 - DNA, 203 bp, Homo sapiens
ggcgcgccagtcctcacagcatggtctgacatttctgacatttctgacatttctgacatttctgacatttctgacatttctgacataccggccgtttctgacataccggccgtttctgacatttctgacatttctgacatttctgacatttctgacatttctgacatttctgacatttctgacatttccgactcggaccgatg

SEQ ID NO: 16527 - DNA, 203 bp, Homo sapiens
ggcgcgccagtccttgaagacgactctgacatttctgacatttctgacatttctgacatttctgacatttctgacatttctgacataccggccgtttctgacatttctgacatttctgacataccggccgtttctgacataccggccgtttctgacataccggccgtttctgacataccggccgtttccgactcggaccgatg

SEQ ID NO: 16528 - DNA, 203 bp, Homo sapiens
ggcgcgccagtcctgatcacaagttctgacatttctgacatttctgacatttctgacatttctgacatttctgacatttctgacataccggccgtttctgacatttctgacatttctgacataccggccgtttctgacataccggccgtttctgacataccggccgtttctgacatttctgacatttccgactcggaccgatg

SEQ ID NO: 16529 - DNA, 203 bp, Homo sapiens
ggcgcgccagtcctatcatggtgctctgacatttctgacatttctgacatttctgacatttctgacatttctgacatttctgacataccggccgtttctgacatttctgacatttctgacataccggccgtttctgacataccggccgtttctgacatttctgacatttctgacatttctgacatttccgactcggaccgatg

SEQ ID NO: 16530 - DNA, 203 bp, Homo sapiens
ggcgcgccagtccttcagcaagcatctgacatttctgacatttctgacatttctgacatttctgacatttctgacatttctgacataccggccgtttctgacatttctgacatttctgacataccggccgtttctgacatttctgacatttctgacataccggccgtttctgacataccggccgtttccgactcggaccgatg

SEQ ID NO: 16531 - DNA, 203 bp, Homo sapiens
ggcgcgccagtcctagagtcctagtctgacatttctgacatttctgacatttctgacatttctgacatttctgacatttctgacataccggccgtttctgacatttctgacatttctgacataccggccgtttctgacatttctgacatttctgacatttctgacatttctgacatttctgacatttccgactcggaccgatg

SEQ ID NO: 16532 - DNA, 203 bp, Homo sapiens
ggcgcgccagtcctcagagtcctatctgacatttctgacatttctgacatttctgacatttctgacatttctgacatttctgacataccggccgtttctgacatttctgacatttctgacatttctgacatttctgacataccggccgtttctgacataccggccgtttctgacataccggccgtttccgactcggaccgatg

SEQ ID NO: 16533 - DNA, 203 bp, Homo sapiens
ggcgcgccagtcctccaaagtgcatctgacatttctgacatttctgacatttctgacatttctgacatttctgacatttctgacataccggccgtttctgacatttctgacatttctgacatttctgacatttctgacataccggccgtttctgacataccggccgtttctgacatttctgacatttccgactcggaccgatg

SEQ ID NO: 16534 - DNA, 203 bp, Homo sapiens
ggcgcgccagtcctgtgcacttcttctgacatttctgacatttctgacatttctgacatttctgacatttctgacatttctgacataccggccgtttctgacatttctgacatttctgacatttctgacatttctgacataccggccgtttctgacatttctgacatttctgacataccggccgtttccgactcggaccgatg

SEQ ID NO: 16535 - DNA, 203 bp, Homo sapiens
ggcgcgccagtcctaccgtcagtgtctgacatttctgacatttctgacatttctgacatttctgacatttctgacatttctgacataccggccgtttctgacatttctgacatttctgacatttctgacatttctgacatttctgacatttctgacataccggccgtttctgacataccggccgtttccgactcggaccgatg

SEQ ID NO: 16536 - DNA, 203 bp, Homo sapiens
ggcgcgccagtcctaccgttcatatctgacatttctgacatttctgacatttctgacatttctgacatttctgacatttctgacataccggcctcttctgacataccggcctcttctgacataccggcctcttctgacataccggcctcttctgacataccggcctcttctgacatttctgacatttccgactcggaccgatg

SEQ ID NO: 16537 - DNA, 203 bp, Homo sapiens
ggcgcgccagtcctagcaccgttctctgacatttctgacatttctgacatttctgacatttctgacatttctgacatttctgacataccggcctgttctgacataccggcctgttctgacataccggcctgttctgacataccggcctgttctgacataccggcctgttctgacatttctgacatttccgactcggaccgatg

SEQ ID NO: 16538 - DNA, 203 bp, Homo sapiens
ggcgcgccagtcctgctgtgaccatctgacatttctgacatttctgacatttctgacatttctgacatttctgacatttctgacataccggcggtttctgacataccggcggtttctgacataccggcggtttctgacataccggcggtttctgacataccggcggtttctgacatttctgacatttccgactcggaccgatg

SEQ ID NO: 16539 - DNA, 203 bp, Homo sapiens
ggcgcgccagtccttgtgaccgactctgacatttctgacatttctgacatttctgacatttctgacatttctgacatttctgacataccggcgttttctgacataccggcgttttctgacataccggcgttttctgacataccggcgttttctgacataccggcgttttctgacatttctgacatttccgactcggaccgatg

SEQ ID NO: 16540 - DNA, 203 bp, Homo sapiens
ggcgcgccagtcctgaggtcacactctgacatttctgacatttctgacatttctgacatttctgacatttctgacatttctgacataccggctctttctgacataccggctctttctgacataccggctctttctgacataccggctctttctgacataccggctctttctgacatttctgacatttccgactcggaccgatg

SEQ ID NO: 16541 - DNA, 203 bp, Homo sapiens
ggcgcgccagtcctcatgttcgtttctgacatttctgacatttctgacatttctgacatttctgacatttctgacatttctgacataccggctgtttctgacataccggctgtttctgacataccggctgtttctgacataccggctgtttctgacataccggctgtttctgacatttctgacatttccgactcggaccgatg

SEQ ID NO: 16542 - DNA, 203 bp, Homo sapiens
ggcgcgccagtcctaatgagcctttctgacatttctgacatttctgacatttctgacatttctgacatttctgacatttctgacataccgtgcgtttctgacataccgtgcgtttctgacataccgtgcgtttctgacataccgtgcgtttctgacataccgtgcgtttctgacatttctgacatttccgactcggaccgatg

SEQ ID NO: 16543 - DNA, 203 bp, Homo sapiens
ggcgcgccagtccttacgttcttatctgacatttctgacatttctgacatttctgacatttctgacatttctgacatttctgacatacgcgccgtttctgacatacgcgccgtttctgacatacgcgccgtttctgacatacgcgccgtttctgacatacgcgccgtttctgacatttctgacatttccgactcggaccgatg

SEQ ID NO: 16544 - DNA, 203 bp, Homo sapiens
ggcgcgccagtcctagctaacgtatctgacatttctgacatttctgacatttctgacatttctgacatttctgacatttctgacatacggccggtttctgacatacggccggtttctgacatacggccggtttctgacatacggccggtttctgacatacggccggtttctgacatttctgacatttccgactcggaccgatg

SEQ ID NO: 16545 - DNA, 203 bp, Homo sapiens
ggcgcgccagtcctttggactgaatctgacatttctgacatttctgacatttctgacatttctgacatttctgacatttctgacatacgtgccgtttctgacatacgtgccgtttctgacatacgtgccgtttctgacatacgtgccgtttctgacatacgtgccgtttctgacatttctgacatttccgactcggaccgatg

SEQ ID NO: 16546 - DNA, 203 bp, Homo sapiens
ggcgcgccagtcctttcagtgtactctgacatttctgacatttctgacatttctgacatttctgacatttctgacatttctgacatactcgccgtttctgacatactcgccgtttctgacatactcgccgtttctgacatactcgccgtttctgacatactcgccgtttctgacatttctgacatttccgactcggaccgatg

SEQ ID NO: 16547 - DNA, 203 bp, Homo sapiens
ggcgcgccagtcctttactgaatttctgacatttctgacatttctgacatttctgacatttctgacatttctgacatttctgacatagcggccgtttctgacatagcggccgtttctgacatagcggccgtttctgacatagcggccgtttctgacatagcggccgtttctgacatttctgacatttccgactcggaccgatg

SEQ ID NO: 16548 - DNA, 203 bp, Homo sapiens
ggcgcgccagtcctacccaactggtctgacatttctgacatttctgacatttctgacatttctgacatttctgacatttctgacatatctcccatttctgacatatctcccatttctgacatatctcccatttctgacatatctcccatttctgacatatctcccatttctgacatttctgacatttccgactcggaccgatg

SEQ ID NO: 16549 - DNA, 203 bp, Homo sapiens
ggcgcgccagtcctgttgggtcagtctgacatttctgacatttctgacatttctgacatttctgacatttctgacatttctgacatatgagccattcgcagtttcactgtaccggccgtgcgtactcagacatgcatggcttctgacatttctgacatttctgacatttctgacatttctgacatttccgactcggaccgatg

SEQ ID NO: 16550 - DNA, 203 bp, Homo sapiens
ggcgcgccagtcctaaagagagactctgacatttctgacatttctgacatttctgacatttctgacatttctgacatttctgacatcacgaaatcgagaaacatcacgaaatcgagaaacatcacgaaatcgagaaacatcacgaaatcgagaaacatcacgaaatcgagaaacatttctgacatttccgactcggaccgatg

SEQ ID NO: 16551 - DNA, 203 bp, Homo sapiens
ggcgcgccagtcctagtcacagtttctgacatttctgacatttctgacatttctgacatttctgacatttctgacatttctgacatcacggaatcaagaaacatcacggaatcaagaaacatcacggaatcaagaaacatcacggaatcaagaaacatcacggaatcaagaaacatttctgacatttccgactcggaccgatg

SEQ ID NO: 16552 - DNA, 203 bp, Homo sapiens
ggcgcgccagtcctaatcagagcttctgacatttctgacatttctgacatttctgacatttctgacatttctgacatttctgacatcacggaatccagaaacatcacggaatccagaaacatcacggaatccagaaacatcacggaatccagaaacatcacggaatccagaaacatttctgacatttccgactcggaccgatg

SEQ ID NO: 16553 - DNA, 203 bp, Homo sapiens
ggcgcgccagtcctgaccaccgtgtctgacatttctgacatttctgacatttctgacatttctgacatttctgacatttctgacatcacggaatcgaaaaacatcacggaatcgaaaaacatcacggaatcgaaaaacatcacggaatcgaaaaacatcacggaatcgaaaaacatttctgacatttccgactcggaccgatg

SEQ ID NO: 16554 - DNA, 203 bp, Homo sapiens
ggcgcgccagtcctacggtggttttctgacatttctgacatttctgacatttctgacatttctgacatttctgacatttctgacatcacggaatcgacaaacatcacggaatcgacaaacatcacggaatcgacaaacatcacggaatcgacaaacatcacggaatcgacaaacatttctgacatttccgactcggaccgatg

SEQ ID NO: 16555 - DNA, 203 bp, Homo sapiens
ggcgcgccagtccttccaggtggttctgacatttctgacatttctgacatttctgacatttctgacatttctgacatttctgacatcacggaatcgagaaacatcacggaatcgagaaacatcacggaatcgagaaacatcacggaatcgagaaacatcacggaatcgagaaacatttctgacatttccgactcggaccgatg

SEQ ID NO: 16556 - DNA, 203 bp, Homo sapiens
ggcgcgccagtccttttggtgaaatctgacatttctgacatttctgacatttctgacatttctgacatttctgacatttctgacatcacggaatcgagaaacatcacggaatcgagaaacatcacggaatcgagaaacatttctgacatttctgacatcacggaatcgagaaacatttctgacatttccgactcggaccgatg

SEQ ID NO: 16557 - DNA, 203 bp, Homo sapiens
ggcgcgccagtccttaaccgtaactctgacatttctgacatttctgacatttctgacatttctgacatttctgacatttctgacatcacggaatcgagaaacatcacggaatcgagaaacatttctgacatttctgacatttctgacatttctgacatttctgacatttctgacatttctgacatttccgactcggaccgatg

SEQ ID NO: 16558 - DNA, 203 bp, Homo sapiens
ggcgcgccagtcctaccgtagccttctgacatttctgacatttctgacatttctgacatttctgacatttctgacatttctgacatcacggaatcgagaaacatttctgacatttctgacatcacggaatcgagaaacatttctgacatttctgacatttctgacatttctgacatttctgacatttccgactcggaccgatg

SEQ ID NO: 16559 - DNA, 203 bp, Homo sapiens
ggcgcgccagtcctctacggttaatctgacatttctgacatttctgacatttctgacatttctgacatttctgacatttctgacatcacggaatcgagaaacatttctgacatttctgacatttctgacatttctgacatttctgacatttctgacatcacggaatcgagaaacatttctgacatttccgactcggaccgatg

SEQ ID NO: 16560 - DNA, 203 bp, Homo sapiens
ggcgcgccagtcctcaaagagacttctgacatttctgacatttctgacatttctgacatttctgacatttctgacatttctgacatcacggaatcgagaaacatttctgacatttctgacatttctgacatttctgacatttctgacatttctgacatttctgacatttctgacatttctgacatttccgactcggaccgatg

SEQ ID NO: 16561 - DNA, 203 bp, Homo sapiens
ggcgcgccagtcctaatgcacatttctgacatttctgacatttctgacatttctgacatttctgacatttctgacatttctgacatcacggaatcgagagacatcacggaatcgagagacatcacggaatcgagagacatcacggaatcgagagacatcacggaatcgagagacatttctgacatttccgactcggaccgatg

SEQ ID NO: 16562 - DNA, 203 bp, Homo sapiens
ggcgcgccagtcctccagaagtgttctgacatttctgacatttctgacatttctgacatttctgacatttctgacatttctgacatcacggaatcgagggacatcacggaatcgagggacatcacggaatcgagggacatcacggaatcgagggacatcacggaatcgagggacatttctgacatttccgactcggaccgatg

SEQ ID NO: 16563 - DNA, 203 bp, Homo sapiens
ggcgcgccagtcctacttgggtcttctgacatttctgacatttctgacatttctgacatttctgacatttctgacatttctgacatcacggaatcgagtaacatcacggaatcgagtaacatcacggaatcgagtaacatcacggaatcgagtaacatcacggaatcgagtaacatttctgacatttccgactcggaccgatg

SEQ ID NO: 16564 - DNA, 203 bp, Homo sapiens
ggcgcgccagtcctgctacccatttctgacatttctgacatttctgacatttctgacatttctgacatttctgacatttctgacatcacggaatcggaaaacatcacggaatcggaaaacatcacggaatcggaaaacatcacggaatcggaaaacatcacggaatcggaaaacatttctgacatttccgactcggaccgatg

SEQ ID NO: 16565 - DNA, 203 bp, Homo sapiens
ggcgcgccagtccttgcaagcctttctgacatttctgacatttctgacatttctgacatttctgacatttctgacatttctgacatcacggaatcgtgaaacatcacggaatcgtgaaacatcacggaatcgtgaaacatcacggaatcgtgaaacatcacggaatcgtgaaacatttctgacatttccgactcggaccgatg

SEQ ID NO: 16566 - DNA, 203 bp, Homo sapiens
ggcgcgccagtcctacgtttcgtttctgacatttctgacatttctgacatttctgacatttctgacatttctgacatttctgacatcacggaatgtagaaacatcacggaatgtagaaacatcacggaatgtagaaacatcacggaatgtagaaacatcacggaatgtagaaacatttctgacatttccgactcggaccgatg

SEQ ID NO: 16567 - DNA, 203 bp, Homo sapiens
ggcgcgccagtcctttagctgcactctgacatttctgacatttctgacatttctgacatttctgacatttctgacatttctgacatcacggaattaagaaacatcacggaattaagaaacatcacggaattaagaaacatcacggaattaagaaacatcacggaattaagaaacatttctgacatttccgactcggaccgatg

SEQ ID NO: 16568 - DNA, 203 bp, Homo sapiens
ggcgcgccagtccttatgcagttgtctgacatttctgacatttctgacatttctgacatttctgacatttctgacatttctgacatcacggcatcgagaaacatcacggcatcgagaaacatcacggcatcgagaaacatcacggcatcgagaaacatcacggcatcgagaaacatttctgacatttccgactcggaccgatg

SEQ ID NO: 16569 - DNA, 203 bp, Homo sapiens
ggcgcgccagtcctgaaactgcattctgacatttctgacatttctgacatttctgacatttctgacatttctgacatttctgacatcacggccgtttctgacatcacggccgtttctgacatcacggccgtttctgacatcacggccgtttctgacatcacggccgtttctgacatttctgacatttccgactcggaccgatg

SEQ ID NO: 16570 - DNA, 203 bp, Homo sapiens
ggcgcgccagtcctccaagcctgttctgacatttctgacatttctgacatttctgacatttctgacatttctgacatttctgacatcacgggatcgagaaacatcacgggatcgagaaacatcacgggatcgagaaacatcacgggatcgagaaacatcacgggatcgagaaacatttctgacatttccgactcggaccgatg

SEQ ID NO: 16571 - DNA, 203 bp, Homo sapiens
ggcgcgccagtccttaggatcaagtctgacatttctgacatttctgacatttctgacatttctgacatttctgacatttctgacatcacgtcatcgagaaacatcacgtcatcgagaaacatcacgtcatcgagaaacatcacgtcatcgagaaacatcacgtcatcgagaaacatttctgacatttccgactcggaccgatg

SEQ ID NO: 16572 - DNA, 203 bp, Homo sapiens
ggcgcgccagtcctttcaacgaaatctgacatttctgacatttctgacatttctgacatttctgacatttctgacatttctgacatcactcccatttctgacatcactcccatttctgacatcactcccatttctgacatcactcccatttctgacatcactcccatttctgacatttctgacatttccgactcggaccgatg

SEQ ID NO: 16573 - DNA, 203 bp, Homo sapiens
ggcgcgccagtcctacaccgaacttctgacatttctgacatttctgacatttctgacatttctgacatttctgacatttctgacatcactgaatcgagaaacatcactgaatcgagaaacatcactgaatcgagaaacatcactgaatcgagaaacatcactgaatcgagaaacatttctgacatttccgactcggaccgatg

SEQ ID NO: 16574 - DNA, 203 bp, Homo sapiens
ggcgcgccagtcctaactgaggcatctgacatttctgacatttctgacatttctgacatttctgacatttctgacatttctgacatcagggaatcgagaaacatcagggaatcgagaaacatcagggaatcgagaaacatcagggaatcgagaaacatcagggaatcgagaaacatttctgacatttccgactcggaccgatg

SEQ ID NO: 16575 - DNA, 203 bp, Homo sapiens
ggcgcgccagtcctgacgaagttctctgacatttctgacatttctgacatttctgacatttctgacatttctgacatttctgacatcattgaatcgagaaacatcattgaatcgagaaacatcattgaatcgagaaacatcattgaatcgagaaacatcattgaatcgagaaacatttctgacatttccgactcggaccgatg

SEQ ID NO: 16576 - DNA, 203 bp, Homo sapiens
ggcgcgccagtcctcaaccgagtatctgacatttctgacatttctgacatttctgacatttctgacatttctgacatttctgacatcccggccgtttctgacatcccggccgtttctgacatcccggccgtttctgacatcccggccgtttctgacatcccggccgtttctgacatttctgacatttccgactcggaccgatg

SEQ ID NO: 16577 - DNA, 203 bp, Homo sapiens
ggcgcgccagtcctcactagtgattctgacatttctgacatttctgacatttctgacatttctgacatttctgacatttctgacatccgccgggtttctgacatccgccgggtttctgacatccgccgggtttctgacatccgccgggtttctgacatccgccgggtttctgacatttctgacatttccgactcggaccgatg

SEQ ID NO: 16578 - DNA, 203 bp, Homo sapiens
ggcgcgccagtcctttcggtccaatctgacatttctgacatttctgacatttctgacatttctgacatttctgacatttctgacatccggatggtttctgacatccggatggtttctgacatccggatggtttctgacatccggatggtttctgacatccggatggtttctgacatttctgacatttccgactcggaccgatg

SEQ ID NO: 16579 - DNA, 203 bp, Homo sapiens
ggcgcgccagtcctaggtctgacttctgacatttctgacatttctgacatttctgacatttctgacatttctgacatttctgacatccggcgactttctgacatccggcgactttctgacatccggcgactttctgacatccggcgactttctgacatccggcgactttctgacatttctgacatttccgactcggaccgatg

SEQ ID NO: 16580 - DNA, 203 bp, Homo sapiens
ggcgcgccagtcctagtgcaactatctgacatttctgacatttctgacatttctgacatttctgacatttctgacatttctgacatccggcggacttctgacatccggcggacttctgacatccggcggacttctgacatccggcggacttctgacatccggcggacttctgacatttctgacatttccgactcggaccgatg

SEQ ID NO: 16581 - DNA, 203 bp, Homo sapiens
ggcgcgccagtccttccaactagttctgacatttctgacatttctgacatttctgacatttctgacatttctgacatttctgacatccggcggccttctgacatccggcggccttctgacatccggcggccttctgacatccggcggccttctgacatccggcggccttctgacatttctgacatttccgactcggaccgatg

SEQ ID NO: 16582 - DNA, 203 bp, Homo sapiens
ggcgcgccagtcctacatgagacatctgacatttctgacatttctgacatttctgacatttctgacatttctgacatttctgacatccggcgggcttctgacatccggcgggcttctgacatccggcgggcttctgacatccggcgggcttctgacatccggcgggcttctgacatttctgacatttccgactcggaccgatg

SEQ ID NO: 16583 - DNA, 203 bp, Homo sapiens
ggcgcgccagtccttaacggtgtatctgacatttctgacatttctgacatttctgacatttctgacatttctgacatttctgacatccggcggggttctgacatccggcggggttctgacatccggcggggttctgacatccggcggggttctgacatccggcggggttctgacatttctgacatttccgactcggaccgatg

SEQ ID NO: 16584 - DNA, 203 bp, Homo sapiens
ggcgcgccagtcctttcgatcgattctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16585 - DNA, 203 bp, Homo sapiens
ggcgcgccagtcctctgttgtcactctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16586 - DNA, 203 bp, Homo sapiens
ggcgcgccagtcctacaacagttttctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16587 - DNA, 203 bp, Homo sapiens
ggcgcgccagtcctagcattcacatctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16588 - DNA, 203 bp, Homo sapiens
ggcgcgccagtccttgaagttaactctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16589 - DNA, 203 bp, Homo sapiens
ggcgcgccagtcctgtgaagtttatctgacatttctgacatttctgacatttctgacatttctgacatttctgacatttctgacatccggcgggtttctgacatccggcgggtttctgacatccggcgggtttctgacatccggcgggtttctgacatttctgacatttctgacatccggcgggtttccgactcggaccgatg

SEQ ID NO: 16590 - DNA, 203 bp, Homo sapiens
ggcgcgccagtcctgttgtagtattctgacatttctgacatttctgacatttctgacatttctgacatttctgacatttctgacatccggcgggtttctgacatccggcgggtttctgacatttctgacatttctgacatccggcgggtttctgacatccggcgggtttctgacatttctgacatttccgactcggaccgatg

SEQ ID NO: 16591 - DNA, 203 bp, Homo sapiens
ggcgcgccagtcctgttttgtacttctgacatttctgacatttctgacatttctgacatttctgacatttctgacatttctgacatccggcgggtttctgacatccggcgggtttctgacatttctgacatttctgacatccggcgggtttctgacatttctgacatttctgacatttctgacatttccgactcggaccgatg

SEQ ID NO: 16592 - DNA, 203 bp, Homo sapiens
ggcgcgccagtcctgcaaagaatttctgacatttctgacatttctgacatttctgacatttctgacatttctgacatttctgacatccggcgggtttctgacatttctgacatttctgacatccggcgggtttctgacatccggcgggtttctgacatttctgacatttctgacatccggcgggtttccgactcggaccgatg

SEQ ID NO: 16593 - DNA, 203 bp, Homo sapiens
ggcgcgccagtcctatgtagaaactctgacatttctgacatttctgacatttctgacatttctgacatttctgacatttctgacatccggcgggtttctgacatttctgacatttctgacatccggcgggtttctgacatttctgacatttctgacatttctgacatttctgacatttctgacatttccgactcggaccgatg

SEQ ID NO: 16594 - DNA, 203 bp, Homo sapiens
ggcgcgccagtcctccttgtagaatctgacatttctgacatttctgacatttctgacatttctgacatttctgacatttctgacatccggcgggtttctgacatttctgacatttctgacatttctgacatttctgacatccggcgggtttctgacatccggcgggtttctgacatccggcgggtttccgactcggaccgatg

SEQ ID NO: 16595 - DNA, 203 bp, Homo sapiens
ggcgcgccagtcctgcatacattctctgacatttctgacatttctgacatttctgacatttctgacatttctgacatttctgacatccggcgggtttctgacatttctgacatttctgacatttctgacatttctgacatttctgacatttctgacatccggcgggtttctgacatttctgacatttccgactcggaccgatg

SEQ ID NO: 16596 - DNA, 203 bp, Homo sapiens
ggcgcgccagtcctcatacagaaatctgacatttctgacatttctgacatttctgacatttctgacatttctgacatttctgacatccggcgggtttctgacatttctgacatttctgacatttctgacatttctgacatttctgacatttctgacatttctgacatttctgacatttcccggcgggtcgactcggaccgatg

SEQ ID NO: 16597 - DNA, 203 bp, Homo sapiens
ggcgcgccagtccttcgttgtatgtctgacatttctgacatttctgacatttctgacatttctgacatttctgacatttctgacatccggcggtcttctgacatccggcggtcttctgacatccggcggtcttctgacatccggcggtcttctgacatccggcggtcttctgacatttctgacatttccgactcggaccgatg

SEQ ID NO: 16598 - DNA, 203 bp, Homo sapiens
ggcgcgccagtcctatgtatgtagtctgacatttctgacatttctgacatttctgacatttctgacatttctgacatttctgacatccggcggttttctgacatccggcggttttctgacatccggcggttttctgacatccggcggttttctgacatccggcggttttctgacatttctgacatttccgactcggaccgatg

SEQ ID NO: 16599 - DNA, 203 bp, Homo sapiens
ggcgcgccagtcctaatctgtatgtctgacatttctgacatttctgacatttctgacatttctgacatttctgacatttctgacatccggctggtttctgacatccggctggtttctgacatccggctggtttctgacatccggctggtttctgacatccggctggtttctgacatttctgacatttccgactcggaccgatg

SEQ ID NO: 16600 - DNA, 203 bp, Homo sapiens
ggcgcgccagtcctatcagacgaatctgacatttctgacatttctgacatttctgacatttctgacatttctgacatttctgacatccgggaggtttctgacatccgggaggtttctgacatccgggaggtttctgacatccgggaggtttctgacatccgggaggtttctgacatttctgacatttccgactcggaccgatg

SEQ ID NO: 16601 - DNA, 203 bp, Homo sapiens
ggcgcgccagtcctactggtaggatctgacatttctgacatttctgacatttctgacatttctgacatttctgacatttctgacatccggtcggtttctgacatccggtcggtttctgacatccggtcggtttctgacatccggtcggtttctgacatccggtcggtttctgacatttctgacatttccgactcggaccgatg

SEQ ID NO: 16602 - DNA, 203 bp, Homo sapiens
ggcgcgccagtcctgatacctctttctgacatttctgacatttctgacatttctgacatttctgacatttctgacatttctgacatccggttggtttctgacatccggttggtttctgacatccggttggtttctgacatccggttggtttctgacatccggttggtttctgacatttctgacatttccgactcggaccgatg

SEQ ID NO: 16603 - DNA, 203 bp, Homo sapiens
ggcgcgccagtcctaggatacctctctgacatttctgacatttctgacatttctgacatttctgacatttctgacatttctgacatccgtcgggtttctgacatccgtcgggtttctgacatccgtcgggtttctgacatccgtcgggtttctgacatccgtcgggtttctgacatttctgacatttccgactcggaccgatg

SEQ ID NO: 16604 - DNA, 203 bp, Homo sapiens
ggcgcgccagtcctactcagcgtctctgacatttctgacatttctgacatttctgacatttctgacatttctgacatttctgacatcctccgggtttctgacatcctccgggtttctgacatcctccgggtttctgacatcctccgggtttctgacatcctccgggtttctgacatttctgacatttccgactcggaccgatg

SEQ ID NO: 16605 - DNA, 203 bp, Homo sapiens
ggcgcgccagtcctgcagttcacatctgacatttctgacatttctgacatttctgacatttctgacatttctgacatttctgacatcgacaattcctttaacatcgacaattcctttaacatcgacaattcctttaacatcgacaattcctttaacatcgacaattcctttaacatttctgacatttccgactcggaccgatg

SEQ ID NO: 16606 - DNA, 203 bp, Homo sapiens
ggcgcgccagtcctcctgctgacatctgacatttctgacatttctgacatttctgacatttctgacatttctgacatttctgacatcgccaattcctttaacatcgccaattcctttaacatcgccaattcctttaacatcgccaattcctttaacatcgccaattcctttaacatttctgacatttccgactcggaccgatg

SEQ ID NO: 16607 - DNA, 203 bp, Homo sapiens
ggcgcgccagtccttgtcagcatttctgacatttctgacatttctgacatttctgacatttctgacatttctgacatttctgacatcgcgaattcctttaacatcgcgaattcctttaacatcgcgaattcctttaacatcgcgaattcctttaacatcgcgaattcctttaacatttctgacatttccgactcggaccgatg

SEQ ID NO: 16608 - DNA, 203 bp, Homo sapiens
ggcgcgccagtccttcgcaagatatctgacatttctgacatttctgacatttctgacatttctgacatttctgacatttctgacatcgctcccatttctgacatcgctcccatttctgacatcgctcccatttctgacatcgctcccatttctgacatcgctcccatttctgacatttctgacatttccgactcggaccgatg

SEQ ID NO: 16609 - DNA, 203 bp, Homo sapiens
ggcgcgccagtcctgtggtgattctctgacatttctgacatttctgacatttctgacatttctgacatttctgacatttctgacatcgcttggcaaactgacatcgcttggcaaactgacatcgcttggcaaactgacatcgcttggcaaactgacatcgcttggcaaactgacatttctgacatttccgactcggaccgatg

SEQ ID NO: 16610 - DNA, 203 bp, Homo sapiens
ggcgcgccagtccttctgtgcatttctgacatttctgacatttctgacatttctgacatttctgacatttctgacatttctgacatcggcaattcctttaacatcggcaattcctttaacatcggcaattcctttaacatcggcaattcctttaacatcggcaattcctttaacatttctgacatttccgactcggaccgatg

SEQ ID NO: 16611 - DNA, 203 bp, Homo sapiens
ggcgcgccagtcctcttgttcagatctgacatttctgacatttctgacatttctgacatttctgacatttctgacatttctgacatcgtcaacgcctttaacatcgtcaacgcctttaacatcgtcaacgcctttaacatcgtcaacgcctttaacatcgtcaacgcctttaacatttctgacatttccgactcggaccgatg

SEQ ID NO: 16612 - DNA, 203 bp, Homo sapiens
ggcgcgccagtcctaccactcagatctgacatttctgacatttctgacatttctgacatttctgacatttctgacatttctgacatcgtcaagacctttaacatcgtcaagacctttaacatcgtcaagacctttaacatcgtcaagacctttaacatcgtcaagacctttaacatttctgacatttccgactcggaccgatg

SEQ ID NO: 16613 - DNA, 203 bp, Homo sapiens
ggcgcgccagtcctccaggcttcttctgacatttctgacatttctgacatttctgacatttctgacatttctgacatttctgacatcgtcaaggcctttaacatcgtcaaggcctttaacatcgtcaaggcctttaacatcgtcaaggcctttaacatcgtcaaggcctttaacatttctgacatttccgactcggaccgatg

SEQ ID NO: 16614 - DNA, 203 bp, Homo sapiens
ggcgcgccagtccttacaacctggtctgacatttctgacatttctgacatttctgacatttctgacatttctgacatttctgacatcgtcaatacctttaacatcgtcaatacctttaacatcgtcaatacctttaacatcgtcaatacctttaacatcgtcaatacctttaacatttctgacatttccgactcggaccgatg

SEQ ID NO: 16615 - DNA, 203 bp, Homo sapiens
ggcgcgccagtccttgagcaactgtctgacatttctgacatttctgacatttctgacatttctgacatttctgacatttctgacatcgtcaatgcctttaacatcgtcaatgcctttaacatcgtcaatgcctttaacatcgtcaatgcctttaacatcgtcaatgcctttaacatttctgacatttccgactcggaccgatg

SEQ ID NO: 16616 - DNA, 203 bp, Homo sapiens
ggcgcgccagtcctcatgaggccatctgacatttctgacatttctgacatttctgacatttctgacatttctgacatttctgacatcgtcaattagtttaacatcgtcaattagtttaacatcgtcaattagtttaacatcgtcaattagtttaacatcgtcaattagtttaacatttctgacatttccgactcggaccgatg

SEQ ID NO: 16617 - DNA, 203 bp, Homo sapiens
ggcgcgccagtccttctgacgatttctgacatttctgacatttctgacatttctgacatttctgacatttctgacatttctgacatcgtcaattcatttaacatcgtcaattcatttaacatcgtcaattcatttaacatcgtcaattcatttaacatcgtcaattcatttaacatttctgacatttccgactcggaccgatg

SEQ ID NO: 16618 - DNA, 203 bp, Homo sapiens
ggcgcgccagtcctaggtttcaagtctgacatttctgacatttctgacatttctgacatttctgacatttctgacatttctgacatcgtcaattccaataacatcgtcaattccaataacatcgtcaattccaataacatcgtcaattccaataacatcgtcaattccaataacatttctgacatttccgactcggaccgatg

SEQ ID NO: 16619 - DNA, 203 bp, Homo sapiens
ggcgcgccagtcctaatacgttgctctgacatttctgacatttctgacatttctgacatttctgacatttctgacatttctgacatcgtcaattcccgtaacatcgtcaattcccgtaacatcgtcaattcccgtaacatcgtcaattcccgtaacatcgtcaattcccgtaacatttctgacatttccgactcggaccgatg

SEQ ID NO: 16620 - DNA, 203 bp, Homo sapiens
ggcgcgccagtcctggcaacgagctctgacatttctgacatttctgacatttctgacatttctgacatttctgacatttctgacatcgtcaattccgttaacatcgtcaattccgttaacatcgtcaattccgttaacatcgtcaattccgttaacatcgtcaattccgttaacatttctgacatttccgactcggaccgatg

SEQ ID NO: 16621 - DNA, 203 bp, Homo sapiens
ggcgcgccagtcctctttgtaacatctgacatttctgacatttctgacatttctgacatttctgacatttctgacatttctgacatcgtcaattccttctacatcgtcaattccttctacatcgtcaattccttctacatcgtcaattccttctacatcgtcaattccttctacatttctgacatttccgactcggaccgatg

SEQ ID NO: 16622 - DNA, 203 bp, Homo sapiens
ggcgcgccagtcctacaaagcctttctgacatttctgacatttctgacatttctgacatttctgacatttctgacatttctgacatcgtcaattccttgcacatcgtcaattccttgcacatcgtcaattccttgcacatcgtcaattccttgcacatcgtcaattccttgcacatttctgacatttccgactcggaccgatg

SEQ ID NO: 16623 - DNA, 203 bp, Homo sapiens
ggcgcgccagtcctgacgaaagcctctgacatttctgacatttctgacatttctgacatttctgacatttctgacatttctgacatcgtcaattcctttaacatcgtcaattcctttaacatcgtcaattcctttaacatcgtcaattcctttaacatcgtcaattcctttaacatttctgacatttccgactcggaccgatg

SEQ ID NO: 16624 - DNA, 203 bp, Homo sapiens
ggcgcgccagtcctctgaaaggcctctgacatttctgacatttctgacatttctgacatttctgacatttctgacatttctgacatcgtcaattcctttaacatttctgacatttctgacatttctgacatttctgacatcgtcaattcctttaacatttctgacatttctgacatttctgacatttccgactcggaccgatg

SEQ ID NO: 16625 - DNA, 203 bp, Homo sapiens
ggcgcgccagtcctggctctgcaatctgacatttctgacatttctgacatttctgacatttctgacatttctgacatttctgacatcgtcaattcctttcacatcgtcaattcctttcacatcgtcaattcctttcacatcgtcaattcctttcacatcgtcaattcctttcacatttctgacatttccgactcggaccgatg

SEQ ID NO: 16626 - DNA, 203 bp, Homo sapiens
ggcgcgccagtcctggcctcacaatctgacatttctgacatttctgacatttctgacatttctgacatttctgacatttctgacatcgtcaattccttttacatcgtcaattccttttacatcgtcaattccttttacatcgtcaattccttttacatcgtcaattccttttacatttctgacatttccgactcggaccgatg

SEQ ID NO: 16627 - DNA, 203 bp, Homo sapiens
ggcgcgccagtcctgaagaccacctctgacatttctgacatttctgacatttctgacatttctgacatttctgacatttctgacatcgtcccttcctttaacatcgtcccttcctttaacatcgtcccttcctttaacatcgtcccttcctttaacatcgtcccttcctttaacatttctgacatttccgactcggaccgatg

SEQ ID NO: 16628 - DNA, 203 bp, Homo sapiens
ggcgcgccagtcctcacactagcctctgacatttctgacatttctgacatttctgacatttctgacatttctgacatttctgacatcgtccgttcctttaacatcgtccgttcctttaacatcgtccgttcctttaacatcgtccgttcctttaacatcgtccgttcctttaacatttctgacatttccgactcggaccgatg

SEQ ID NO: 16629 - DNA, 203 bp, Homo sapiens
ggcgcgccagtcctggtgtcctactctgacatttctgacatttctgacatttctgacatttctgacatttctgacatttctgacatcgtcgattcctttaacatcgtcgattcctttaacatcgtcgattcctttaacatcgtcgattcctttaacatcgtcgattcctttaacatttctgacatttccgactcggaccgatg

SEQ ID NO: 16630 - DNA, 203 bp, Homo sapiens
ggcgcgccagtcctggttctgctctctgacatttctgacatttctgacatttctgacatttctgacatttctgacatttctgacatcgtcggttcctttaacatcgtcggttcctttaacatcgtcggttcctttaacatcgtcggttcctttaacatcgtcggttcctttaacatttctgacatttccgactcggaccgatg

SEQ ID NO: 16631 - DNA, 203 bp, Homo sapiens
ggcgcgccagtcctggtgctctgttctgacatttctgacatttctgacatttctgacatttctgacatttctgacatttctgacatcgtcgtttcctttaacatcgtcgtttcctttaacatcgtcgtttcctttaacatcgtcgtttcctttaacatcgtcgtttcctttaacatttctgacatttccgactcggaccgatg

SEQ ID NO: 16632 - DNA, 203 bp, Homo sapiens
ggcgcgccagtcctggtagccttctctgacatttctgacatttctgacatttctgacatttctgacatttctgacatttctgacatcgtctattcctttaacatcgtctattcctttaacatcgtctattcctttaacatcgtctattcctttaacatcgtctattcctttaacatttctgacatttccgactcggaccgatg

SEQ ID NO: 16633 - DNA, 203 bp, Homo sapiens
ggcgcgccagtcctggtgtagagctctgacatttctgacatttctgacatttctgacatttctgacatttctgacatttctgacatcgtctgttcctttaacatcgtctgttcctttaacatcgtctgttcctttaacatcgtctgttcctttaacatcgtctgttcctttaacatttctgacatttccgactcggaccgatg

SEQ ID NO: 16634 - DNA, 203 bp, Homo sapiens
ggcgcgccagtcctggtttcggtctctgacatttctgacatttctgacatttctgacatttctgacatttctgacatttctgacatcgtcttttcctttaacatcgtcttttcctttaacatcgtcttttcctttaacatcgtcttttcctttaacatcgtcttttcctttaacatttctgacatttccgactcggaccgatg

SEQ ID NO: 16635 - DNA, 203 bp, Homo sapiens
ggcgcgccagtcctggactgagtctctgacatttctgacatttctgacatttctgacatttctgacatttctgacatttctgacatctcggccgtttctgacatctcggccgtttctgacatctcggccgtttctgacatctcggccgtttctgacatctcggccgtttctgacatttctgacatttccgactcggaccgatg

SEQ ID NO: 16636 - DNA, 203 bp, Homo sapiens
ggcgcgccagtcctgacatgacgatctgacatttctgacatttctgacatttctgacatttctgacatttctgacatttctgacatctcttggcaaactgacatctcttggcaaactgacatctcttggcaaactgacatctcttggcaaactgacatctcttggcaaactgacatttctgacatttccgactcggaccgatg

SEQ ID NO: 16637 - DNA, 203 bp, Homo sapiens
ggcgcgccagtcctcctctttgtgtctgacatttctgacatttctgacatttctgacatttctgacatttctgacatttctgacatctggcgggtttctgacatctggcgggtttctgacatctggcgggtttctgacatctggcgggtttctgacatctggcgggtttctgacatttctgacatttccgactcggaccgatg

SEQ ID NO: 16638 - DNA, 203 bp, Homo sapiens
ggcgcgccagtcctagaatctttttctgacatttctgacatttctgacatttctgacatttctgacatttctgacatttctgacatcttcaattcctttaacatcttcaattcctttaacatcttcaattcctttaacatcttcaattcctttaacatcttcaattcctttaacatttctgacatttccgactcggaccgatg

SEQ ID NO: 16639 - DNA, 203 bp, Homo sapiens
ggcgcgccagtcctctctcgtagctctgacatttctgacatttctgacatttctgacatttctgacatttctgacatttctgacatgatcaattcctttaacatgatcaattcctttaacatgatcaattcctttaacatgatcaattcctttaacatgatcaattcctttaacatttctgacatttccgactcggaccgatg

SEQ ID NO: 16640 - DNA, 203 bp, Homo sapiens
ggcgcgccagtcctgctctacgaatctgacatttctgacatttctgacatttctgacatttctgacatttctgacatttctgacatgccggccgtttctgacatgccggccgtttctgacatgccggccgtttctgacatgccggccgtttctgacatgccggccgtttctgacatttctgacatttccgactcggaccgatg

SEQ ID NO: 16641 - DNA, 203 bp, Homo sapiens
ggcgcgccagtcctcctacgaatctctgacatttctgacatttctgacatttctgacatttctgacatttctgacatttctgacatgcggcgggtttctgacatgcggcgggtttctgacatgcggcgggtttctgacatgcggcgggtttctgacatgcggcgggtttctgacatttctgacatttccgactcggaccgatg

SEQ ID NO: 16642 - DNA, 203 bp, Homo sapiens
ggcgcgccagtcctttcactacgatctgacatttctgacatttctgacatttctgacatttctgacatttctgacatttctgacatgctcaattcctttaacatgctcaattcctttaacatgctcaattcctttaacatgctcaattcctttaacatgctcaattcctttaacatttctgacatttccgactcggaccgatg

SEQ ID NO: 16643 - DNA, 203 bp, Homo sapiens
ggcgcgccagtccttccatggacctctgacatttctgacatttctgacatttctgacatttctgacatttctgacatttctgacatggtcaattcctttaacatggtcaattcctttaacatggtcaattcctttaacatggtcaattcctttaacatggtcaattcctttaacatttctgacatttccgactcggaccgatg

SEQ ID NO: 16644 - DNA, 203 bp, Homo sapiens
ggcgcgccagtcctatgtgtcctttctgacatttctgacatttctgacatttctgacatttctgacatttctgacatttctgacatgtcggaatcgagaaacatgtcggaatcgagaaacatgtcggaatcgagaaacatgtcggaatcgagaaacatgtcggaatcgagaaacatttctgacatttccgactcggaccgatg

SEQ ID NO: 16645 - DNA, 203 bp, Homo sapiens
ggcgcgccagtcctacactgcagttctgacatttctgacatttctgacatttctgacatttctgacatttctgacatttctgacatgtggcgggtttctgacatgtggcgggtttctgacatgtggcgggtttctgacatgtggcgggtttctgacatgtggcgggtttctgacatttctgacatttccgactcggaccgatg

SEQ ID NO: 16646 - DNA, 203 bp, Homo sapiens
ggcgcgccagtcctgtcgtcatgttctgacatttctgacatttctgacatttctgacatttctgacatttctgacatttctgacattaaccccatttctgacattaaccccatttctgacattaaccccatttctgacattaaccccatttctgacattaaccccatttctgacatttctgacatttccgactcggaccgatg

SEQ ID NO: 16647 - DNA, 203 bp, Homo sapiens
ggcgcgccagtcctcagtcaccattctgacatttctgacatttctgacatttctgacatttctgacatttctgacatttctgacattaacggccatgcaccaccacccacggaatcgagaaagagctatcaatctgtcaattctgacatttctgacatttctgacatttctgacatttctgacatttccgactcggaccgatg

SEQ ID NO: 16648 - DNA, 203 bp, Homo sapiens
ggcgcgccagtcctgatcaagcagtctgacatttctgacatttctgacatttctgacatttctgacatttctgacatttctgacattaagcccatttctgacattaagcccatttctgacattaagcccatttctgacattaagcccatttctgacattaagcccatttctgacatttctgacatttccgactcggaccgatg

SEQ ID NO: 16649 - DNA, 203 bp, Homo sapiens
ggcgcgccagtccttgtaacaaggtctgacatttctgacatttctgacatttctgacatttctgacatttctgacatttctgacattaatcccatttctgacattaatcccatttctgacattaatcccatttctgacattaatcccatttctgacattaatcccatttctgacatttctgacatttccgactcggaccgatg

SEQ ID NO: 16650 - DNA, 203 bp, Homo sapiens
ggcgcgccagtcctgccttgttaatctgacatttctgacatttctgacatttctgacatttctgacatttctgacatttctgacattacggaatcgagaaacattacggaatcgagaaacattacggaatcgagaaacattacggaatcgagaaacattacggaatcgagaaacatttctgacatttccgactcggaccgatg

SEQ ID NO: 16651 - DNA, 203 bp, Homo sapiens
ggcgcgccagtcctacagttgatttctgacatttctgacatttctgacatttctgacatttctgacatttctgacatttctgacattactagcatttctgacattactagcatttctgacattactagcatttctgacattactagcatttctgacattactagcatttctgacatttctgacatttccgactcggaccgatg

SEQ ID NO: 16652 - DNA, 203 bp, Homo sapiens
ggcgcgccagtcctttgctagagatctgacatttctgacatttctgacatttctgacatttctgacatttctgacatttctgacattactcagatttctgacattactcagatttctgacattactcagatttctgacattactcagatttctgacattactcagatttctgacatttctgacatttccgactcggaccgatg

SEQ ID NO: 16653 - DNA, 203 bp, Homo sapiens
ggcgcgccagtccttctagcaaactctgacatttctgacatttctgacatttctgacatttctgacatttctgacatttctgacattactcccatttctgacattactcccatttctgacattactcccatttctgacattactcccatttctgacattactcccatttctgacattactcccatttccgactcggaccgatg

SEQ ID NO: 16654 - DNA, 203 bp, Homo sapiens
ggcgcgccagtcctgtagcaaacatctgacatttctgacatttctgacatttctgacatttctgacatttctgacatttctgacattactcccatttctgacattactcccatttctgacattactcccatttctgacattactcccatttctgacattactcccatttctgacatttctgacatttccgactcggaccgatg

SEQ ID NO: 16655 - DNA, 203 bp, Homo sapiens
ggcgcgccagtcctttaaagctaatctgacatttctgacatttctgacatttctgacatttctgacatttctgacatttctgacattactcccatttctgacattactcccatttctgacattactcccatttctgacattactcccatttctgacatttctgacatttctgacatttctgacatttccgactcggaccgatg

SEQ ID NO: 16656 - DNA, 203 bp, Homo sapiens
ggcgcgccagtccttaggatcgtctctgacatttctgacatttctgacatttctgacatttctgacatttctgacatttctgacattactcccatttctgacattactcccatttctgacattactcccatttctgacatttctgacatttctgacattactcccatttctgacattactcccatttccgactcggaccgatg

SEQ ID NO: 16657 - DNA, 203 bp, Homo sapiens
ggcgcgccagtcctggatcgtcagtctgacatttctgacatttctgacatttctgacatttctgacatttctgacatttctgacattactcccatttctgacattactcccatttctgacattactcccatttctgacatttctgacatttctgacattactcccatttctgacatttctgacatttccgactcggaccgatg

SEQ ID NO: 16658 - DNA, 203 bp, Homo sapiens
ggcgcgccagtccttgcttgggtctctgacatttctgacatttctgacatttctgacatttctgacatttctgacatttctgacattactcccatttctgacattactcccatttctgacattactcccatttctgacatttctgacatttctgacatttctgacatttctgacattactcccatttccgactcggaccgatg

SEQ ID NO: 16659 - DNA, 203 bp, Homo sapiens
ggcgcgccagtccttctcttacagtctgacatttctgacatttctgacatttctgacatttctgacatttctgacatttctgacattactcccatttctgacattactcccatttctgacattactcccatttctgacatttctgacatttctgacatttctgacatttctgacatttctgacatttccgactcggaccgatg

SEQ ID NO: 16660 - DNA, 203 bp, Homo sapiens
ggcgcgccagtccttcctgtgaactctgacatttctgacatttctgacatttctgacatttctgacatttctgacatttctgacattactcccatttctgacattactcccatttctgacatttctgacatttctgacattactcccatttctgacatttctgacatttctgacattactcccatttccgactcggaccgatg

SEQ ID NO: 16661 - DNA, 203 bp, Homo sapiens
ggcgcgccagtcctgaaaccgtactctgacatttctgacatttctgacatttctgacatttctgacatttctgacatttctgacattactcccatttctgacattactcccatttctgacatttctgacatttctgacatttctgacatttctgacatttctgacatttctgacattactcccatttccgactcggaccgatg

SEQ ID NO: 16662 - DNA, 203 bp, Homo sapiens
ggcgcgccagtcctgtacggtgagtctgacatttctgacatttctgacatttctgacatttctgacatttctgacatttctgacattactcccatttctgacattactcccatttctgacatttctgacatttctgacatttctgacatttctgacatttctgacatttctgacatttctgacatttccgactcggaccgatg

SEQ ID NO: 16663 - DNA, 203 bp, Homo sapiens
ggcgcgccagtccttagtacggtatctgacatttctgacatttctgacatttctgacatttctgacatttctgacatttctgacattactcccatttctgacatttctgacatttctgacattactcccatttctgacattactcccatttctgacattactcccatttctgacattactcccatttccgactcggaccgatg

SEQ ID NO: 16664 - DNA, 203 bp, Homo sapiens
ggcgcgccagtcctggtacggtgatctgacatttctgacatttctgacatttctgacatttctgacatttctgacatttctgacattactcccatttctgacatttctgacatttctgacattactcccatttctgacattactcccatttctgacattactcccatttctgacatttctgacatttccgactcggaccgatg

SEQ ID NO: 16665 - DNA, 203 bp, Homo sapiens
ggcgcgccagtccttcaggacacatctgacatttctgacatttctgacatttctgacatttctgacatttctgacatttctgacattactcccatttctgacatttctgacatttctgacattactcccatttctgacattactcccatttctgacatttctgacatttctgacattactcccatttccgactcggaccgatg

SEQ ID NO: 16666 - DNA, 203 bp, Homo sapiens
ggcgcgccagtcctggcagtcgtatctgacatttctgacatttctgacatttctgacatttctgacatttctgacatttctgacattactcccatttctgacatttctgacatttctgacattactcccatttctgacattactcccatttctgacatttctgacatttctgacatttctgacatttccgactcggaccgatg

SEQ ID NO: 16667 - DNA, 203 bp, Homo sapiens
ggcgcgccagtcctccaggctgtatctgacatttctgacatttctgacatttctgacatttctgacatttctgacatttctgacattactcccatttctgacatttctgacatttctgacattactcccatttctgacatttctgacatttctgacattactcccatttctgacattactcccatttccgactcggaccgatg

SEQ ID NO: 16668 - DNA, 203 bp, Homo sapiens
ggcgcgccagtcctcctcactgcctctgacatttctgacatttctgacatttctgacatttctgacatttctgacatttctgacattactcccatttctgacatttctgacatttctgacattactcccatttctgacatttctgacatttctgacattactcccatttctgacatttctgacatttccgactcggaccgatg

SEQ ID NO: 16669 - DNA, 203 bp, Homo sapiens
ggcgcgccagtccttaggctgtgttctgacatttctgacatttctgacatttctgacatttctgacatttctgacatttctgacattactcccatttctgacatttctgacatttctgacattactcccatttctgacatttctgacatttctgacatttctgacatttctgacattactcccatttccgactcggaccgatg

SEQ ID NO: 16670 - DNA, 203 bp, Homo sapiens
ggcgcgccagtcctggctgtcaggtctgacatttctgacatttctgacatttctgacatttctgacatttctgacatttctgacattactcccatttctgacatttctgacatttctgacatttctgacatttctgacattactcccatttctgacattactcccatttctgacattactcccatttccgactcggaccgatg

SEQ ID NO: 16671 - DNA, 203 bp, Homo sapiens
ggcgcgccagtccttacactgccttctgacatttctgacatttctgacatttctgacatttctgacatttctgacatttctgacattactcccatttctgacatttctgacatttctgacatttctgacatttctgacattactcccatttctgacattactcccatttctgacatttctgacatttccgactcggaccgatg

SEQ ID NO: 16672 - DNA, 203 bp, Homo sapiens
ggcgcgccagtcctaggcagtctttctgacatttctgacatttctgacatttctgacatttctgacatttctgacatttctgacattactcccatttctgacatttctgacatttctgacatttctgacatttctgacattactcccatttctgacatttctgacatttctgacatttctgacatttccgactcggaccgatg

SEQ ID NO: 16673 - DNA, 203 bp, Homo sapiens
ggcgcgccagtccttcatggtggatctgacatttctgacatttctgacatttctgacatttctgacatttctgacatttctgacattactcccatttctgacatttctgacatttctgacatttctgacatttctgacatttctgacatttctgacattactcccatttctgacatttctgacatttccgactcggaccgatg

SEQ ID NO: 16674 - DNA, 203 bp, Homo sapiens
ggcgcgccagtcctttaaggatcttctgacatttctgacatttctgacatttctgacatttctgacatttctgacatttctgacattactcccatttctgacatttctgacatttctgacatttctgacatttctgacatttctgacatttctgacatttctgacatttctgacattactcccatttccgactcggaccgatg

SEQ ID NO: 16675 - DNA, 203 bp, Homo sapiens
ggcgcgccagtcctctctaccagatctgacatttctgacatttctgacatttctgacatttctgacatttctgacatttctgacattactcgtatttctgacattactcgtatttctgacattactcgtatttctgacattactcgtatttctgacattactcgtatttctgacatttctgacatttccgactcggaccgatg

SEQ ID NO: 16676 - DNA, 203 bp, Homo sapiens
ggcgcgccagtcctacaggcttactctgacatttctgacatttctgacatttctgacatttctgacatttctgacatttctgacattactgacatttctgacattactgacatttctgacattactgacatttctgacattactgacatttctgacattactgacatttctgacatttctgacatttccgactcggaccgatg

SEQ ID NO: 16677 - DNA, 203 bp, Homo sapiens
ggcgcgccagtcctaggacaacagtctgacatttctgacatttctgacatttctgacatttctgacatttctgacatttctgacattacttggcaaactgacattacttggcaaactgacattacttggcaaactgacattacttggcaaactgacattacttggcaaactgacatttctgacatttccgactcggaccgatg

SEQ ID NO: 16678 - DNA, 203 bp, Homo sapiens
ggcgcgccagtcctgctacgagtttctgacatttctgacatttctgacatttctgacatttctgacatttctgacatttctgacattactttcatttctgacattactttcatttctgacattactttcatttctgacattactttcatttctgacattactttcatttctgacatttctgacatttccgactcggaccgatg

SEQ ID NO: 16679 - DNA, 203 bp, Homo sapiens
ggcgcgccagtcctcctgagacaatctgacatttctgacatttctgacatttctgacatttctgacatttctgacatttctgacattagccccatttctgacattagccccatttctgacattagccccatttctgacattagccccatttctgacattagccccatttctgacatttctgacatttccgactcggaccgatg

SEQ ID NO: 16680 - DNA, 203 bp, Homo sapiens
ggcgcgccagtcctgtagacaacttctgacatttctgacatttctgacatttctgacatttctgacatttctgacatttctgacattaggcccatttctgacattaggcccatttctgacattaggcccatttctgacattaggcccatttctgacattaggcccatttctgacatttctgacatttccgactcggaccgatg

SEQ ID NO: 16681 - DNA, 203 bp, Homo sapiens
ggcgcgccagtccttcagacaagctctgacatttctgacatttctgacatttctgacatttctgacatttctgacatttctgacattaggcgggtttctgacattaggcgggtttctgacattaggcgggtttctgacattaggcgggtttctgacattaggcgggtttctgacatttctgacatttccgactcggaccgatg

SEQ ID NO: 16682 - DNA, 203 bp, Homo sapiens
ggcgcgccagtcctcatgggtatttctgacatttctgacatttctgacatttctgacatttctgacatttctgacatttctgacattccggaatcgagaaacattccggaatcgagaaacattccggaatcgagaaacattccggaatcgagaaacattccggaatcgagaaacatttctgacatttccgactcggaccgatg

SEQ ID NO: 16683 - DNA, 203 bp, Homo sapiens
ggcgcgccagtcctgtcatgttcatctgacatttctgacatttctgacatttctgacatttctgacatttctgacatttctgacattcctcccatttctgacattcctcccatttctgacattcctcccatttctgacattcctcccatttctgacattcctcccatttctgacatttctgacatttccgactcggaccgatg

SEQ ID NO: 16684 - DNA, 203 bp, Homo sapiens
ggcgcgccagtcctgtgagaagtttctgacatttctgacatttctgacatttctgacatttctgacatttctgacatttctgacattgcggccgtttctgacattgcggccgtttctgacattgcggccgtttctgacattgcggccgtttctgacattgcggccgtttctgacatttctgacatttccgactcggaccgatg

SEQ ID NO: 16685 - DNA, 203 bp, Homo sapiens
ggcgcgccagtcctgtatctaagttctgacatttctgacatttctgacatttctgacatttctgacatttctgacatttctgacattgctcccatttctgacattgctcccatttctgacattgctcccatttctgacattgctcccatttctgacattgctcccatttctgacatttctgacatttccgactcggaccgatg

SEQ ID NO: 16686 - DNA, 203 bp, Homo sapiens
ggcgcgccagtccttctaagctcatctgacatttctgacatttctgacatttctgacatttctgacatttctgacatttctgacattgggcgggtttctgacattgggcgggtttctgacattgggcgggtttctgacattgggcgggtttctgacattgggcgggtttctgacatttctgacatttccgactcggaccgatg

SEQ ID NO: 16687 - DNA, 203 bp, Homo sapiens
ggcgcgccagtcctaatctaaggatctgacatttctgacatttctgacatttctgacatttctgacatttctgacatttctgacattgtcaattcctttaacattgtcaattcctttaacattgtcaattcctttaacattgtcaattcctttaacattgtcaattcctttaacatttctgacatttccgactcggaccgatg

SEQ ID NO: 16688 - DNA, 203 bp, Homo sapiens
ggcgcgccagtcctccacttagactctgacatttctgacatttctgacatttctgacatttctgacatttctgacatttctgacatttaccggccgtctgacatttctgacatttctgacatttctgacatttctgacatttctgacatttctgacatttctgacatttctgacatttctgtactccccgactcggaccgatg

SEQ ID NO: 16689 - DNA, 203 bp, Homo sapiens
ggcgcgccagtccttcttagactgtctgacatttctgacatttctgacatttctgacatttctgacatttctgacatttctgacatttaccggccgtctgacatttctgacatttctgacatttctgacatttctgacatttctgacatttctgacatttctgacatttctgaccacggaatcgagaacgactcggaccgatg

SEQ ID NO: 16690 - DNA, 203 bp, Homo sapiens
ggcgcgccagtccttcttagagactctgacatttctgacatttctgacatttctgacatttctgacatttctgacatttctgacatttaccggccgtctgacatttctgacatttctgacatttctgacatttctgacatttctgacatttctgacatttctgacatttctgaccgtcaattcctttacgactcggaccgatg

SEQ ID NO: 16691 - DNA, 203 bp, Homo sapiens
ggcgcgccagtcctccaccgtgcctctgacatttctgacatttctgacatttctgacatttctgacatttctgacatttctgacatttactggcaaactgacatttactggcaaactgacatttactggcaaactgacatttactggcaaactgacatttactggcaaactgacatttctgacatttccgactcggaccgatg

SEQ ID NO: 16692 - DNA, 203 bp, Homo sapiens
ggcgcgccagtcctagtttgggtatctgacatttctgacatttctgacatttctgacatttctgacatttctgacatttctgacatttcagccattcgcagtttcactgtaccggccgtgcgtactcagacatgcatggtttctgacatttctgacatttctgacatttctgacatttctgacatttccgactcggaccgatg

SEQ ID NO: 16693 - DNA, 203 bp, Homo sapiens
ggcgcgccagtcctcaacagtgactctgacatttctgacatttctgacatttctgacatttctgacatttctgacatttctgacatttccggccatgcaccaccacccacggaatcgagaaagagctatcaatctgtcatttctgacatttctgacatttctgacatttctgacatttctgacatttccgactcggaccgatg

SEQ ID NO: 16694 - DNA, 203 bp, Homo sapiens
ggcgcgccagtcctttgaacagcatctgacatttctgacatttctgacatttctgacatttctgacatttctgacatttctgacatttccggcgggtctgacatttctgacatttctgacatttctgacatttctgacatttctgacatttctgacatttctgacatttctgacatttctgtactccccgactcggaccgatg

SEQ ID NO: 16695 - DNA, 203 bp, Homo sapiens
ggcgcgccagtcctaacgctactctctgacatttctgacatttctgacatttctgacatttctgacatttctgacatttctgacatttcctggcaaactgacatttcctggcaaactgacatttcctggcaaactgacatttcctggcaaactgacatttcctggcaaactgacatttctgacatttccgactcggaccgatg

SEQ ID NO: 16696 - DNA, 203 bp, Homo sapiens
ggcgcgccagtcctcagatcagtgtctgacatttctgacatttctgacatttctgacatttctgacatttctgacatttctgacatttcggccgtttctgacatttcggccgtttctgacatttcggccgtttctgacatttcggccgtttctgacatttcggccgtttctgacatttctgacatttccgactcggaccgatg

SEQ ID NO: 16697 - DNA, 203 bp, Homo sapiens
ggcgcgccagtcctgactgcagtctctgacatttctgacatttctgacatttctgacatttctgacatttctgacatttctgacatttcgtcaattcctttaatttctgacatttctgacatttctgacatttctgacatttctgacatttctgacatttctgacatttctgacatttcaccggccgtcgactcggaccgatg

SEQ ID NO: 16698 - DNA, 203 bp, Homo sapiens
ggcgcgccagtcctcttaacacattctgacatttctgacatttctgacatttctgacatttctgacatttctgacatttctgacatttcgtcaattcctttaatttctgacatttctgacatttctgacatttctgacatttctgacatttctgacatttctgacatttctgacatttcccggcgggtcgactcggaccgatg

SEQ ID NO: 16699 - DNA, 203 bp, Homo sapiens
ggcgcgccagtcctaggttgacgatctgacatttctgacatttctgacatttctgacatttctgacatttctgacatttctgacatttcgttcttgattaatgaaaacattcttggcaaatgctttcgctctggtccgtcttctgacatttctgacatttctgacatttctgacatttctgacatttccgactcggaccgatg

SEQ ID NO: 16700 - DNA, 203 bp, Homo sapiens
ggcgcgccagtcctctcgtcaacctctgacatttctgacatttctgacatttctgacatttctgacatttctgacatttctgacatttcgttcttgattaatgaaaacattcttggcaaatgctttcgctctggtccgttttctgacatttctgacatttctgacatttctgacatttctgacatttccgactcggaccgatg

SEQ ID NO: 16701 - DNA, 203 bp, Homo sapiens
ggcgcgccagtcctgaggatcacttctgacatttctgacatttctgacatttctgacatttctgacatttctgacatttctgacatttctaggcaaactgacatttctaggcaaactgacatttctaggcaaactgacatttctaggcaaactgacatttctaggcaaactgacatttctgacatttccgactcggaccgatg

SEQ ID NO: 16702 - DNA, 203 bp, Homo sapiens
ggcgcgccagtcctcactgggttctctgacatttctgacatttctgacatttctgacatttctgacatttctgacatttctgacatttctcacggaatcgagaattctgacatttctgacatttctgacatttctgacatttctgacatttctgacatttctgacatttctgaccacggaatcgagaacgactcggaccgatg

SEQ ID NO: 16703 - DNA, 203 bp, Homo sapiens
ggcgcgccagtcctgacccagtattctgacatttctgacatttctgacatttctgacatttctgacatttctgacatttctgacatttctcacggaatcgagaattctgacatttctgacatttctgacatttctgacatttctgacatttctgacatttctgacatttctgaccgtcaattcctttacgactcggaccgatg

SEQ ID NO: 16704 - DNA, 203 bp, Homo sapiens
ggcgcgccagtcctacccagtatgtctgacatttctgacatttctgacatttctgacatttctgacatttctgacatttctgacatttctcagcaaactgacatttctcagcaaactgacatttctcagcaaactgacatttctcagcaaactgacatttctcagcaaactgacatttctgacatttccgactcggaccgatg

SEQ ID NO: 16705 - DNA, 203 bp, Homo sapiens
ggcgcgccagtcctcccagtttgctctgacatttctgacatttctgacatttctgacatttctgacatttctgacatttctgacatttctcgattccgtgacatttctcgattccgtgacatttctcgattccgtgacatttctcgattccgtgacatttctcgattccgtgacatttctgacatttccgactcggaccgatg

SEQ ID NO: 16706 - DNA, 203 bp, Homo sapiens
ggcgcgccagtcctgatcctgaactctgacatttctgacatttctgacatttctgacatttctgacatttctgacatttctgacatttctcggcaaactgacatttctcggcaaactgacatttctcggcaaactgacatttctcggcaaactgacatttctcggcaaactgacatttctgacatttccgactcggaccgatg

SEQ ID NO: 16707 - DNA, 203 bp, Homo sapiens
ggcgcgccagtcctaaacggtgcctctgacatttctgacatttctgacatttctgacatttctgacatttctgacatttctgacatttctgaagtttcagctttgcaaccatactccccccggaacccaaagacttacatttctgacatttctgacatttctgacatttctgacatttctgacatttccgactcggaccgatg

SEQ ID NO: 16708 - DNA, 203 bp, Homo sapiens
ggcgcgccagtcctagagaggatctctgacatttctgacatttctgacatttctgacatttctgacatttctgacatttctgacatttctgacaccggccgtatttctgacatttctgacatttctgacatttctgacatttctgacatttctgacatttctgacatttctgacatttcccggcgggtcgactcggaccgatg

SEQ ID NO: 16709 - DNA, 203 bp, Homo sapiens
ggcgcgccagtcctatgggttaaatctgacatttctgacatttctgacatttctgacatttctgacatttctgacatttctgacatttctgacagtttcccggaagctgcccggcgggtcatgggaataacgcctgacatttctgacatttctgacatttctgacatttctgacatttctgacatttccgactcggaccgatg

SEQ ID NO: 16710 - DNA, 203 bp, Homo sapiens
ggcgcgccagtcctagttaaaggatctgacatttctgacatttctgacatttctgacatttctgacatttctgacatttctgacatttctgacataccggccgtttctgacatttctgacatttctgacatttctgacatttctgacatttctgacatttctgacatttctgacatttctgacatttccgactcggaccgatg

SEQ ID NO: 16711 - DNA, 203 bp, Homo sapiens
ggcgcgccagtcctcgaaaactgttctgacatttctgacatttctgacatttctgacatttctgacatttctgacatttctgacatttctgacatccggcgggtttctgacatttctgacatttctgacatttctgacatttctgacatttctgacatttctgacatttctgacatttctgtactccccgactcggaccgatg

SEQ ID NO: 16712 - DNA, 203 bp, Homo sapiens
ggcgcgccagtccttgtatcctcgtctgacatttctgacatttctgacatttctgacatttctgacatttctgacatttctgacatttctgacatccggcgggtttctgacatttctgacatttctgacatttctgacatttctgacatttctgacatttctgacatttctgaccgtcaattcctttacgactcggaccgatg

SEQ ID NO: 16713 - DNA, 203 bp, Homo sapiens
ggcgcgccagtcctcgaaaaccagtctgacatttctgacatttctgacatttctgacatttctgacatttctgacatttctgacatttctgacatcgtcaattcctttaacatttctgacatttctgacatttctgacatttctgacatttctgacatttctgacatttctgacatttcaccggccgtcgactcggaccgatg

SEQ ID NO: 16714 - DNA, 203 bp, Homo sapiens
ggcgcgccagtcctggaccactcgtctgacatttctgacatttctgacatttctgacatttctgacatttctgacatttctgacatttctgacatgattaatgaaaacattcttggcaaatgctttcgctctgctgacatttctgacatttctgacatttctgacatttctgacatttctgacatttccgactcggaccgatg

SEQ ID NO: 16715 - DNA, 203 bp, Homo sapiens
ggcgcgccagtcctttgagtatcgtctgacatttctgacatttctgacatttctgacatttctgacatttctgacatttctgacatttctgacatgtggtgcccttccgtcaattcctttaagtttcagctttctgacatttctgacatttctgacatttctgacatttctgacatttctgacatttccgactcggaccgatg

SEQ ID NO: 16716 - DNA, 203 bp, Homo sapiens
ggcgcgccagtcctttactgctcgtctgacatttctgacatttctgacatttctgacatttctgacatttctgacatttctgacatttctgacattcgcagtttcactgtaccggccgtgcgtactcagacatctgacatttctgacatttctgacatttctgacatttctgacatttctgacatttccgactcggaccgatg

SEQ ID NO: 16717 - DNA, 203 bp, Homo sapiens
ggcgcgccagtcctcgaagcagtttctgacatttctgacatttctgacatttctgacatttctgacatttctgacatttctgacatttctgacattcgcagtttcactgtaccggccgtgcgtactcagacatgcgacatttctgacatttctgacatttctgacatttctgacatttctgacatttccgactcggaccgatg

SEQ ID NO: 16718 - DNA, 203 bp, Homo sapiens
ggcgcgccagtcctgttggactcgtctgacatttctgacatttctgacatttctgacatttctgacatttctgacatttctgacatttctgacattgcaccaccacccacggaatcgagaaagagctatcaatctgacatttctgacatttctgacatttctgacatttctgacatttctgacatttccgactcggaccgatg

SEQ ID NO: 16719 - DNA, 203 bp, Homo sapiens
ggcgcgccagtcctatccacctcgtctgacatttctgacatttctgacatttctgacatttctgacatttctgacatttctgacatttctgacatttcaccggccgttgacatttctgacatttctgacatttctgacatttctgacatttctgacatttctgacatttctgacattttcttggcaaacgactcggaccgatg

SEQ ID NO: 16720 - DNA, 203 bp, Homo sapiens
ggcgcgccagtcctgaggccttcgtctgacatttctgacatttctgacatttctgacatttctgacatttctgacatttctgacatttctgacatttcacggaatcgagaaatttctgacatttctgacatttctgacatttctgacatttctgacatttctgacatttctgaccacggaatcgagaacgactcggaccgatg

SEQ ID NO: 16721 - DNA, 203 bp, Homo sapiens
ggcgcgccagtcctcgacaacgtttctgacatttctgacatttctgacatttctgacatttctgacatttctgacatttctgacatttctgacatttcagctttgcaaccatactccccccggaacccaaagtctgacatttctgacatttctgacatttctgacatttctgacatttctgacatttccgactcggaccgatg

SEQ ID NO: 16722 - DNA, 203 bp, Homo sapiens
ggcgcgccagtcctcgactctgtgtctgacatttctgacatttctgacatttctgacatttctgacatttctgacatttctgacatttctgacatttcagctttgcaaccatactccccccggaacccaaattctgacatttctgacatttctgacatttctgacatttctgacatttctgacatttccgactcggaccgatg

SEQ ID NO: 16723 - DNA, 203 bp, Homo sapiens
ggcgcgccagtcctctgttgctcgtctgacatttctgacatttctgacatttctgacatttctgacatttctgacatttctgacatttctgacatttcccggcgggttgacatttctgacatttctgacatttctgacatttctgacatttctgacatttctgacatttctgacattttcttggcaaacgactcggaccgatg

SEQ ID NO: 16724 - DNA, 203 bp, Homo sapiens
ggcgcgccagtcctcgagttcacctctgacatttctgacatttctgacatttctgacatttctgacatttctgacatttctgacatttctgacatttcgtgcccttccgtcaattcctttaagtttcagctttctgacatttctgacatttctgacatttctgacatttctgacatttctgacatttccgactcggaccgatg

SEQ ID NO: 16725 - DNA, 203 bp, Homo sapiens
ggcgcgccagtcctcgaatcctggtctgacatttctgacatttctgacatttctgacatttctgacatttctgacatttctgacatttctgacatttctaatgaaaacattcttggcaaatgctttcgcttttctgacatttctgacatttctgacatttctgacatttctgacatttctgacatttccgactcggaccgatg

SEQ ID NO: 16726 - DNA, 203 bp, Homo sapiens
ggcgcgccagtcctcgatacgttatctgacatttctgacatttctgacatttctgacatttctgacatttctgacatttctgacatttctgacatttctgaaccacccacggaatcgagaaagagctacatttctgacatttctgacatttctgacatttctgacatttctgacatttctgacatttccgactcggaccgatg

SEQ ID NO: 16727 - DNA, 203 bp, Homo sapiens
ggcgcgccagtccttgctctgtcgtctgacatttctgacatttctgacatttctgacatttctgacatttctgacatttctgacatttctgacatttctgacatacccgccggttctgacatacccgccggttctgacatacccgccggttctgacatacccgccggttctgacatttctgacatttccgactcggaccgatg

SEQ ID NO: 16728 - DNA, 203 bp, Homo sapiens
ggcgcgccagtcctcacaacgtcgtctgacatttctgacatttctgacatttctgacatttctgacatttctgacatttctgacatttctgacatttctgacataccggccgtttctgacataccggccgtttctgacatttctgacatttctgacataccggccgtttctgacataccggccgtttccgactcggaccgatg

SEQ ID NO: 16729 - DNA, 203 bp, Homo sapiens
ggcgcgccagtcctcgagcaagtttctgacatttctgacatttctgacatttctgacatttctgacatttctgacatttctgacatttctgacatttctgacataccggccgtttctgacatttctgacatttctgacataccggccgtttctgacatttctgacatttctgacataccggccgtttccgactcggaccgatg

SEQ ID NO: 16730 - DNA, 203 bp, Homo sapiens
ggcgcgccagtcctcgagttgaggtctgacatttctgacatttctgacatttctgacatttctgacatttctgacatttctgacatttctgacatttctgacataccggccgtttctgacatttctgacatttctgacatttctgacatttctgacatttctgacatttctgacataccggccgtttccgactcggaccgatg

SEQ ID NO: 16731 - DNA, 203 bp, Homo sapiens
ggcgcgccagtcctgttttgaatatctgacatttctgacatttctgacatttctgacatttctgacatttctgacatttctgacatttctgacatttctgacataccggccgtttctgacatttctgacatttctgacatttctgacatttctgacatttctgacatttctgacatttctgacatttccgactcggaccgatg

SEQ ID NO: 16732 - DNA, 203 bp, Homo sapiens
ggcgcgccagtcctgtttaacttatctgacatttctgacatttctgacatttctgacatttctgacatttctgacatttctgacatttctgacatttctgacatacggccggtttctgacatacggccggtttctgacatacggccggtttctgacatacggccggtttctgacatttctgacatttccgactcggaccgatg

SEQ ID NO: 16733 - DNA, 203 bp, Homo sapiens
ggcgcgccagtcctccactttctttctgacatttctgacatttctgacatttctgacatttctgacatttctgacatttctgacatttctgacatttctgacatagctgcccggcgggtcatggctgacatttctgacatttctgacatttctgacatttctgacatttctgacatttctgacatttccgactcggaccgatg

SEQ ID NO: 16734 - DNA, 203 bp, Homo sapiens
ggcgcgccagtcctaaatcacagctctgacatttctgacatttctgacatttctgacatttctgacatttctgacatttctgacatttctgacatttctgacatcacggaatcgagaaacatcacggaatcgagaaacatcacggaatcgagaaacatttctgacatttctgacatttctgacatttccgactcggaccgatg

SEQ ID NO: 16735 - DNA, 203 bp, Homo sapiens
ggcgcgccagtcctagcaaaatgctctgacatttctgacatttctgacatttctgacatttctgacatttctgacatttctgacatttctgacatttctgacatcacggaatcgagaaacatttctgacatttctgacatttctgacatttctgacatcacggaatcgagaaacatttctgacatttccgactcggaccgatg

SEQ ID NO: 16736 - DNA, 203 bp, Homo sapiens
ggcgcgccagtcctaaatctctagtctgacatttctgacatttctgacatttctgacatttctgacatttctgacatttctgacatttctgacatttctgacatcacggaatcgagaaacatttctgacatttctgacatttctgacatttctgacatttctgacatttctgacatttctgacatttccgactcggaccgatg

SEQ ID NO: 16737 - DNA, 203 bp, Homo sapiens
ggcgcgccagtccttgcacaaatgtctgacatttctgacatttctgacatttctgacatttctgacatttctgacatttctgacatttctgacatttctgacatcacggaatcgagaaacatttctgacatttctgacatttctgacatttctgacatttctgacatttctgacatttctgtactccccgactcggaccgatg

SEQ ID NO: 16738 - DNA, 203 bp, Homo sapiens
ggcgcgccagtcctcttgcaaatctctgacatttctgacatttctgacatttctgacatttctgacatttctgacatttctgacatttctgacatttctgacatccggcgggtttctgacatccggcgggtttctgacatccggcgggtttctgacatccggcgggtttctgacatccggcgggtttccgactcggaccgatg

SEQ ID NO: 16739 - DNA, 203 bp, Homo sapiens
ggcgcgccagtcctgctagaaatctctgacatttctgacatttctgacatttctgacatttctgacatttctgacatttctgacatttctgacatttctgacatccggcgggtttctgacatccggcgggtttctgacatccggcgggtttctgacatccggcgggtttctgacatccggcgggtttccgactcggaccgatg

SEQ ID NO: 16740 - DNA, 203 bp, Homo sapiens
ggcgcgccagtcctaaatgagttgtctgacatttctgacatttctgacatttctgacatttctgacatttctgacatttctgacatttctgacatttctgacatccggcgggtttctgacatccggcgggtttctgacatccggcgggtttctgacatccggcgggtttctgacatccggcgggtttccgactcggaccgatg

SEQ ID NO: 16741 - DNA, 203 bp, Homo sapiens
ggcgcgccagtcctcctgaaaatgtctgacatttctgacatttctgacatttctgacatttctgacatttctgacatttctgacatttctgacatttctgacatccggcgggtttctgacatccggcgggtttctgacatccggcgggtttctgacatttctgacatttctgacatccggcgggtttccgactcggaccgatg

SEQ ID NO: 16742 - DNA, 203 bp, Homo sapiens
ggcgcgccagtccttgctgaaatctctgacatttctgacatttctgacatttctgacatttctgacatttctgacatttctgacatttctgacatttctgacatccggcgggtttctgacatccggcgggtttctgacatttctgacatttctgacatccggcgggtttctgacatttctgacatttccgactcggaccgatg

SEQ ID NO: 16743 - DNA, 203 bp, Homo sapiens
ggcgcgccagtcctctcaaatggttctgacatttctgacatttctgacatttctgacatttctgacatttctgacatttctgacatttctgacatttctgacatccggcgggtttctgacatccggcgggtttctgacatttctgacatttctgacatttctgacatttctgacatccggcgggtttccgactcggaccgatg

SEQ ID NO: 16744 - DNA, 203 bp, Homo sapiens
ggcgcgccagtcctcagatttgattctgacatttctgacatttctgacatttctgacatttctgacatttctgacatttctgacatttctgacatttctgacatccggcgggtttctgacatttctgacatttctgacatccggcgggtttctgacatttctgacatttctgacatttctgacatttccgactcggaccgatg

SEQ ID NO: 16745 - DNA, 203 bp, Homo sapiens
ggcgcgccagtcctgaatgatttctctgacatttctgacatttctgacatttctgacatttctgacatttctgacatttctgacatttctgacatttctgacatccggcgggtttctgacatttctgacatttctgacatttctgacatttctgacatttctgacatttctgacatccggcgggtttccgactcggaccgatg

SEQ ID NO: 16746 - DNA, 203 bp, Homo sapiens
ggcgcgccagtcctgatttcacaatctgacatttctgacatttctgacatttctgacatttctgacatttctgacatttctgacatttctgacatttctgacatcgtcaattcctttaacatcgtcaattcctttaacatcgtcaattcctttaacatcgtcaattcctttaacatttctgacatttccgactcggaccgatg

SEQ ID NO: 16747 - DNA, 203 bp, Homo sapiens
ggcgcgccagtccttacttgattttctgacatttctgacatttctgacatttctgacatttctgacatttctgacatttctgacatttctgacatttctgacatcgtcaattcctttaacatcgtcaattcctttaacatcgtcaattcctttaacatttctgacatttctgacatttctgacatttccgactcggaccgatg

SEQ ID NO: 16748 - DNA, 203 bp, Homo sapiens
ggcgcgccagtcctatttgatcagtctgacatttctgacatttctgacatttctgacatttctgacatttctgacatttctgacatttctgacatttctgacatcgtcaattcctttaacatttctgacatttctgacatttctgacatttctgacatcgtcaattcctttaacatttctgacatttccgactcggaccgatg

SEQ ID NO: 16749 - DNA, 203 bp, Homo sapiens
ggcgcgccagtcctgtgatttcactctgacatttctgacatttctgacatttctgacatttctgacatttctgacatttctgacatttctgacatttctgacatgcaaccatactccccccggaatgacatttctgacatttctgacatttctgacatttctgacatttctgacatttctgacatttccgactcggaccgatg

SEQ ID NO: 16750 - DNA, 203 bp, Homo sapiens
ggcgcgccagtcctgcagatttgttctgacatttctgacatttctgacatttctgacatttctgacatttctgacatttctgacatttctgacatttctgacattactcccatttctgacattactcccatttctgacattactcccatttctgacatttctgacatttctgacattactcccatttccgactcggaccgatg

SEQ ID NO: 16751 - DNA, 203 bp, Homo sapiens
ggcgcgccagtcctttagatttggtctgacatttctgacatttctgacatttctgacatttctgacatttctgacatttctgacatttctgacatttctgacattactcccatttctgacattactcccatttctgacatttctgacatttctgacattactcccatttctgacatttctgacatttccgactcggaccgatg

SEQ ID NO: 16752 - DNA, 203 bp, Homo sapiens
ggcgcgccagtccttaggatttcgtctgacatttctgacatttctgacatttctgacatttctgacatttctgacatttctgacatttctgacatttctgacattactcccatttctgacatttctgacatttctgacattactcccatttctgacattactcccatttctgacattactcccatttccgactcggaccgatg

SEQ ID NO: 16753 - DNA, 203 bp, Homo sapiens
ggcgcgccagtcctagaacactagtctgacatttctgacatttctgacatttctgacatttctgacatttctgacatttctgacatttctgacatttctgacattactcccatttctgacatttctgacatttctgacattactcccatttctgacattactcccatttctgacatttctgacatttccgactcggaccgatg

SEQ ID NO: 16754 - DNA, 203 bp, Homo sapiens
ggcgcgccagtccttgatcctacatctgacatttctgacatttctgacatttctgacatttctgacatttctgacatttctgacatttctgacatttctgacattactcccatttctgacatttctgacatttctgacattactcccatttctgacatttctgacatttctgacattactcccatttccgactcggaccgatg

SEQ ID NO: 16755 - DNA, 203 bp, Homo sapiens
ggcgcgccagtcctcgacctacaatctgacatttctgacatttctgacatttctgacatttctgacatttctgacatttctgacatttctgacatttctgacattactcccatttctgacatttctgacatttctgacatttctgacatttctgacattactcccatttctgacattactcccatttccgactcggaccgatg

SEQ ID NO: 16756 - DNA, 203 bp, Homo sapiens
ggcgcgccagtcctccaaccagtgtctgacatttctgacatttctgacatttctgacatttctgacatttctgacatttctgacatttctgacatttctgacattactcccatttctgacatttctgacatttctgacatttctgacatttctgacatttctgacatttctgacattactcccatttccgactcggaccgatg

SEQ ID NO: 16757 - DNA, 203 bp, Homo sapiens
ggcgcgccagtcctcatgtatgcatctgacatttctgacatttctgacatttctgacatttctgacatttctgacatttctgacatttctgacatttctgacattactgtaccggccgtgcgttctgacatttctgacatttctgacatttctgacatttctgacatttctgacatttctgacatttccgactcggaccgatg

SEQ ID NO: 16758 - DNA, 203 bp, Homo sapiens
ggcgcgccagtcctactacatgagtctgacatttctgacatttctgacatttctgacatttctgacatttctgacatttctgacatttctgacatttctgacattccggcgggttctgacatttctgacatttctgacatttctgacatttctgacatttctgacatttctgacattttcttggcaaacgactcggaccgatg

SEQ ID NO: 16759 - DNA, 203 bp, Homo sapiens
ggcgcgccagtccttacaggttggtctgacatttctgacatttctgacatttctgacatttctgacatttctgacatttctgacatttctgacatttctgacatttaaccatactccccccgttctgacatttctgacatttctgacatttctgacatttctgacatttctgacatttctgacatttccgactcggaccgatg

SEQ ID NO: 16760 - DNA, 203 bp, Homo sapiens
ggcgcgccagtccttcgcaggtggtctgacatttctgacatttctgacatttctgacatttctgacatttctgacatttctgacatttctgacatttctgacatttcaccggccgttgacatttctgacatttctgacatttctgacatttctgacatttctgacatttctgacatttcccggcgggtcgactcggaccgatg

SEQ ID NO: 16761 - DNA, 203 bp, Homo sapiens
ggcgcgccagtcctgtcactcatttctgacatttctgacatttctgacatttctgacatttctgacatttctgacatttctgacatttctgacatttctgacatttccacggaatcgagaatttctgacatttctgacatttctgacatttctgacatttctgacatttctgacatttctgacatttccgactcggaccgatg

SEQ ID NO: 16762 - DNA, 203 bp, Homo sapiens
ggcgcgccagtcctacgagcagcatctgacatttctgacatttctgacatttctgacatttctgacatttctgacatttctgacatttctgacatttctgacatttcccggcgggttgacatttctgacatttctgacatttctgacatttctgacatttctgacatttctgacatttcaccggccgtcgactcggaccgatg

SEQ ID NO: 16763 - DNA, 203 bp, Homo sapiens
ggcgcgccagtcctgtgcagcatatctgacatttctgacatttctgacatttctgacatttctgacatttctgacatttctgacatttctgacatttctgacatttccgtcaattcctttaattctgacatttctgacatttctgacatttctgacatttctgacatttctgacatttctgacatttccgactcggaccgatg

SEQ ID NO: 16764 - DNA, 203 bp, Homo sapiens
ggcgcgccagtcctatccaacagttctgacatttctgacatttctgacatttctgacatttctgacatttctgacatttctgacatttctgacatttctgacatttctcgattccgtgacatttctcgattccgtgacatttctcgattccgtgacatttctcgattccgtgacatttctgacatttccgactcggaccgatg

SEQ ID NO: 16765 - DNA, 203 bp, Homo sapiens
ggcgcgccagtcctgttaggcctctctgacatttctgacatttctgacatttctgacatttctgacatttctgacatttctgacatttctgacatttctgacatttctgacaaccggccgttttctgacatttctgacatttctgacatttctgacatttctgacatttctgacattttcttggcaaacgactcggaccgatg

SEQ ID NO: 16766 - DNA, 203 bp, Homo sapiens
ggcgcgccagtcctgagctttctatctgacatttctgacatttctgacatttctgacatttctgacatttctgacatttctgacatttctgacatttctgacatttctgacaattcctacatttctgacatttctgacatttctgacatttctgacatttctgacatttctgacatttctgacatttccgactcggaccgatg

SEQ ID NO: 16767 - DNA, 203 bp, Homo sapiens
ggcgcgccagtccttaacttgaaatctgacatttctgacatttctgacatttctgacatttctgacatttctgacatttctgacatttctgacatttctgacatttctgacaattctgacatttctgacatttctgacatttctgacatttctgacatttctgacatttctgacatttctgacatttccgactcggaccgatg

SEQ ID NO: 16768 - DNA, 203 bp, Homo sapiens
ggcgcgccagtcctcaagcacttgtctgacatttctgacatttctgacatttctgacatttctgacatttctgacatttctgacatttctgacatttctgacatttctgacatatctgacatttctgacatttctgacatttctgacatttctgacatttctgacatttctgacatttctgacatttccgactcggaccgatg

SEQ ID NO: 16769 - DNA, 203 bp, Homo sapiens
ggcgcgccagtcctatgtgcttactctgacatttctgacatttctgacatttctgacatttctgacatttctgacatttctgacatttctgacatttctgacatttctgacatgcctgacatttctgacatttctgacatttctgacatttctgacatttctgacatttctgacatttctgacatttccgactcggaccgatg

SEQ ID NO: 16770 - DNA, 203 bp, Homo sapiens
ggcgcgccagtcctcatgaagcactctgacatttctgacatttctgacatttctgacatttctgacatttctgacatttctgacatttctgacatttctgacatttctgacattaccggccgttctgacatttctgacatttctgacatttctgacatttctgacatttctgacatttcaccggccgtcgactcggaccgatg

SEQ ID NO: 16771 - DNA, 203 bp, Homo sapiens
ggcgcgccagtcctagtgcttttctctgacatttctgacatttctgacatttctgacatttctgacatttctgacatttctgacatttctgacatttctgacatttctgacattccggcgggttctgacatttctgacatttctgacatttctgacatttctgacatttctgacatttcaccggccgtcgactcggaccgatg

SEQ ID NO: 16772 - DNA, 203 bp, Homo sapiens
ggcgcgccagtcctgagtgctttatctgacatttctgacatttctgacatttctgacatttctgacatttctgacatttctgacatttctgacatttctgacatttctgacattcgtcaattcctttacatttctgacatttctgacatttctgacatttctgacatttctgacattttcttggcaaacgactcggaccgatg

SEQ ID NO: 16773 - DNA, 203 bp, Homo sapiens
ggcgcgccagtcctactaacaagatctgacatttctgacatttctgacatttctgacatttctgacatttctgacatttctgacatttctgacatttctgacatttctgacattcttggcaaatctgacatttctgacatttctgacatttctgacatttctgacatttctgacatttcaccggccgtcgactcggaccgatg

SEQ ID NO: 16774 - DNA, 203 bp, Homo sapiens
ggcgcgccagtccttagttagtagtctgacatttctgacatttctgacatttctgacatttctgacatttctgacatttctgacatttctgacatttctgacatttctgacattggtgacatttctgacatttctgacatttctgacatttctgacatttctgacatttctgacatttctgacatttccgactcggaccgatg

SEQ ID NO: 16775 - DNA, 203 bp, Homo sapiens
ggcgcgccagtccttactaacaggtctgacatttctgacatttctgacatttctgacatttctgacatttctgacatttctgacatttctgacatttctgacatttctgacatttactccctttctgacatttctgacatttctgacatttctgacatttctgacatttctgacattttcttggcaaacgactcggaccgatg

SEQ ID NO: 16776 - DNA, 203 bp, Homo sapiens
ggcgcgccagtcctctgtactaactctgacatttctgacatttctgacatttctgacatttctgacatttctgacatttctgacatttctgacatttctgacatttctgacatttcaccggccgttgacatttctgacatttctgacatttctgacatttctgacatttctgacatttctgtactccccgactcggaccgatg

SEQ ID NO: 16777 - DNA, 203 bp, Homo sapiens
ggcgcgccagtccttcctcaaaattctgacatttctgacatttctgacatttctgacatttctgacatttctgacatttctgacatttctgacatttctgacatttctgacatttccacggaatcgagaatttctgacatttctgacatttctgacatttctgacatttctgacatttcaccggccgtcgactcggaccgatg

SEQ ID NO: 16778 - DNA, 203 bp, Homo sapiens
ggcgcgccagtccttcctctgcagtctgacatttctgacatttctgacatttctgacatttctgacatttctgacatttctgacatttctgacatttctgacatttctgacatttcccggcgggttgacatttctgacatttctgacatttctgacatttctgacatttctgacatttctgtactccccgactcggaccgatg

SEQ ID NO: 16779 - DNA, 203 bp, Homo sapiens
ggcgcgccagtcctaactcggttatctgacatttctgacatttctgacatttctgacatttctgacatttctgacatttctgacatttctgacatttctgacatttctgacatttccgtcaattcctttatttctgacatttctgacatttctgacatttctgacatttctgacatttcaccggccgtcgactcggaccgatg

SEQ ID NO: 16780 - DNA, 203 bp, Homo sapiens
ggcgcgccagtcctcactcagcagtctgacatttctgacatttctgacatttctgacatttctgacatttctgacatttctgacatttctgacatttctgacatttctgacatttctactccctctgacatttctgacatttctgacatttctgacatttctgacatttctgacatttcaccggccgtcgactcggaccgatg

SEQ ID NO: 16781 - DNA, 203 bp, Homo sapiens
ggcgcgccagtcctcacgcctagctctgacatttctgacatttctgacatttctgacatttctgacatttctgacatttctgacatttctgacatttctgacatttctgacatttctgaaccggccgtcatttctgacatttctgacatttctgacatttctgacatttctgacattttcttggcaaacgactcggaccgatg

SEQ ID NO: 16782 - DNA, 203 bp, Homo sapiens
ggcgcgccagtcctatggacttcgtctgacatttctgacatttctgacatttctgacatttctgacatttctgacatttctgacatttctgacatttctgacatttctgacatttctgacaaccggccgttttctgacatttctgacatttctgacatttctgacatttctgacatttcccggcgggtcgactcggaccgatg

SEQ ID NO: 16783 - DNA, 203 bp, Homo sapiens
ggcgcgccagtcctttgagacccatctgacatttctgacatttctgacatttctgacatttctgacatttctgacatttctgacatttctgacatttctgacatttctgacatttctgacataccggccgtttctgacataccggccgtttctgacatttctgacatttctgacataccggccgtttccgactcggaccgatg

SEQ ID NO: 16784 - DNA, 203 bp, Homo sapiens
ggcgcgccagtccttgttcgtcactctgacatttctgacatttctgacatttctgacatttctgacatttctgacatttctgacatttctgacatttctgacatttctgacatttctgacataccggccgtttctgacatttctgacatttctgacataccggccgtttctgacataccggccgtttccgactcggaccgatg

SEQ ID NO: 16785 - DNA, 203 bp, Homo sapiens
ggcgcgccagtcctgatcaaccgttctgacatttctgacatttctgacatttctgacatttctgacatttctgacatttctgacatttctgacatttctgacatttctgacatttctgacataccggccgtttctgacatttctgacatttctgacataccggccgtttctgacatttctgacatttccgactcggaccgatg

SEQ ID NO: 16786 - DNA, 203 bp, Homo sapiens
ggcgcgccagtcctcagcttaacctctgacatttctgacatttctgacatttctgacatttctgacatttctgacatttctgacatttctgacatttctgacatttctgacatttctgacatcacggaatcgagaaacatcacggaatcgagaaacatttctgacatttctgacatttctgacatttccgactcggaccgatg

SEQ ID NO: 16787 - DNA, 203 bp, Homo sapiens
ggcgcgccagtcctggcagtattctctgacatttctgacatttctgacatttctgacatttctgacatttctgacatttctgacatttctgacatttctgacatttctgacatttctgacatcacggaatcgagaaacatttctgacatttctgacatcacggaatcgagaaacatttctgacatttccgactcggaccgatg

SEQ ID NO: 16788 - DNA, 203 bp, Homo sapiens
ggcgcgccagtcctcaagtgaacctctgacatttctgacatttctgacatttctgacatttctgacatttctgacatttctgacatttctgacatttctgacatttctgacatttctgacatcacggaatcgagaaacatttctgacatttctgacatttctgacatttctgacatttctgacatttccgactcggaccgatg

SEQ ID NO: 16789 - DNA, 203 bp, Homo sapiens
ggcgcgccagtccttctctaagcctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16790 - DNA, 203 bp, Homo sapiens
ggcgcgccagtcctacagtgtacctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16791 - DNA, 203 bp, Homo sapiens
ggcgcgccagtcctttgcaacacctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16792 - DNA, 203 bp, Homo sapiens
ggcgcgccagtccttgcaaagacctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16793 - DNA, 203 bp, Homo sapiens
ggcgcgccagtcctctgagaatcctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16794 - DNA, 203 bp, Homo sapiens
ggcgcgccagtcctggtaactacctctgacatttctgacatttctgacatttctgacatttctgacatttctgacatttctgacatttctgacatttctgacatttctgacatttctgacatccggcgggtttctgacatttctgacatttctgacatccggcgggtttctgacatccggcgggtttccgactcggaccgatg

SEQ ID NO: 16795 - DNA, 203 bp, Homo sapiens
ggcgcgccagtcctggtctaagactctgacatttctgacatttctgacatttctgacatttctgacatttctgacatttctgacatttctgacatttctgacatttctgacatttctgacatccggcgggtttctgacatttctgacatttctgacatccggcgggtttctgacatttctgacatttccgactcggaccgatg

SEQ ID NO: 16796 - DNA, 203 bp, Homo sapiens
ggcgcgccagtcctggcctgaaattctgacatttctgacatttctgacatttctgacatttctgacatttctgacatttctgacatttctgacatttctgacatttctgacatttctgacatccggcgggtttctgacatttctgacatttctgacatttctgacatttctgacatccggcgggtttccgactcggaccgatg

SEQ ID NO: 16797 - DNA, 203 bp, Homo sapiens
ggcgcgccagtcctggtcaaagcttctgacatttctgacatttctgacatttctgacatttctgacatttctgacatttctgacatttctgacatttctgacatttctgacatttctgacatcgtcaattcctttaacatcgtcaattcctttaacatcgtcaattcctttaacatttctgacatttccgactcggaccgatg

SEQ ID NO: 16798 - DNA, 203 bp, Homo sapiens
ggcgcgccagtcctggtcctttcatctgacatttctgacatttctgacatttctgacatttctgacatttctgacatttctgacatttctgacatttctgacatttctgacatttctgacatgggagtaatttctgacatgggagtaatttctgacatgggagtaatttctgacatttctgacatttccgactcggaccgatg

SEQ ID NO: 16799 - DNA, 203 bp, Homo sapiens
ggcgcgccagtcctggtaagcttgtctgacatttctgacatttctgacatttctgacatttctgacatttctgacatttctgacatttctgacatttctgacatttctgacatttctgacattactcccatttctgacattactcccatttctgacattactcccatttctgacatttctgacatttccgactcggaccgatg

SEQ ID NO: 16800 - DNA, 203 bp, Homo sapiens
ggcgcgccagtcctggctaaaggttctgacatttctgacatttctgacatttctgacatttctgacatttctgacatttctgacatttctgacatttctgacatttctgacatttctgacattactcccatttctgacattactcccatttctgacatttctgacatttctgacatttctgacatttccgactcggaccgatg

SEQ ID NO: 16801 - DNA, 203 bp, Homo sapiens
ggcgcgccagtcctggactgtctttctgacatttctgacatttctgacatttctgacatttctgacatttctgacatttctgacatttctgacatttctgacatttctgacatttctgacattccggcgggttctgacatttctgacatttctgacatttctgacatttctgacatttctgacatttccgactcggaccgatg

SEQ ID NO: 16802 - DNA, 203 bp, Homo sapiens
ggcgcgccagtccttacagtcgattctgacatttctgacatttctgacatttctgacatttctgacatttctgacatttctgacatttctgacatttctgacatttctgacatttctgacattcttggcaaatctgacatttctgacatttctgacatttctgacatttctgacatttctgacatttccgactcggaccgatg

SEQ ID NO: 16803 - DNA, 203 bp, Homo sapiens
ggcgcgccagtcctttgagtcgagtctgacatttctgacatttctgacatttctgacatttctgacatttctgacatttctgacatttctgacatttctgacatttctgacatttctgacattcttggcaaatctgacatttctgacatttctgacatttctgacatttctgaccacggaatcgagaacgactcggaccgatg

SEQ ID NO: 16804 - DNA, 203 bp, Homo sapiens
ggcgcgccagtcctcagtcgactttctgacatttctgacatttctgacatttctgacatttctgacatttctgacatttctgacatttctgacatttctgacatttctgacatttctgacatttactccctttctgacatttctgacatttctgacatttctgacatttctgacatttcccggcgggtcgactcggaccgatg

SEQ ID NO: 16805 - DNA, 203 bp, Homo sapiens
ggcgcgccagtccttcgactgtcatctgacatttctgacatttctgacatttctgacatttctgacatttctgacatttctgacatttctgacatttctgacatttctgacatttctgacatttccacggaatcgagaatttctgacatttctgacatttctgacatttctgacatttctgacatttccgactcggaccgatg

SEQ ID NO: 16806 - DNA, 203 bp, Homo sapiens
ggcgcgccagtccttggaccaacatctgacatttctgacatttctgacatttctgacatttctgacatttctgacatttctgacatttctgacatttctgacatttctgacatttctgacatttccgtcaattcctttatttctgacatttctgacatttctgacatttctgacatttctgacatttccgactcggaccgatg

SEQ ID NO: 16807 - DNA, 203 bp, Homo sapiens
ggcgcgccagtcctggcgtttgcttctgacatttctgacatttctgacatttctgacatttctgacatttctgacatttctgacatttctgacatttctgacatttctgacatttctgacatttctaccggccgtgacatttctgacatttctgacatttctgacatttctgacattttcttggcaaacgactcggaccgatg

SEQ ID NO: 16808 - DNA, 203 bp, Homo sapiens
ggcgcgccagtcctaaacgctcgttctgacatttctgacatttctgacatttctgacatttctgacatttctgacatttctgacatttctgacatttctgacatttctgacatttctgacatttctactccctctgacatttctgacatttctgacatttctgacatttctgaccacggaatcgagaacgactcggaccgatg

SEQ ID NO: 16809 - DNA, 203 bp, Homo sapiens
ggcgcgccagtcctcgaagtaccttctgacatttctgacatttctgacatttctgacatttctgacatttctgacatttctgacatttctgacatttctgacatttctgacatttctgacatttctgacaaccggccgttttctgacatttctgacatttctgacatttctgaccacggaatcgagaacgactcggaccgatg

SEQ ID NO: 16810 - DNA, 203 bp, Homo sapiens
ggcgcgccagtcctactgtacctctctgacatttctgacatttctgacatttctgacatttctgacatttctgacatttctgacatttctgacatttctgacatttctgacatttctgacatttctgacacacggaatcgagaagacatttctgacatttctgacatttctgacatttcaccggccgtcgactcggaccgatg

SEQ ID NO: 16811 - DNA, 203 bp, Homo sapiens
ggcgcgccagtcctaaaattcgtctctgacatttctgacatttctgacatttctgacatttctgacatttctgacatttctgacatttctgacatttctgacatttctgacatttctgacatttctgacaccggcgggttttctgacatttctgacatttctgacatttctgacatttctgacatttccgactcggaccgatg

SEQ ID NO: 16812 - DNA, 203 bp, Homo sapiens
ggcgcgccagtcctccaccaaatttctgacatttctgacatttctgacatttctgacatttctgacatttctgacatttctgacatttctgacatttctgacatttctgacatttctgacatttctgacacggaatcgagaactgacatttctgacatttctgacatttctgacattttcttggcaaacgactcggaccgatg

SEQ ID NO: 16813 - DNA, 203 bp, Homo sapiens
ggcgcgccagtccttgtagaaatttctgacatttctgacatttctgacatttctgacatttctgacatttctgacatttctgacatttctgacatttctgacatttctgacatttctgacatttctgacacgtcaattcctttagacatttctgacatttctgacatttctgacatttcccggcgggtcgactcggaccgatg

SEQ ID NO: 16814 - DNA, 203 bp, Homo sapiens
ggcgcgccagtcctgcaagaattttctgacatttctgacatttctgacatttctgacatttctgacatttctgacatttctgacatttctgacatttctgacatttctgacatttctgacatttctgacatactccccatttctgacatttctgacatttctgacatttctgacatttcccggcgggtcgactcggaccgatg

SEQ ID NO: 16815 - DNA, 203 bp, Homo sapiens
ggcgcgccagtcctcacggtggactctgacatttctgacatttctgacatttctgacatttctgacatttctgacatttctgacatttctgacatttctgacatttctgacatttctgacatttctgacattcgtcaattcctttacatttctgacatttctgacatttctgaccgtcaattcctttacgactcggaccgatg

SEQ ID NO: 16816 - DNA, 203 bp, Homo sapiens
ggcgcgccagtcctatgcaccgtgtctgacatttctgacatttctgacatttctgacatttctgacatttctgacatttctgacatttctgacatttctgacatttctgacatttctgacatttctgacatttaccggccgtctgacatttctgacatttctgacatttctgacattttcttggcaaacgactcggaccgatg

SEQ ID NO: 16817 - DNA, 203 bp, Homo sapiens
ggcgcgccagtcctctgcaccgactctgacatttctgacatttctgacatttctgacatttctgacatttctgacatttctgacatttctgacatttctgacatttctgacatttctgacatttctgacatttactccctttctgacatttctgacatttctgacatttctgacatttctgtactccccgactcggaccgatg

SEQ ID NO: 16818 - DNA, 203 bp, Homo sapiens
ggcgcgccagtccttttcacaccatctgacatttctgacatttctgacatttctgacatttctgacatttctgacatttctgacatttctgacatttctgacatttctgacatttctgacatttctgacatttactccctttctgacatttctgacatttctgacatttctgaccacggaatcgagaacgactcggaccgatg

SEQ ID NO: 16819 - DNA, 203 bp, Homo sapiens
ggcgcgccagtcctaacagaagattctgacatttctgacatttctgacatttctgacatttctgacatttctgacatttctgacatttctgacatttctgacatttctgacatttctgacatttctgacatttctaccggccgtgacatttctgacatttctgacatttctgacatttcaccggccgtcgactcggaccgatg

SEQ ID NO: 16820 - DNA, 203 bp, Homo sapiens
ggcgcgccagtccttagaacttgctctgacatttctgacatttctgacatttctgacatttctgacatttctgacatttctgacatttctgacatttctgacatttctgacatttctgacatttctgacatttctaccggccgtgacatttctgacatttctgacatttctgacatttcccggcgggtcgactcggaccgatg

SEQ ID NO: 16821 - DNA, 203 bp, Homo sapiens
ggcgcgccagtcctctagaacttctctgacatttctgacatttctgacatttctgacatttctgacatttctgacatttctgacatttctgacatttctgacatttctgacatttctgacatttctgacatttctcacggaatcgagaattctgacatttctgacatttctgacattttcttggcaaacgactcggaccgatg

SEQ ID NO: 16822 - DNA, 203 bp, Homo sapiens
ggcgcgccagtcctcgaaatttcttctgacatttctgacatttctgacatttctgacatttctgacatttctgacatttctgacatttctgacatttctgacatttctgacatttctgacatttctgacatttctccggcgggtgacatttctgacatttctgacatttctgacatttcaccggccgtcgactcggaccgatg

SEQ ID NO: 16823 - DNA, 203 bp, Homo sapiens
ggcgcgccagtcctggttgacgtttctgacatttctgacatttctgacatttctgacatttctgacatttctgacatttctgacatttctgacatttctgacatttctgacatttctgacatttctgacatttctcgtcaattcctttattctgacatttctgacatttctgacattttcttggcaaacgactcggaccgatg

SEQ ID NO: 16824 - DNA, 203 bp, Homo sapiens
ggcgcgccagtcctctgttttcgttctgacatttctgacatttctgacatttctgacatttctgacatttctgacatttctgacatttctgacatttctgacatttctgacatttctgacatttctgacatttctgacacgtcaattcctttagacatttctgacatttctgacatttctgtactccccgactcggaccgatg

SEQ ID NO: 16825 - DNA, 203 bp, Homo sapiens
ggcgcgccagtccttcacaaagtatctgacatttctgacatttctgacatttctgacatttctgacatttctgacatttctgacatttctgacatttctgacatttctgacatttctgacatttctgacatttctgacacgtcaattcctttagacatttctgacatttctgaccgtcaattcctttacgactcggaccgatg

SEQ ID NO: 16826 - DNA, 203 bp, Homo sapiens
ggcgcgccagtcctcttgtagaactctgacatttctgacatttctgacatttctgacatttctgacatttctgacatttctgacatttctgacatttctgacatttctgacatttctgacatttctgacatttctgacatacccgccggttctgacatacccgccggttctgacatttctgacatttccgactcggaccgatg

SEQ ID NO: 16827 - DNA, 203 bp, Homo sapiens
ggcgcgccagtcctggcaggttactctgacatttctgacatttctgacatttctgacatttctgacatttctgacatttctgacatttctgacatttctgacatttctgacatttctgacatttctgacatttctgacataccggccgtttctgacatttctgacatttctgacataccggccgtttccgactcggaccgatg

SEQ ID NO: 16828 - DNA, 203 bp, Homo sapiens
ggcgcgccagtcctaacctacctctctgacatttctgacatttctgacatttctgacatttctgacatttctgacatttctgacatttctgacatttctgacatttctgacatttctgacatttctgacatttctgacataccggccgtttctgacatttctgacatttctgacattttcttggcaaacgactcggaccgatg

SEQ ID NO: 16829 - DNA, 203 bp, Homo sapiens
ggcgcgccagtccttagtaggttgtctgacatttctgacatttctgacatttctgacatttctgacatttctgacatttctgacatttctgacatttctgacatttctgacatttctgacatttctgacatttctgacatactccccatttctgacatttctgacatttctgacatttctgacatttccgactcggaccgatg

SEQ ID NO: 16830 - DNA, 203 bp, Homo sapiens
ggcgcgccagtcctgcacgatcgttctgacatttctgacatttctgacatttctgacatttctgacatttctgacatttctgacatttctgacatttctgacatttctgacatttctgacatttctgacatttctgacatactccccatttctgacatttctgacatttctgaccgtcaattcctttacgactcggaccgatg

SEQ ID NO: 16831 - DNA, 203 bp, Homo sapiens
ggcgcgccagtcctgacgtcactatctgacatttctgacatttctgacatttctgacatttctgacatttctgacatttctgacatttctgacatttctgacatttctgacatttctgacatttctgacatttctgacatcacggaatcgagaaacatttctgacatttctgacatttctgacatttccgactcggaccgatg

SEQ ID NO: 16832 - DNA, 203 bp, Homo sapiens
ggcgcgccagtcctagtcctcgtgtctgacatttctgacatttctgacatttctgacatttctgacatttctgacatttctgacatttctgacatttctgacatttctgacatttctgacatttctgacatttctgacatccggcgggtttctgacatccggcgggtttctgacatccggcgggtttccgactcggaccgatg

SEQ ID NO: 16833 - DNA, 203 bp, Homo sapiens
ggcgcgccagtcctctcgtgagcatctgacatttctgacatttctgacatttctgacatttctgacatttctgacatttctgacatttctgacatttctgacatttctgacatttctgacatttctgacatttctgacatccggcgggtttctgacatccggcgggtttctgacatccggcgggtttccgactcggaccgatg

SEQ ID NO: 16834 - DNA, 203 bp, Homo sapiens
ggcgcgccagtcctgtgctcgtggtctgacatttctgacatttctgacatttctgacatttctgacatttctgacatttctgacatttctgacatttctgacatttctgacatttctgacatttctgacatttctgacatccggcgggtttctgacatccggcgggtttctgacatccggcgggtttccgactcggaccgatg

SEQ ID NO: 16835 - DNA, 203 bp, Homo sapiens
ggcgcgccagtcctccacgagcagtctgacatttctgacatttctgacatttctgacatttctgacatttctgacatttctgacatttctgacatttctgacatttctgacatttctgacatttctgacatttctgacatccggcgggtttctgacatccggcgggtttctgacatccggcgggtttccgactcggaccgatg

SEQ ID NO: 16836 - DNA, 203 bp, Homo sapiens
ggcgcgccagtccttctgttgagctctgacatttctgacatttctgacatttctgacatttctgacatttctgacatttctgacatttctgacatttctgacatttctgacatttctgacatttctgacatttctgacatccggcgggtttctgacatttctgacatttctgacatttctgacatttccgactcggaccgatg

SEQ ID NO: 16837 - DNA, 203 bp, Homo sapiens
ggcgcgccagtccttatgcacggttctgacatttctgacatttctgacatttctgacatttctgacatttctgacatttctgacatttctgacatttctgacatttctgacatttctgacatttctgacatttctgacatcgtcaattcctttaacatcgtcaattcctttaacatttctgacatttccgactcggaccgatg

SEQ ID NO: 16838 - DNA, 203 bp, Homo sapiens
ggcgcgccagtccttcgatttctatctgacatttctgacatttctgacatttctgacatttctgacatttctgacatttctgacatttctgacatttctgacatttctgacatttctgacatttctgacatttctgacattactcccatttctgacattactcccatttctgacattactcccatttccgactcggaccgatg

SEQ ID NO: 16839 - DNA, 203 bp, Homo sapiens
ggcgcgccagtcctccactttagatctgacatttctgacatttctgacatttctgacatttctgacatttctgacatttctgacatttctgacatttctgacatttctgacatttctgacatttctgacatttctgacattactcccatttctgacatttctgacatttctgacattactcccatttccgactcggaccgatg

SEQ ID NO: 16840 - DNA, 203 bp, Homo sapiens
ggcgcgccagtcctataccatgtttctgacatttctgacatttctgacatttctgacatttctgacatttctgacatttctgacatttctgacatttctgacatttctgacatttctgacatttctgacatttctgacatttctaccggccgtgacatttctgacatttctgacatttctgtactccccgactcggaccgatg

SEQ ID NO: 16841 - DNA, 203 bp, Homo sapiens
ggcgcgccagtccttccagaaacgtctgacatttctgacatttctgacatttctgacatttctgacatttctgacatttctgacatttctgacatttctgacatttctgacatttctgacatttctgacatttctgacatttctaccggccgtgacatttctgacatttctgaccacggaatcgagaacgactcggaccgatg

SEQ ID NO: 16842 - DNA, 203 bp, Homo sapiens
ggcgcgccagtcctggtcatgacgtctgacatttctgacatttctgacatttctgacatttctgacatttctgacatttctgacatttctgacatttctgacatttctgacatttctgacatttctgacatttctgacatttctcacggaatcgagaattctgacatttctgacatttcccggcgggtcgactcggaccgatg

SEQ ID NO: 16843 - DNA, 203 bp, Homo sapiens
ggcgcgccagtcctcgtagcaagatctgacatttctgacatttctgacatttctgacatttctgacatttctgacatttctgacatttctgacatttctgacatttctgacatttctgacatttctgacatttctgacatttctccggcgggtgacatttctgacatttctgacatttctgacatttccgactcggaccgatg

SEQ ID NO: 16844 - DNA, 203 bp, Homo sapiens
ggcgcgccagtcctttcttgaacgtctgacatttctgacatttctgacatttctgacatttctgacatttctgacatttctgacatttctgacatttctgacatttctgacatttctgacatttctgacatttctgacatttctcgattccgtgacatttctcgattccgtgacatttctgacatttccgactcggaccgatg

SEQ ID NO: 16845 - DNA, 203 bp, Homo sapiens
ggcgcgccagtcctcgtcttgacttctgacatttctgacatttctgacatttctgacatttctgacatttctgacatttctgacatttctgacatttctgacatttctgacatttctgacatttctgacatttctgacatttctcgtcaattcctttattctgacatttctgacatttcccggcgggtcgactcggaccgatg

SEQ ID NO: 16846 - DNA, 203 bp, Homo sapiens
ggcgcgccagtcctcgacaagacgtctgacatttctgacatttctgacatttctgacatttctgacatttctgacatttctgacatttctgacatttctgacatttctgacatttctgacatttctgacatttctgacatttctgacacggaatcgagaactgacatttctgaccgtcaattcctttacgactcggaccgatg

SEQ ID NO: 16847 - DNA, 203 bp, Homo sapiens
ggcgcgccagtcctcgtctcggtttctgacatttctgacatttctgacatttctgacatttctgacatttctgacatttctgacatttctgacatttctgacatttctgacatttctgacatttctgacatttctgacatttctgacatccggcgggtttctgacatttctgacatttcccggcgggtcgactcggaccgatg

SEQ ID NO: 16848 - DNA, 203 bp, Homo sapiens
ggcgcgccagtcctaatcttaacgtctgacatttctgacatttctgacatttctgacatttctgacatttctgacatttctgacatttctgacatttctgacatttctgacatttctgacatttctgacatttctgacatttctgacatcgtcaattcctttaacatttctgacattttcttggcaaacgactcggaccgatg

SEQ ID NO: 16849 - DNA, 203 bp, Homo sapiens
ggcgcgccagtcctcgttgactgttctgacatttctgacatttctgacatttctgacatttctgacatttctgacatttctgacatttctgacatttctgacatttctgacatttctgacatttctgacatttctgacatttctgacatttaccggccgtctgacatttctgacatttctgacatttccgactcggaccgatg

SEQ ID NO: 16850 - DNA, 203 bp, Homo sapiens
ggcgcgccagtcctgtcttagacgtctgacatttctgacatttctgacatttctgacatttctgacatttctgacatttctgacatttctgacatttctgacatttctgacatttctgacatttctgacatttctgacatttctgacatttaccggccgtctgacatttctgacatttctgtactccccgactcggaccgatg

SEQ ID NO: 16851 - DNA, 203 bp, Homo sapiens
ggcgcgccagtcctctgtgcaacgtctgacatttctgacatttctgacatttctgacatttctgacatttctgacatttctgacatttctgacatttctgacatttctgacatttctgacatttctgacatttctgacatttctgacatttaccggccgtctgacatttctgaccgtcaattcctttacgactcggaccgatg

SEQ ID NO: 16852 - DNA, 203 bp, Homo sapiens
ggcgcgccagtcctgacatggacgtctgacatttctgacatttctgacatttctgacatttctgacatttctgacatttctgacatttctgacatttctgacatttctgacatttctgacatttctgacatttctgacatttctgacatttccggcgggtctgacatttctgaccgtcaattcctttacgactcggaccgatg

SEQ ID NO: 16853 - DNA, 203 bp, Homo sapiens
ggcgcgccagtcctcgttcacttatctgacatttctgacatttctgacatttctgacatttctgacatttctgacatttctgacatttctgacatttctgacatttctgacatttctgacatttctgacatttctgacatttctgacatttctcacggaatcgagaattctgaccacggaatcgagaacgactcggaccgatg

SEQ ID NO: 16854 - DNA, 203 bp, Homo sapiens
ggcgcgccagtcctgaatcagacgtctgacatttctgacatttctgacatttctgacatttctgacatttctgacatttctgacatttctgacatttctgacatttctgacatttctgacatttctgacatttctgacatttctgacatttctcgtcaattcctttattctgacatttctgtactccccgactcggaccgatg

SEQ ID NO: 16855 - DNA, 203 bp, Homo sapiens
ggcgcgccagtcctcgtaaagtgctctgacatttctgacatttctgacatttctgacatttctgacatttctgacatttctgacatttctgacatttctgacatttctgacatttctgacatttctgacatttctgacatttctgacatttctgacaccggccgtatttctgacatttcccggcgggtcgactcggaccgatg

SEQ ID NO: 16856 - DNA, 203 bp, Homo sapiens
ggcgcgccagtcctcaggactacgtctgacatttctgacatttctgacatttctgacatttctgacatttctgacatttctgacatttctgacatttctgacatttctgacatttctgacatttctgacatttctgacatttctgacatttctgacatcacggaatcgagaaacatttcaccggccgtcgactcggaccgatg

SEQ ID NO: 16857 - DNA, 203 bp, Homo sapiens
ggcgcgccagtcctgactgttacgtctgacatttctgacatttctgacatttctgacatttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16858 - DNA, 203 bp, Homo sapiens
ggcgcgccagtcctcgtcaccttctctgacatttctgacatttctgacatttctgacatttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16859 - DNA, 203 bp, Homo sapiens
ggcgcgccagtcctcgttaactcgtctgacatttctgacatttctgacatttctgacatttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16860 - DNA, 203 bp, Homo sapiens
ggcgcgccagtcctcgtagtcgagtctgacatttctgacatttctgacatttctgacatttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16861 - DNA, 203 bp, Homo sapiens
ggcgcgccagtcctgcaccaagcgtctgacatttctgacatttctgacatttctgacatttctgacatttctgacatttctgacatttctgacatttctgacatttctgacatttctgacatttctgacatttctgacatttctgacatttctgacatccggcgggtttctgaccgtcaattcctttacgactcggaccgatg

SEQ ID NO: 16862 - DNA, 203 bp, Homo sapiens
ggcgcgccagtcctgctgtctgcgtctgacatttctgacatttctgacatttctgacatttctgacatttctgacatttctgacatttctgacatttctgacatttctgacatttctgacatttctgacatttctgacatttctgacatttctgacatcgtcaattcctttaacatttcaccggccgtcgactcggaccgatg

SEQ ID NO: 16863 - DNA, 203 bp, Homo sapiens
ggcgcgccagtccttgggtctgcgtctgacatttctgacatttctgacatttctgacatttctgacatttctgacatttctgacatttctgacatttctgacatttctgacatttctgacatttctgacatttctgacatttctgacatttctgacatcgtcaattcctttaacatttcccggcgggtcgactcggaccgatg

SEQ ID NO: 16864 - DNA, 203 bp, Homo sapiens
ggcgcgccagtccttgctactgcgtctgacatttctgacatttctgacatttctgacatttctgacatttctgacatttctgacatttctgacatttctgacatttctgacatttctgacatttctgacatttctgacatttctgacatttctgacatcgtcaattcctttaacatttctgacatttccgactcggaccgatg

SEQ ID NO: 16865 - DNA, 203 bp, Homo sapiens
ggcgcgccagtcctcctacaagcgtctgacatttctgacatttctgacatttctgacatttctgacatttctgacatttctgacatttctgacatttctgacatttctgacatttctgacatttctgacatttctgacatttctgacatttctgacatgggagtaatttctgacatttctgacatttccgactcggaccgatg

SEQ ID NO: 16866 - DNA, 203 bp, Homo sapiens
ggcgcgccagtcctcttgttagcgtctgacatttctgacatttctgacatttctgacatttctgacatttctgacatttctgacatttctgacatttctgacatttctgacatttctgacatttctgacatttctgacatttctgacatttctgacatttcacggaatcgagaaatttctgacatttccgactcggaccgatg

SEQ ID NO: 16867 - DNA, 203 bp, Homo sapiens
ggcgcgccagtcctctcaagagcgtctgacatttctgacatttctgacatttctgacatttctgacatttctgacatttctgacatttctgacatttctgacatttctgacatttctgacatttctgacatttctgacatttctgacatttctgacatttcacggaatcgagaaatttctgtactccccgactcggaccgatg

SEQ ID NO: 16868 - DNA, 203 bp, Homo sapiens
ggcgcgccagtccttcgctttgcgtctgacatttctgacatttctgacatttctgacatttctgacatttctgacatttctgacatttctgacatttctgacatttctgacatttctgacatttctgacatttctgacatttctgacatttctgacatttcgtcaattcctttacgtcaattcctttacgactcggaccgatg

SEQ ID NO: 16869 - DNA, 203 bp, Homo sapiens
ggcgcgccagtcctcgctctaagatctgacatttctgacatttctgacatttctgacatttctgacatttctgacatttctgacatttctgacatttctgacatttctgacatttctgacatttctgacatttctgacatttctgacatttctgacatttctgacatcgtcaattcctttaacatttccgactcggaccgatg

SEQ ID NO: 16870 - DNA, 203 bp, Homo sapiens
ggcgcgccagtcctcgctaggatctctgacatttctgacatttctgacatttctgacatttctgacatttctgacatttctgacatttctgacatttctgacatttctgacatttctgacatttctgacatttctgacatttctgacatttctgacatttctgacattactccccgtcaattcctttacgactcggaccgatg

SEQ ID NO: 16871 - DNA, 203 bp, Homo sapiens
ggcgcgccagtcctcgcctcgtagtctgacatttctgacatttctgacatttctgacatttctgacatttctgacatttctgacatttctgacatttctgacatttctgacatttctgacatttctgacatttctgacatttctgacatttctgacatttctgacatttcaccggccgtccggcgggtcgactcggaccgatg

SEQ ID NO: 16872 - DNA, 203 bp, Homo sapiens
ggcgcgccagtcctcgctcagcgttctgacatttctgacatttctgacatttctgacatttctgacatttctgacatttctgacatttctgacatttctgacatttctgacatttctgacatttctgacatttctgacatttctgacatttctgacatttctgacatttctactcccttcttggcaaacgactcggaccgatg

SEQ ID NO: 16873 - DNA, 203 bp, Homo sapiens
ggcgcgccagtcctcgcctttcgttctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16874 - DNA, 203 bp, Homo sapiens
ggcgcgccagtcctcgcctagtcctctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16875 - DNA, 203 bp, Homo sapiens
ggcgcgccagtcctcgctttgagttctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16876 - DNA, 203 bp, Homo sapiens
ggcgcgccagtcctcgctgacaaatctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16877 - DNA, 203 bp, Homo sapiens
ggcgcgccagtcctcgctaccgtttctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16878 - DNA, 203 bp, Homo sapiens
ggcgcgccagtcctacaactcacgtctgacatttctgacatttctgacatttctgacatttctgacatttctgacatttctgacatttctgacatttctgacatttctgacatttctgacatttctgacatttctgacatttctgacatttctgacatttctgacatttctgacattactcccatttccgactcggaccgatg

SEQ ID NO: 16879 - DNA, 203 bp, Homo sapiens
ggcgcgccagtccttaacgaggcatctgacatttctgacatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16880 - DNA, 203 bp, Homo sapiens
ggcgcgccagtcctagcttcgttatctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16881 - DNA, 203 bp, Homo sapiens
ggcgcgccagtccttctttaacgatctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16882 - DNA, 203 bp, Homo sapiens
ggcgcgccagtcctcttctcgttatctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16883 - DNA, 203 bp, Homo sapiens
ggcgcgccagtccttaacgacatttctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16884 - DNA, 203 bp, Homo sapiens
ggcgcgccagtccttaacgagtggtctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16885 - DNA, 203 bp, Homo sapiens
ggcgcgccagtcctgcaaacgcactctgacatttctgacatttctgacatttctgacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 16886 - DNA, 203 bp, Homo sapiens
ggcgcgccagtcctcgacctagtctctgacatttctgacatttctgacatttctgacatttctgacatttctgacatttctgacatttctgacatttctgacatttctgacatttctgacatttctgacatttctgacatttctgacatttctgacatttctgacatttctgactactccctactccccgactcggaccgatg

SEQ ID NO: 16887 - DNA, 203 bp, Homo sapiens
ggcgcgccagtcctcacgttaacatctgacatttctgacatttctgacatttctgacatttctgacatttctgacatttctgacatttctgacatttctgacatttctgacatttctgacatttctgacatttctgacatttctgacatttctgacatttctgacatttcttcttggcaaatactccccgactcggaccgatg

SEQ ID NO: 16888 - DNA, 203 bp, Homo sapiens
ggcgcgccagtcctgctaccacgttctgacatttctgacatttctgacatttctgacatttctgacatttctgacatttctgacatttctgacatttctgacatttctgacatttctgacatttctgacatttctgacatttctgacatttctgacatttctgactactcccacatttcaccggccgtcgactcggaccgatg

SEQ ID NO: 16889 - DNA, 203 bp, Homo sapiens
ggcgcgccagtcctttaaacgtgctctgacatttctgacatttctgacatttctgacatttctgacatttctgacatttctgacatttctgacatttctgacatttctgacatttctgacatttctgacatttctgacatttctgacatttctgacatttctgcacggaatcgagaattcttggcaaacgactcggaccgatg

SEQ ID NO: 16890 - DNA, 203 bp, Homo sapiens
ggcgcgccagtcctaacgtgcatttctgacatttctgacatttctgacatttctgacatttctgacatttctgacatttctgacatttctgacatttctgacatttctgacatttctgacatttctgacatttctgacatttctgacatttctgacatttctgccggcgggtacatttcaccggccgtcgactcggaccgatg

SEQ ID NO: 16891 - DNA, 203 bp, Homo sapiens
ggcgcgccagtcctacgtgcttcttctgacatttctgacatttctgacatttctgacatttctgacatttctgacatttctgacatttctgacatttctgacatttctgacatttctgacatttctgacatttctgacatttctgacatttctgacatttctgccggcgggtacatttcccggcgggtcgactcggaccgatg

SEQ ID NO: 16892 - DNA, 203 bp, Homo sapiens
ggcgcgccagtccttgcgttaaggtctgacatttctgacatttctgacatttctgacatttctgacatttctgacatttctgacatttctgacatttctgacatttctgacatttctgacatttctgacatttctgacatttctgacatttctgacatttctgtactccctgacattttcttggcaaacgactcggaccgatg

SEQ ID NO: 16893 - DNA, 203 bp, Homo sapiens
ggcgcgccagtcctttaacgcatttctgacatttctgacatttctgacatttctgacatttctgacatttctgacatttctgacatttctgacatttctgacatttctgacatttctgacatttctgacatttctgacatttctgacatttctgacatttctgttcttggcaaaatttctgacatttccgactcggaccgatg

SEQ ID NO: 16894 - DNA, 203 bp, Homo sapiens
ggcgcgccagtccttgtctaacgctctgacatttctgacatttctgacatttctgacatttctgacatttctgacatttctgacatttctgacatttctgacatttctgacatttctgacatttctgacatttctgacatttctgacatttctgacatttctgttcttggcaaacacggaatcgagaacgactcggaccgatg

SEQ ID NO: 16895 - DNA, 203 bp, Homo sapiens
ggcgcgccagtcctctgctgtgcgtctgacatttctgacatttctgacatttctgacatttctgacatttctgacatttctgacatttctgacatttctgacatttctgacatttctgacatttctgacatttctgacatttctgacatttctgacatttcttcttggcaaaacatttcccggcgggtcgactcggaccgatg

SEQ ID NO: 16896 - DNA, 203 bp, Homo sapiens
ggcgcgccagtccttgacatactctctgacatttctgacatttctgacatttctgacatttctgacatttctgacatttctgacatttctgacatttctgacatttctgacatttctgacatttctgacatttctgacatttctgacatttctgacccggcgggtatttctgacatttcaccggccgtcgactcggaccgatg

SEQ ID NO: 16897 - DNA, 203 bp, Homo sapiens
ggcgcgccagtcctgaccagtacatctgacatttctgacatttctgacatttctgacatttctgacatttctgacatttctgacatttctgacatttctgacatttctgacatttctgacatttctgacatttctgacatttctgacatttctgactactcccacatttctgacattttcttggcaaacgactcggaccgatg

SEQ ID NO: 16898 - DNA, 203 bp, Homo sapiens
ggcgcgccagtcctcgtctacagctctgacatttctgacatttctgacatttctgacatttctgacatttctgacatttctgacatttctgacatttctgacatttctgacatttctgacatttctgacatttctgacatttctgacatttctgacttcttggcaaattctgacatttctgacatttccgactcggaccgatg

SEQ ID NO: 16899 - DNA, 203 bp, Homo sapiens
ggcgcgccagtcctagacctgggttctgacatttctgacatttctgacatttctgacatttctgacatttctgacatttctgacatttctgacatttctgacatttctgacatttctgacatttctgacatttctgacatttctgacatttctgacttcttggcaaattctgacatttctgtactccccgactcggaccgatg

SEQ ID NO: 16900 - DNA, 203 bp, Homo sapiens
ggcgcgccagtcctgcagcctgggtctgacatttctgacatttctgacatttctgacatttctgacatttctgacatttctgacatttctgacatttctgacatttctgacatttctgacatttctgacatttctgacatttctgacatttctgacttcttggcaaattctgaccgtcaattcctttacgactcggaccgatg

SEQ ID NO: 16901 - DNA, 203 bp, Homo sapiens
ggcgcgccagtcctacccaggttctctgacatttctgacatttctgacatttctgacatttctgacatttctgacatttctgacatttctgacatttctgacatttctgacatttctgacatttctgacatttctgacatttctgacatttctgccggcgggtacatttctgacattttcttggcaaacgactcggaccgatg

SEQ ID NO: 16902 - DNA, 203 bp, Homo sapiens
ggcgcgccagtcctcattctactatctgacatttctgacatttctgacatttctgacatttctgacatttctgacatttctgacatttctgacatttctgacatttctgacatttctgacatttctgacatttctgacatttctgacatttcttactcccctgacatttctgaccgtcaattcctttacgactcggaccgatg

SEQ ID NO: 16903 - DNA, 203 bp, Homo sapiens
ggcgcgccagtcctggatcttgggtctgacatttctgacatttctgacatttctgacatttctgacatttctgacatttctgacatttctgacatttctgacatttctgacatttctgacatttctgacatttctgacatttctgacatttcttggcaaactgacatttctgacatttctgacatttccgactcggaccgatg

SEQ ID NO: 16904 - DNA, 203 bp, Homo sapiens
ggcgcgccagtcctgtctgacagttctgacatttctgacatttctgacatttctgacatttctgacatttctgacatttctgacatttctgacatttctgacatttctgacatttctgacatttctgacatttctgacatttctgacattttactcccttctgacatttctgacatttcaccggccgtcgactcggaccgatg

SEQ ID NO: 16905 - DNA, 203 bp, Homo sapiens
ggcgcgccagtcctcagtctgacatctgacatttctgacatttctgacatttctgacatttctgacatttctgacatttctgacatttctgacatttctgacatttctgacatttctgacatttctgacatttctgacatttctgacattttactcccttctgacatttctgacatttcccggcgggtcgactcggaccgatg

SEQ ID NO: 16906 - DNA, 203 bp, Homo sapiens
ggcgcgccagtccttgtcagacagtctgacatttctgacatttctgacatttctgacatttctgacatttctgacatttctgacatttctgacatttctgacatttctgacatttctgacatttctgacatttctgacatttctgacccggcgggtatttctgacatttctgacattttcttggcaaacgactcggaccgatg

SEQ ID NO: 16907 - DNA, 203 bp, Homo sapiens
ggcgcgccagtcctacgtctacgttctgacatttctgacatttctgacatttctgacatttctgacatttctgacatttctgacatttctgacatttctgacatttctgacatttctgacatttctgacatttctgacatttcttggcaaactgacatttcttggcaaactgacatttcttggcaaaccgactcggaccgatg

SEQ ID NO: 16908 - DNA, 203 bp, Homo sapiens
ggcgcgccagtccttgttagacgttctgacatttctgacatttctgacatttctgacatttctgacatttctgacatttctgacatttctgacatttctgacatttctgacatttctgacatttctgacatttctgacattttactcccttctgacatttctgacatttctgacattttcttggcaaacgactcggaccgatg

SEQ ID NO: 16909 - DNA, 203 bp, Homo sapiens
ggcgcgccagtcctagacgtacagtctgacatttctgacatttctgacatttctgacatttctgacatttctgacatttctgacatttctgacatttctgacatttctgacatttctgacatttctgacatttctgaccggcgggtcatttctgacatttctgacatttctgaccgtcaattcctttacgactcggaccgatg

SEQ ID NO: 16910 - DNA, 203 bp, Homo sapiens
ggcgcgccagtcctagttttgaaatctgacatttctgacatttctgacatttctgacatttctgacatttctgacatttctgacatttctgacatttctgacatttctgacatttctgacatttctgacatttctgacttcttggcaaattctgacatttctgacatttctgacattttcttggcaaacgactcggaccgatg

SEQ ID NO: 16911 - DNA, 203 bp, Homo sapiens
ggcgcgccagtcctctggatcggttctgacatttctgacatttctgacatttctgacatttctgacatttctgacatttctgacatttctgacatttctgacatttctgacatttctgacatttctgacatttctgatactcccgacatttctgacatttctgacatttctgacatttcaccggccgtcgactcggaccgatg

SEQ ID NO: 16912 - DNA, 203 bp, Homo sapiens
ggcgcgccagtccttgcgaccttctctgacatttctgacatttctgacatttctgacatttctgacatttctgacatttctgacatttctgacatttctgacatttctgacatttctgacatttctgacatttcttactcccctgacatttctgacatttctgacatttctgacattttcttggcaaacgactcggaccgatg

SEQ ID NO: 16913 - DNA, 203 bp, Homo sapiens
ggcgcgccagtcctctctagcgactctgacatttctgacatttctgacatttctgacatttctgacatttctgacatttctgacatttctgacatttctgacatttctgacatttctgacatttctgacatttttcttggcaaagacatttctgacatttctgacatttctgacatttcccggcgggtcgactcggaccgatg

SEQ ID NO: 16914 - DNA, 203 bp, Homo sapiens
ggcgcgccagtcctgcgacttggttctgacatttctgacatttctgacatttctgacatttctgacatttctgacatttctgacatttctgacatttctgacatttctgacatttctgacatttctgaccggcgggtcatttctgacatttctgacatttctgacatttctgacatttcaccggccgtcgactcggaccgatg

SEQ ID NO: 16915 - DNA, 203 bp, Homo sapiens
ggcgcgccagtcctagagtcgccttctgacatttctgacatttctgacatttctgacatttctgacatttctgacatttctgacatttctgacatttctgacatttctgacatttctgacatttctgaccggcgggtcatttctgacatttctgacatttctgacatttctgacatttcccggcgggtcgactcggaccgatg

SEQ ID NO: 16916 - DNA, 203 bp, Homo sapiens
ggcgcgccagtcctcgacgtcgcttctgacatttctgacatttctgacatttctgacatttctgacatttctgacatttctgacatttctgacatttctgacatttctgacatttctgacatttctgacgtcaattcctttactgacatttctgacatttctgacatttctgacattttcttggcaaacgactcggaccgatg

SEQ ID NO: 16917 - DNA, 203 bp, Homo sapiens
ggcgcgccagtccttaagtcgctatctgacatttctgacatttctgacatttctgacatttctgacatttctgacatttctgacatttctgacatttctgacatttctgacatttctgacatttctgattcttggcaaatttctgacatttctgacatttctgacatttctgaccgtcaattcctttacgactcggaccgatg

SEQ ID NO: 16918 - DNA, 203 bp, Homo sapiens
ggcgcgccagtcctctgcgacatgtctgacatttctgacatttctgacatttctgacatttctgacatttctgacatttctgacatttctgacatttctgacatttctgacatttctgacatttcttggcaaactgacatttctgacatttctgacatttcttggcaaactgacatttctgacatttccgactcggaccgatg

SEQ ID NO: 16919 - DNA, 203 bp, Homo sapiens
ggcgcgccagtcctcacctgtcgctctgacatttctgacatttctgacatttctgacatttctgacatttctgacatttctgacatttctgacatttctgacatttctgacatttctgattcttggcaaatttctgacatttctgacatttctgacatttctgacatttctgacatttcccggcgggtcgactcggaccgatg

SEQ ID NO: 16920 - DNA, 203 bp, Homo sapiens
ggcgcgccagtcctcgagcgacagtctgacatttctgacatttctgacatttctgacatttctgacatttctgacatttctgacatttctgacatttctgacatttctgacatttctgcacggaatcgagaatctgacatttctgacatttctgacatttctgacatttctgacatttctgacatttccgactcggaccgatg

SEQ ID NO: 16921 - DNA, 203 bp, Homo sapiens
ggcgcgccagtccttgaatgtcgctctgacatttctgacatttctgacatttctgacatttctgacatttctgacatttctgacatttctgacatttctgacatttctgacatttctgcacggaatcgagaatctgacatttctgacatttctgacatttctgacatttctgaccacggaatcgagaacgactcggaccgatg

SEQ ID NO: 16922 - DNA, 203 bp, Homo sapiens
ggcgcgccagtcctgttggtcgcctctgacatttctgacatttctgacatttctgacatttctgacatttctgacatttctgacatttctgacatttctgacatttctgacatttctgcgtcaattcctttatctgacatttctgacatttctgacatttctgacatttctgacatttctgacatttccgactcggaccgatg

SEQ ID NO: 16923 - DNA, 203 bp, Homo sapiens
ggcgcgccagtcctgtcgctctaatctgacatttctgacatttctgacatttctgacatttctgacatttctgacatttctgacatttctgacatttctgacatttctgacatttctgcgtcaattcctttatctgacatttctgacatttctgacatttctgacatttctgaccgtcaattcctttacgactcggaccgatg

SEQ ID NO: 16924 - DNA, 203 bp, Homo sapiens
ggcgcgccagtcctgtcgctgatctctgacatttctgacatttctgacatttctgacatttctgacatttctgacatttctgacatttctgacatttctgacatttctgacatttctgtactccctgacatttctgacatttctgacatttctgacatttctgacatttctgaccgtcaattcctttacgactcggaccgatg

SEQ ID NO: 16925 - DNA, 203 bp, Homo sapiens
ggcgcgccagtcctgtgtcgctcatctgacatttctgacatttctgacatttctgacatttctgacatttctgacatttctgacatttctgacatttctgacatttctgacatttctttcttggcaaacatttctgacatttctgacatttctgacatttctgacatttctgacattttcttggcaaacgactcggaccgatg

SEQ ID NO: 16926 - DNA, 203 bp, Homo sapiens
ggcgcgccagtcctaatgtcgtagtctgacatttctgacatttctgacatttctgacatttctgacatttctgacatttctgacatttctgacatttctgacatttctgaccacggaatcgagaatgacatttctgacatttctgacatttctgacatttctgacatttctgacatttctgacatttccgactcggaccgatg

SEQ ID NO: 16927 - DNA, 203 bp, Homo sapiens
ggcgcgccagtcctcgcctagaattctgacatttctgacatttctgacatttctgacatttctgacatttctgacatttctgacatttctgacatttctgacatttctgaccgtcaattcctttatgacatttctgacatttctgacatttctgacatttctgacatttctgacatttctgtactccccgactcggaccgatg

SEQ ID NO: 16928 - DNA, 203 bp, Homo sapiens
ggcgcgccagtcctcctagacggttctgacatttctgacatttctgacatttctgacatttctgacatttctgacatttctgacatttctgacatttctgacatttctgattcttggcaaatttctgacatttctgacatttctgacatttctgacatttctgacatttctgacattttcttggcaaacgactcggaccgatg

SEQ ID NO: 16929 - DNA, 203 bp, Homo sapiens
ggcgcgccagtccttctttctaggtctgacatttctgacatttctgacatttctgacatttctgacatttctgacatttctgacatttctgacatttctgacatttctgcacggaatcgagaatctgacatttctgacatttctgacatttctgacatttctgacatttctgacatttcccggcgggtcgactcggaccgatg

SEQ ID NO: 16930 - DNA, 203 bp, Homo sapiens
ggcgcgccagtcctcgtctagtgttctgacatttctgacatttctgacatttctgacatttctgacatttctgacatttctgacatttctgacatttctgacatttctgcatactcccccatttctgacatttctgacatttctgacatttctgacatttctgacatttctgacatttctgacatttccgactcggaccgatg

SEQ ID NO: 16931 - DNA, 203 bp, Homo sapiens
ggcgcgccagtcctgcttctagtctctgacatttctgacatttctgacatttctgacatttctgacatttctgacatttctgacatttctgacatttctgacatttctgcgtcaattcctttatctgacatttctgacatttctgacatttctgacatttctgacatttctgacatttcccggcgggtcgactcggaccgatg

SEQ ID NO: 16932 - DNA, 203 bp, Homo sapiens
ggcgcgccagtcctatctagttggtctgacatttctgacatttctgacatttctgacatttctgacatttctgacatttctgacatttctgacatttctgacatttctgtaccggccgtgcgttctgacatttctgacatttctgacatttctgacatttctgacatttctgacatttctgacatttccgactcggaccgatg

SEQ ID NO: 16933 - DNA, 203 bp, Homo sapiens
ggcgcgccagtcctcttctaggcgtctgacatttctgacatttctgacatttctgacatttctgacatttctgacatttctgacatttctgacatttctgacatttctgtaccggccgtgctttctgacatttctgacatttctgacatttctgacatttctgacatttctgacatttctgacatttccgactcggaccgatg

SEQ ID NO: 16934 - DNA, 203 bp, Homo sapiens
ggcgcgccagtcctggtttagcgttctgacatttctgacatttctgacatttctgacatttctgacatttctgacatttctgacatttctgacatttctgacatttctgttcttggcaacatttctgacatttctgacatttctgacatttctgacatttctgacatttctgacatttctgacatttccgactcggaccgatg

SEQ ID NO: 16935 - DNA, 203 bp, Homo sapiens
ggcgcgccagtccttagtcaggtgtctgacatttctgacatttctgacatttctgacatttctgacatttctgacatttctgacatttctgacatttctgacatttcttcttggcaaaacatttctgacatttctgacatttctgacatttctgacatttctgacatttctgacatttctgacatttccgactcggaccgatg

SEQ ID NO: 16936 - DNA, 203 bp, Homo sapiens
ggcgcgccagtcctggtcaggtcctctgacatttctgacatttctgacatttctgacatttctgacatttctgacatttctgacatttctgacatttctgacatttcttggcaaactgacatttctgacatttctgacatttctgacatttctgacatttctgacatttctgacatttctgacatttccgactcggaccgatg

SEQ ID NO: 16937 - DNA, 203 bp, Homo sapiens
ggcgcgccagtcctaaacctgatctctgacatttctgacatttctgacatttctgacatttctgacatttctgacatttctgacatttctgacatttctgacatttcttggcaaactgacatttctgacatttctgacatttcttggcaaactgacatttctgacatttctgacatttctgacatttccgactcggaccgatg

SEQ ID NO: 16938 - DNA, 203 bp, Homo sapiens
ggcgcgccagtcctacctgaagaatctgacatttctgacatttctgacatttctgacatttctgacatttctgacatttctgacatttctgacatttctgacatttcttggcaaactgacatttctgacatttctgacatttcttggcaaactgacatttcttggcaaactgacatttctgacatttccgactcggaccgatg

SEQ ID NO: 16939 - DNA, 203 bp, Homo sapiens
ggcgcgccagtcctctggtgcatttctgacatttctgacatttctgacatttctgacatttctgacatttctgacatttctgacatttctgacatttctgacattttcttggcaaatgacatttctgacatttctgacatttctgacatttctgacatttctgacatttctgacatttcaccggccgtcgactcggaccgatg

SEQ ID NO: 16940 - DNA, 203 bp, Homo sapiens
ggcgcgccagtcctaatgcaccactctgacatttctgacatttctgacatttctgacatttctgacatttctgacatttctgacatttctgacatttctgacattttcttggcaaatgacatttctgacatttctgacatttctgacatttctgacatttctgacatttctgacatttcccggcgggtcgactcggaccgatg

SEQ ID NO: 16941 - DNA, 203 bp, Homo sapiens
ggcgcgccagtcctgactagaacgtctgacatttctgacatttctgacatttctgacatttctgacatttctgacatttctgacatttctgacatttctgacattttgccaagaactgacattttgccaagaactgacattttgccaagaactgacattttgccaagaactgacatttctgacatttccgactcggaccgatg

SEQ ID NO: 16942 - DNA, 203 bp, Homo sapiens
ggcgcgccagtcctggtagaacgttctgacatttctgacatttctgacatttctgacatttctgacatttctgacatttctgacatttctgacatttctgaccacggaatcgagaatgacatttctgacatttctgacatttctgacatttctgacatttctgacatttctgacatttcaccggccgtcgactcggaccgatg

SEQ ID NO: 16943 - DNA, 203 bp, Homo sapiens
ggcgcgccagtcctcgttctagcatctgacatttctgacatttctgacatttctgacatttctgacatttctgacatttctgacatttctgacatttctgaccacggaatcgagaatgacatttctgacatttctgacatttctgacatttctgacatttctgacatttctgacatttcccggcgggtcgactcggaccgatg

SEQ ID NO: 16944 - DNA, 203 bp, Homo sapiens
ggcgcgccagtcctattttcagtttctgacatttctgacatttctgacatttctgacatttctgacatttctgacatttctgacatttctgacatttctgacccggcgggtatttctgacatttctgacatttctgacatttctgacatttctgacatttctgacatttctgaccacggaatcgagaacgactcggaccgatg

SEQ ID NO: 16945 - DNA, 203 bp, Homo sapiens
ggcgcgccagtcctgtatgtcgggtctgacatttctgacatttctgacatttctgacatttctgacatttctgacatttctgacatttctgacatttctgacccttccgtcaattcctttaagtttgacatttctgacatttctgacatttctgacatttctgacatttctgacatttctgacatttccgactcggaccgatg

SEQ ID NO: 16946 - DNA, 203 bp, Homo sapiens
ggcgcgccagtcctaaagaccgggtctgacatttctgacatttctgacatttctgacatttctgacatttctgacatttctgacatttctgacatttctgaccggccgtacatttctgacatttctgacatttctgacatttctgacatttctgacatttctgacatttctgacatttcccggcgggtcgactcggaccgatg

SEQ ID NO: 16947 - DNA, 203 bp, Homo sapiens
ggcgcgccagtccttcgtctcgggtctgacatttctgacatttctgacatttctgacatttctgacatttctgacatttctgacatttctgacatttctgaccgtcaattcctttatgacatttctgacatttctgacatttctgacatttctgacatttctgacatttctgacatttcccggcgggtcgactcggaccgatg

SEQ ID NO: 16948 - DNA, 203 bp, Homo sapiens
ggcgcgccagtccttagtcatttctctgacatttctgacatttctgacatttctgacatttctgacatttctgacatttctgacatttctgacatttctgaggaagctgcccggcgggtcatgggaaacatttctgacatttctgacatttctgacatttctgacatttctgacatttctgacatttccgactcggaccgatg

SEQ ID NO: 16949 - DNA, 203 bp, Homo sapiens
ggcgcgccagtccttacagtgctctctgacatttctgacatttctgacatttctgacatttctgacatttctgacatttctgacatttctgacatttctgatttgcaaccatactccccccggaaccacatttctgacatttctgacatttctgacatttctgacatttctgacatttctgacatttccgactcggaccgatg

SEQ ID NO: 16950 - DNA, 203 bp, Homo sapiens
ggcgcgccagtcctgtgagttaagtctgacatttctgacatttctgacatttctgacatttctgacatttctgacatttctgacatttctgacatttctgcaccacccacggaatcgagaaagagctacatttctgacatttctgacatttctgacatttctgacatttctgacatttctgacatttccgactcggaccgatg

SEQ ID NO: 16951 - DNA, 203 bp, Homo sapiens
ggcgcgccagtccttttggtcacgtctgacatttctgacatttctgacatttctgacatttctgacatttctgacatttctgacatttctgacatttctgccggcgggtacatttctgacatttctgacatttctgacatttctgacatttctgacatttctgacatttctgacatttcaccggccgtcgactcggaccgatg

SEQ ID NO: 16952 - DNA, 203 bp, Homo sapiens
ggcgcgccagtcctgtcactaccctctgacatttctgacatttctgacatttctgacatttctgacatttctgacatttctgacatttctgacatttctgctttgcaaccatactccccccggaaccccatttctgacatttctgacatttctgacatttctgacatttctgacatttctgacatttccgactcggaccgatg

SEQ ID NO: 16953 - DNA, 203 bp, Homo sapiens
ggcgcgccagtcctaacgagaccctctgacatttctgacatttctgacatttctgacatttctgacatttctgacatttctgacatttctgacatttctgtactccctgacatttctgacatttctgacatttctgacatttctgacatttctgacatttctgacatttctgacattttcttggcaaacgactcggaccgatg

SEQ ID NO: 16954 - DNA, 203 bp, Homo sapiens
ggcgcgccagtcctatcatgaccctctgacatttctgacatttctgacatttctgacatttctgacatttctgacatttctgacatttctgacatttctgttcttggcaaaatttctgacatttctgacatttctgacatttctgacatttctgacatttctgacatttctgacatttctgacatttccgactcggaccgatg

SEQ ID NO: 16955 - DNA, 203 bp, Homo sapiens
ggcgcgccagtcctggcaggaccctctgacatttctgacatttctgacatttctgacatttctgacatttctgacatttctgacatttctgacatttcttcttggcaaaacatttctgacatttctgacatttctgacatttctgacatttctgacatttctgacatttctgacatttcaccggccgtcgactcggaccgatg

SEQ ID NO: 16956 - DNA, 203 bp, Homo sapiens
ggcgcgccagtcctcctttgaccctctgacatttctgacatttctgacatttctgacatttctgacatttctgacatttctgacatttctgacatttcttgcccttccgtcaattcctttaagtttcagatttctgacatttctgacatttctgacatttctgacatttctgacatttctgacatttccgactcggaccgatg

SEQ ID NO: 16957 - DNA, 203 bp, Homo sapiens
ggcgcgccagtcctgggttaagtgtctgacatttctgacatttctgacatttctgacatttctgacatttctgacatttctgacatttctgacattttactcccttctgacatttctgacatttctgacatttctgacatttctgacatttctgacatttctgacatttctgacatttctgacatttccgactcggaccgatg

SEQ ID NO: 16958 - DNA, 203 bp, Homo sapiens
ggcgcgccagtcctgggtgacctctctgacatttctgacatttctgacatttctgacatttctgacatttctgacatttctgacatttctgacattttactcccttctgacatttctgacatttctgacatttctgacatttctgacatttctgacatttctgacatttctgacatttctgtactccccgactcggaccgatg

SEQ ID NO: 16959 - DNA, 203 bp, Homo sapiens
ggcgcgccagtcctgggtagcctgtctgacatttctgacatttctgacatttctgacatttctgacatttctgacatttctgacatttctgacattttactcccttctgacatttctgacatttctgacatttctgacatttctgacatttctgacatttctgacatttctgaccacggaatcgagaacgactcggaccgatg

SEQ ID NO: 16960 - DNA, 203 bp, Homo sapiens
ggcgcgccagtcctcctgcacttctctgacatttctgacatttctgacatttctgacatttctgacatttctgacatttctgacatttctgacattttcttggcaaatgacatttctgacatttctgacatttctgacatttctgacatttctgacatttctgacatttctgacattttcttggcaaacgactcggaccgatg

SEQ ID NO: 16961 - DNA, 203 bp, Homo sapiens
ggcgcgccagtccttactagcgtgtctgacatttctgacatttctgacatttctgacatttctgacatttctgacatttctgacatttctgacatttttaatgaaaacattcttggcaaatgctttcgctcttctgacatttctgacatttctgacatttctgacatttctgacatttctgacatttccgactcggaccgatg

SEQ ID NO: 16962 - DNA, 203 bp, Homo sapiens
ggcgcgccagtcctgcagtgactttctgacatttctgacatttctgacatttctgacatttctgacatttctgacatttctgacatttctgaccacggaatcgagaatgacatttctgacatttctgacatttctgacatttctgacatttctgacatttctgacatttctgacattttcttggcaaacgactcggaccgatg

SEQ ID NO: 16963 - DNA, 203 bp, Homo sapiens
ggcgcgccagtcctgggttgactttctgacatttctgacatttctgacatttctgacatttctgacatttctgacatttctgacatttctgaccatgcaccaccacccacggaatcgagaaagagctatcaatctgacatttctgacatttctgacatttctgacatttctgacatttctgacatttccgactcggaccgatg

SEQ ID NO: 16964 - DNA, 203 bp, Homo sapiens
ggcgcgccagtcctggctaagtcatctgacatttctgacatttctgacatttctgacatttctgacatttctgacatttctgacatttctgacggtttcccggaagctgcccggcgggtcatgggaataacgccggacatttctgacatttctgacatttctgacatttctgacatttctgacatttccgactcggaccgatg

SEQ ID NO: 16965 - DNA, 203 bp, Homo sapiens
ggcgcgccagtccttggcaagtcatctgacatttctgacatttctgacatttctgacatttctgacatttctgacatttctgacatttctgactggtggtgcccttccgtcaattcctttaagtttcagctttgcaacatttctgacatttctgacatttctgacatttctgacatttctgacatttccgactcggaccgatg

SEQ ID NO: 16966 - DNA, 203 bp, Homo sapiens
ggcgcgccagtccttgttgacttgtctgacatttctgacatttctgacatttctgacatttctgacatttctgacatttctgacatttctgacttcttggcaaattctgacatttctgacatttctgacatttctgacatttctgacatttctgacatttctgacatttctgacatttctgacatttccgactcggaccgatg

SEQ ID NO: 16967 - DNA, 203 bp, Homo sapiens
ggcgcgccagtcctaagtcaggcctctgacatttctgacatttctgacatttctgacatttctgacatttctgacatttctgacatttctgacttcttggcaaattctgacatttctgacatttctgacatttctgacatttctgacatttctgacatttctgacatttctgaccacggaatcgagaacgactcggaccgatg

SEQ ID NO: 16968 - DNA, 203 bp, Homo sapiens
ggcgcgccagtcctacgatctttatctgacatttctgacatttctgacatttctgacatttctgacatttctgacatttctgacatttctgatggtttcccggaagctgcccggcgggtcatgggaataacgccgcacatttctgacatttctgacatttctgacatttctgacatttctgacatttccgactcggaccgatg

SEQ ID NO: 16969 - DNA, 203 bp, Homo sapiens
ggcgcgccagtccttttgcacacctctgacatttctgacatttctgacatttctgacatttctgacatttctgacatttctgacatttctgccggcgggtacatttctgacatttctgacatttctgacatttctgacatttctgacatttctgacatttctgacatttctgacattttcttggcaaacgactcggaccgatg

SEQ ID NO: 16970 - DNA, 203 bp, Homo sapiens
ggcgcgccagtccttgcacactactctgacatttctgacatttctgacatttctgacatttctgacatttctgacatttctgacatttctgcctggtggtgcccttccgtcaattcctttaagtttcagctttgcaacatttctgacatttctgacatttctgacatttctgacatttctgacatttccgactcggaccgatg

SEQ ID NO: 16971 - DNA, 203 bp, Homo sapiens
ggcgcgccagtcctgtctggtttatctgacatttctgacatttctgacatttctgacatttctgacatttctgacatttctgacatttctgcgcaaactgacatttctgcgcaaactgacatttctgcgcaaactgacatttctgcgcaaactgacatttctgcgcaaactgacatttctgacatttccgactcggaccgatg

SEQ ID NO: 16972 - DNA, 203 bp, Homo sapiens
ggcgcgccagtcctaaagtatgaatctgacatttctgacatttctgacatttctgacatttctgacatttctgacatttctgacatttctgtgcaaactgacatttctgtgcaaactgacatttctgtgcaaactgacatttctgtgcaaactgacatttctgtgcaaactgacatttctgacatttccgactcggaccgatg

SEQ ID NO: 16973 - DNA, 203 bp, Homo sapiens
ggcgcgccagtccttaagtatgggtctgacatttctgacatttctgacatttctgacatttctgacatttctgacatttctgacatttctgttcttggcaaaatttctgacatttctgacatttctgacatttctgacatttctgacatttctgacatttctgacatttctgacatttcaccggccgtcgactcggaccgatg

SEQ ID NO: 16974 - DNA, 203 bp, Homo sapiens
ggcgcgccagtcctacgacagatatctgacatttctgacatttctgacatttctgacatttctgacatttctgacatttctgacatttcttagcaaactgacatttcttagcaaactgacatttcttagcaaactgacatttcttagcaaactgacatttcttagcaaactgacatttctgacatttccgactcggaccgatg

SEQ ID NO: 16975 - DNA, 203 bp, Homo sapiens
ggcgcgccagtcctgtttgtatcctctgacatttctgacatttctgacatttctgacatttctgacatttctgacatttctgacatttcttcctggtggtgcccttccgtcaattcctttaagtttcagctttgcaacatttctgacatttctgacatttctgacatttctgacatttctgacatttccgactcggaccgatg

SEQ ID NO: 16976 - DNA, 203 bp, Homo sapiens
ggcgcgccagtccttttagagacctctgacatttctgacatttctgacatttctgacatttctgacatttctgacatttctgacatttcttcgcaaactgacatttcttcgcaaactgacatttcttcgcaaactgacatttcttcgcaaactgacatttcttcgcaaactgacatttctgacatttccgactcggaccgatg

SEQ ID NO: 16977 - DNA, 203 bp, Homo sapiens
ggcgcgccagtccttgaacatacctctgacatttctgacatttctgacatttctgacatttctgacatttctgacatttctgacatttcttgaaaaactgacatttcttgaaaaactgacatttcttgaaaaactgacatttcttgaaaaactgacatttcttgaaaaactgacatttctgacatttccgactcggaccgatg

SEQ ID NO: 16978 - DNA, 203 bp, Homo sapiens
ggcgcgccagtcctgatacttacctctgacatttctgacatttctgacatttctgacatttctgacatttctgacatttctgacatttcttgagaaactgacatttcttgagaaactgacatttcttgagaaactgacatttcttgagaaactgacatttcttgagaaactgacatttctgacatttccgactcggaccgatg

SEQ ID NO: 16979 - DNA, 203 bp, Homo sapiens
ggcgcgccagtccttactgtaacctctgacatttctgacatttctgacatttctgacatttctgacatttctgacatttctgacatttcttgcaaaactgacatttcttgcaaaactgacatttcttgcaaaactgacatttcttgcaaaactgacatttcttgcaaaactgacatttctgacatttccgactcggaccgatg

SEQ ID NO: 16980 - DNA, 203 bp, Homo sapiens
ggcgcgccagtcctaaacagatcctctgacatttctgacatttctgacatttctgacatttctgacatttctgacatttctgacatttcttggcaaactgacatttctgacatttctgacatttctgacatttctgacatttctgacatttctgacatttctgacatttctgaccacggaatcgagaacgactcggaccgatg

SEQ ID NO: 16981 - DNA, 203 bp, Homo sapiens
ggcgcgccagtcctggtaacgaattctgacatttctgacatttctgacatttctgacatttctgacatttctgacatttctgacatttcttggcaaactgacatttctgacatttctgacatttcttggcaaactgacatttctgacatttctgacatttctgacatttctgacatttctgacatttccgactcggaccgatg

SEQ ID NO: 16982 - DNA, 203 bp, Homo sapiens
ggcgcgccagtcctggtaagaatctctgacatttctgacatttctgacatttctgacatttctgacatttctgacatttctgacatttcttggcaaactgacatttctgacatttctgacatttcttggcaaactgacatttcttggcaaactgacatttcttggcaaactgacatttctgacatttccgactcggaccgatg

SEQ ID NO: 16983 - DNA, 203 bp, Homo sapiens
ggcgcgccagtcctggttcatgtatctgacatttctgacatttctgacatttctgacatttctgacatttctgacatttctgacatttcttggcaaactgacatttcttggcaaactgacatttctgacatttctgacatttctgacatttctgacatttctgacatttctgacatttctgacatttccgactcggaccgatg

SEQ ID NO: 16984 - DNA, 203 bp, Homo sapiens
ggcgcgccagtcctatgtgatctatctgacatttctgacatttctgacatttctgacatttctgacatttctgacatttctgacatttcttggcaaactgacatttcttggcaaactgacatttcttggcaaactgacatttcttggcaaactgacatttcttggcaaactgacatttcttggcaaaccgactcggaccgatg

SEQ ID NO: 16985 - DNA, 203 bp, Homo sapiens
ggcgcgccagtcctggcttcaccctctgacatttctgacatttctgacatttctgacatttctgacatttctgacatttctgacatttcttggcaacctgacatttcttggcaacctgacatttcttggcaacctgacatttcttggcaacctgacatttcttggcaacctgacatttctgacatttccgactcggaccgatg

SEQ ID NO: 16986 - DNA, 203 bp, Homo sapiens
ggcgcgccagtcctgttcacccactctgacatttctgacatttctgacatttctgacatttctgacatttctgacatttctgacatttcttggcaagctgacatttcttggcaagctgacatttcttggcaagctgacatttcttggcaagctgacatttcttggcaagctgacatttctgacatttccgactcggaccgatg

SEQ ID NO: 16987 - DNA, 203 bp, Homo sapiens
ggcgcgccagtcctagagttaacgtctgacatttctgacatttctgacatttctgacatttctgacatttctgacatttctgacatttcttggcaatctgacatttcttggcaatctgacatttcttggcaatctgacatttcttggcaatctgacatttcttggcaatctgacatttctgacatttccgactcggaccgatg

SEQ ID NO: 16988 - DNA, 203 bp, Homo sapiens
ggcgcgccagtcctgaaacctagatctgacatttctgacatttctgacatttctgacatttctgacatttctgacatttctgacatttcttggcacactgacatttcttggcacactgacatttcttggcacactgacatttcttggcacactgacatttcttggcacactgacatttctgacatttccgactcggaccgatg

SEQ ID NO: 16989 - DNA, 203 bp, Homo sapiens
ggcgcgccagtcctaacctagcagtctgacatttctgacatttctgacatttctgacatttctgacatttctgacatttctgacatttcttggcaccctgacatttcttggcaccctgacatttcttggcaccctgacatttcttggcaccctgacatttcttggcaccctgacatttctgacatttccgactcggaccgatg

SEQ ID NO: 16990 - DNA, 203 bp, Homo sapiens
ggcgcgccagtcctagcaacctagtctgacatttctgacatttctgacatttctgacatttctgacatttctgacatttctgacatttcttggcactctgacatttcttggcactctgacatttcttggcactctgacatttcttggcactctgacatttcttggcactctgacatttctgacatttccgactcggaccgatg

SEQ ID NO: 16991 - DNA, 203 bp, Homo sapiens
ggcgcgccagtccttaaccgagcctctgacatttctgacatttctgacatttctgacatttctgacatttctgacatttctgacatttcttggcagactgacatttcttggcagactgacatttcttggcagactgacatttcttggcagactgacatttcttggcagactgacatttctgacatttccgactcggaccgatg

SEQ ID NO: 16992 - DNA, 203 bp, Homo sapiens
ggcgcgccagtcctcgcaagttgctctgacatttctgacatttctgacatttctgacatttctgacatttctgacatttctgacatttcttggcaggctgacatttcttggcaggctgacatttcttggcaggctgacatttcttggcaggctgacatttcttggcaggctgacatttctgacatttccgactcggaccgatg

SEQ ID NO: 16993 - DNA, 203 bp, Homo sapiens
ggcgcgccagtcctgcaacttgcgtctgacatttctgacatttctgacatttctgacatttctgacatttctgacatttctgacatttcttggcagtctgacatttcttggcagtctgacatttcttggcagtctgacatttcttggcagtctgacatttcttggcagtctgacatttctgacatttccgactcggaccgatg

SEQ ID NO: 16994 - DNA, 203 bp, Homo sapiens
ggcgcgccagtcctagcaggacgttctgacatttctgacatttctgacatttctgacatttctgacatttctgacatttctgacatttcttggcatgctgacatttcttggcatgctgacatttcttggcatgctgacatttcttggcatgctgacatttcttggcatgctgacatttctgacatttccgactcggaccgatg

SEQ ID NO: 16995 - DNA, 203 bp, Homo sapiens
ggcgcgccagtcctgacgtccaactctgacatttctgacatttctgacatttctgacatttctgacatttctgacatttctgacatttcttggccaactgacatttcttggccaactgacatttcttggccaactgacatttcttggccaactgacatttcttggccaactgacatttctgacatttccgactcggaccgatg

SEQ ID NO: 16996 - DNA, 203 bp, Homo sapiens
ggcgcgccagtcctcgacgtcctgtctgacatttctgacatttctgacatttctgacatttctgacatttctgacatttctgacatttcttggcccactgacatttcttggcccactgacatttcttggcccactgacatttcttggcccactgacatttcttggcccactgacatttctgacatttccgactcggaccgatg

SEQ ID NO: 16997 - DNA, 203 bp, Homo sapiens
ggcgcgccagtcctaagacgtccttctgacatttctgacatttctgacatttctgacatttctgacatttctgacatttctgacatttcttggccgactgacatttcttggccgactgacatttcttggccgactgacatttcttggccgactgacatttcttggccgactgacatttctgacatttccgactcggaccgatg

SEQ ID NO: 16998 - DNA, 203 bp, Homo sapiens
ggcgcgccagtcctgaggacgtcttctgacatttctgacatttctgacatttctgacatttctgacatttctgacatttctgacatttcttggcgaactgacatttcttggcgaactgacatttcttggcgaactgacatttcttggcgaactgacatttcttggcgaactgacatttctgacatttccgactcggaccgatg

SEQ ID NO: 16999 - DNA, 203 bp, Homo sapiens
ggcgcgccagtcctggacgtttcgtctgacatttctgacatttctgacatttctgacatttctgacatttctgacatttctgacatttcttggcgcactgacatttcttggcgcactgacatttcttggcgcactgacatttcttggcgcactgacatttcttggcgcactgacatttctgacatttccgactcggaccgatg

SEQ ID NO: 17000 - DNA, 203 bp, Homo sapiens
ggcgcgccagtcctggtagtaggctctgacatttctgacatttctgacatttctgacatttctgacatttctgacatttctgacatttcttggctcactgacatttcttggctcactgacatttcttggctcactgacatttcttggctcactgacatttcttggctcactgacatttctgacatttccgactcggaccgatg

SEQ ID NO: 17001 - DNA, 203 bp, Homo sapiens
ggcgcgccagtccttggattcacgtctgacatttctgacatttctgacatttctgacatttctgacatttctgacatttctgacatttcttgggaaactgacatttcttgggaaactgacatttcttgggaaactgacatttcttgggaaactgacatttcttgggaaactgacatttctgacatttccgactcggaccgatg

SEQ ID NO: 17002 - DNA, 203 bp, Homo sapiens
ggcgcgccagtcctcgtgaatacgtctgacatttctgacatttctgacatttctgacatttctgacatttctgacatttctgacatttcttgtgaaactgacatttcttgtgaaactgacatttcttgtgaaactgacatttcttgtgaaactgacatttcttgtgaaactgacatttctgacatttccgactcggaccgatg

SEQ ID NO: 17003 - DNA, 203 bp, Homo sapiens
ggcgcgccagtcctgtgcgaatactctgacatttctgacatttctgacatttctgacatttctgacatttctgacatttctgacatttggcgggtttctgacatttggcgggtttctgacatttggcgggtttctgacatttggcgggtttctgacatttggcgggtttctgacatttctgacatttccgactcggaccgatg

SEQ ID NO: 17004 - DNA, 203 bp, Homo sapiens
ggcgcgccagtcctagcgaatgtctctgacatttctgacatttctgacatttctgacatttctgacatttctgacatttctgacattttactcccttctgacatttctgacatttctgacatttctgacatttctgacatttctgacatttctgacatttctgacatttctgacatttcccggcgggtcgactcggaccgatg

SEQ ID NO: 17005 - DNA, 203 bp, Homo sapiens
ggcgcgccagtcctaggctgcgaatctgacatttctgacatttctgacatttctgacatttctgacatttctgacatttctgacattttatggcaaactgacattttatggcaaactgacattttatggcaaactgacattttatggcaaactgacattttatggcaaactgacatttctgacatttccgactcggaccgatg

SEQ ID NO: 17006 - DNA, 203 bp, Homo sapiens
ggcgcgccagtccttctgcgaagctctgacatttctgacatttctgacatttctgacatttctgacatttctgacatttctgacattttgccaagaactgacattttgccaagaactgacattttgccaagaactgacattttgccaagaactgacattttgccaagaactgacatttctgacatttccgactcggaccgatg

SEQ ID NO: 17007 - DNA, 203 bp, Homo sapiens
ggcgcgccagtccttgcttgcgaatctgacatttctgacatttctgacatttctgacatttctgacatttctgacatttctgacccggcgggtatttctgacatttctgacatttctgacatttctgacatttctgacatttctgacatttctgacatttctgacatttctgacattttcttggcaaacgactcggaccgatg

SEQ ID NO: 17008 - DNA, 203 bp, Homo sapiens
ggcgcgccagtcctactgcgaaaatctgacatttctgacatttctgacatttctgacatttctgacatttctgacatttctgacctccactcctggtggtgcccttccgtcaattcctttaagtttcagctttgcaaccatactgacatttctgacatttctgacatttctgacatttctgacatttccgactcggaccgatg

SEQ ID NO: 17009 - DNA, 203 bp, Homo sapiens
ggcgcgccagtccttggcgaagtctctgacatttctgacatttctgacatttctgacatttctgacatttctgacatttctgacgtcaattcctttactgacatttctgacatttctgacatttctgacatttctgacatttctgacatttctgacatttctgacatttctgacatttctgacatttccgactcggaccgatg

SEQ ID NO: 17010 - DNA, 203 bp, Homo sapiens
ggcgcgccagtcctaagcgaaaattctgacatttctgacatttctgacatttctgacatttctgacatttctgacatttctgacgtcaattcctttactgacatttctgacatttctgacatttctgacatttctgacatttctgacatttctgacatttctgacatttctgaccgtcaattcctttacgactcggaccgatg

SEQ ID NO: 17011 - DNA, 203 bp, Homo sapiens
ggcgcgccagtcctggttcgctcttctgacatttctgacatttctgacatttctgacatttctgacatttctgacatttctgacttcctttaagtttcagctttgcaaccatactccccccggaacccaaagactttggtttccgacatttctgacatttctgacatttctgacatttctgacatttccgactcggaccgatg

SEQ ID NO: 17012 - DNA, 203 bp, Homo sapiens
ggcgcgccagtcctaagttcgcagtctgacatttctgacatttctgacatttctgacatttctgacatttctgacatttctgacttcttggcaaattctgacatttctgacatttctgacatttctgacatttctgacatttctgacatttctgacatttctgacatttctgacatttcaccggccgtcgactcggaccgatg

SEQ ID NO: 17013 - DNA, 203 bp, Homo sapiens
ggcgcgccagtcctacgctttcgctctgacatttctgacatttctgacatttctgacatttctgacatttctgacatttctgatactcccgacatttctgacatttctgacatttctgacatttctgacatttctgacatttctgacatttctgacatttctgacatttctgacatttctgtactccccgactcggaccgatg

SEQ ID NO: 17014 - DNA, 203 bp, Homo sapiens
ggcgcgccagtcctaggattcgcttctgacatttctgacatttctgacatttctgacatttctgacatttctgacatttctggactttcgttcttgattaatgaaaacattcttggcaaatgctttcgctctggtccgtcttgcgccatttctgacatttctgacatttctgacatttctgacatttccgactcggaccgatg

SEQ ID NO: 17015 - DNA, 203 bp, Homo sapiens
ggcgcgccagtcctctgcttcgcctctgacatttctgacatttctgacatttctgacatttctgacatttctgacatttctgggctccactcctggtggtgcccttccgtcaattcctttaagtttcagctttgcaaccatactcccatttctgacatttctgacatttctgacatttctgacatttccgactcggaccgatg

SEQ ID NO: 17016 - DNA, 203 bp, Homo sapiens
ggcgcgccagtcctatttcgctcgtctgacatttctgacatttctgacatttctgacatttctgacatttctgacatttcttactcccctgacatttctgacatttctgacatttctgacatttctgacatttctgacatttctgacatttctgacatttctgacatttctgacatttcaccggccgtcgactcggaccgatg

SEQ ID NO: 17017 - DNA, 203 bp, Homo sapiens
ggcgcgccagtcctctctttcgcatctgacatttctgacatttctgacatttctgacatttctgacatttctgacatttcttggcaaactgacatttctgacatttctgacatttctgacatttctgacatttctgacatttctgacatttctgacatttctgacatttctgacatttcaccggccgtcgactcggaccgatg

SEQ ID NO: 17018 - DNA, 203 bp, Homo sapiens
ggcgcgccagtcctggtcattcgctctgacatttctgacatttctgacatttctgacatttctgacatttctgacatttcttggcaaactgacatttctgacatttctgacatttctgacatttctgacatttctgacatttctgacatttctgacatttctgacatttctgacatttcccggcgggtcgactcggaccgatg

SEQ ID NO: 17019 - DNA, 203 bp, Homo sapiens
ggcgcgccagtcctggatttcgcttctgacatttctgacatttctgacatttctgacatttctgacatttctgacattttactcccttctgacatttctgacatttctgacatttctgacatttctgacatttctgacatttctgacatttctgacatttctgacatttctgacattttcttggcaaacgactcggaccgatg

SEQ ID NO: 17020 - DNA, 203 bp, Homo sapiens
ggcgcgccagtcctcttcgctagttctgacatttctgacatttctgacatttctgacatttctgacatttctgacattttccgactttcgttcttgattaatgaaaacattcttggcaaatgctttcgctctggtccgtcttgcgccggttctgacatttctgacatttctgacatttctgacatttccgactcggaccgatg

SEQ ID NO: 17021 - DNA, 203 bp, Homo sapiens
ggcgcgccagtcctaatgcaagtgtctgacatttctgacatttctgacatttctgacatttctgacatttctgacatttttcttggcaaagacatttctgacatttctgacatttctgacatttctgacatttctgacatttctgacatttctgacatttctgacatttctgacatttctgtactccccgactcggaccgatg

SEQ ID NO: 17022 - DNA, 203 bp, Homo sapiens
ggcgcgccagtcctttgtcatgggtctgacatttctgacatttctgacatttctgacatttctgacatttctgacatttttcttggcaaagacatttctgacatttctgacatttctgacatttctgacatttctgacatttctgacatttctgacatttctgacatttctgaccgtcaattcctttacgactcggaccgatg

SEQ ID NO: 17023 - DNA, 203 bp, Homo sapiens
ggcgcgccagtcctgtgacgttcttctgacatttctgacatttctgacatttctgacatttctgacatttctgacccggaacccaaagactttggtttcccggaagctgcccggcgggtcatgggaataacgccgccgcatcgccggtcggcagacatttctgacatttctgacatttctgacatttccgactcggaccgatg

SEQ ID NO: 17024 - DNA, 203 bp, Homo sapiens
ggcgcgccagtcctgagcgtaagctctgacatttctgacatttctgacatttctgacatttctgacatttctgaccggcgggtcatttctgacatttctgacatttctgacatttctgacatttctgacatttctgacatttctgacatttctgacatttctgacatttctgacatttctgtactccccgactcggaccgatg

SEQ ID NO: 17025 - DNA, 203 bp, Homo sapiens
ggcgcgccagtcctgctttacgcctctgacatttctgacatttctgacatttctgacatttctgacatttctgaccggcgggtcatttctgacatttctgacatttctgacatttctgacatttctgacatttctgacatttctgacatttctgacatttctgacatttctgaccgtcaattcctttacgactcggaccgatg

SEQ ID NO: 17026 - DNA, 203 bp, Homo sapiens
ggcgcgccagtcctcttacgctcttctgacatttctgacatttctgacatttctgacatttctgacatttctgacgtcaattcctttactgacatttctgacatttctgacatttctgacatttctgacatttctgacatttctgacatttctgacatttctgacatttctgacatttcaccggccgtcgactcggaccgatg

SEQ ID NO: 17027 - DNA, 203 bp, Homo sapiens
ggcgcgccagtccttcttacgccatctgacatttctgacatttctgacatttctgacatttctgacatttctgacgtcaattcctttactgacatttctgacatttctgacatttctgacatttctgacatttctgacatttctgacatttctgacatttctgacatttctgacatttcccggcgggtcgactcggaccgatg

SEQ ID NO: 17028 - DNA, 203 bp, Homo sapiens
ggcgcgccagtcctcccgaaatggtctgacatttctgacatttctgacatttctgacatttctgacatttctgacttccgtcaattcctttaagtttcagctttgcaaccatactccccccggaacccaaagactttggtttcccggaagctgcacatttctgacatttctgacatttctgacatttccgactcggaccgatg

SEQ ID NO: 17029 - DNA, 203 bp, Homo sapiens
ggcgcgccagtcctagaattcgggtctgacatttctgacatttctgacatttctgacatttctgacatttctgacttccgtcaattcctttaagtttcagctttgcaaccatactccccccggaacccaaagactttggtttcccggaagctggacatttctgacatttctgacatttctgacatttccgactcggaccgatg

SEQ ID NO: 17030 - DNA, 203 bp, Homo sapiens
ggcgcgccagtcctaatgacatgatctgacatttctgacatttctgacatttctgacatttctgacatttctgatactcccgacatttctgacatttctgacatttctgacatttctgacatttctgacatttctgacatttctgacatttctgacatttctgacatttctgacatttcccggcgggtcgactcggaccgatg

SEQ ID NO: 17031 - DNA, 203 bp, Homo sapiens
ggcgcgccagtccttgctgtgttctctgacatttctgacatttctgacatttctgacatttctgacatttctgatccaccaactaagaacggccatgcaccaccacccacggaatcgagaaagagctatcaatctgtcaatcctgtccgtgtccacatttctgacatttctgacatttctgacatttccgactcggaccgatg

SEQ ID NO: 17032 - DNA, 203 bp, Homo sapiens
ggcgcgccagtcctctcgtgttggtctgacatttctgacatttctgacatttctgacatttctgacatttctgcgaacctccgactttcgttcttgattaatgaaaacattcttggcaaatgctttcgctctggtccgtcttgcgccggtccaagcatttctgacatttctgacatttctgacatttccgactcggaccgatg

SEQ ID NO: 17033 - DNA, 203 bp, Homo sapiens
ggcgcgccagtcctaacacgatcgtctgacatttctgacatttctgacatttctgacatttctgacatttctgctccaccaactaagaacggccatgcaccaccacccacggaatcgagaaagagctatcaatctgtcaatcctgtccgtgtccggatttctgacatttctgacatttctgacatttccgactcggaccgatg

SEQ ID NO: 17034 - DNA, 203 bp, Homo sapiens
ggcgcgccagtcctagacctaaggtctgacatttctgacatttctgacatttctgacatttctgacatttcttcgaacctccgactttcgttcttgattaatgaaaacattcttggcaaatgctttcgctctggtccgtcttgcgccggtccaagaatttctgacatttctgacatttctgacatttccgactcggaccgatg

SEQ ID NO: 17035 - DNA, 203 bp, Homo sapiens
ggcgcgccagtccttggctgattttctgacatttctgacatttctgacatttctgacatttctgacatttcttggcaaactgacatttctgacatttctgacatttctgacatttctgacatttctgacatttctgacatttcttggcaaactgacatttctgacatttctgacatttctgacatttccgactcggaccgatg

SEQ ID NO: 17036 - DNA, 203 bp, Homo sapiens
ggcgcgccagtccttggcagaccatctgacatttctgacatttctgacatttctgacatttctgacatttcttggcaaactgacatttctgacatttctgacatttctgacatttctgacatttcttggcaaactgacatttcttggcaaactgacatttcttggcaaactgacatttctgacatttccgactcggaccgatg

SEQ ID NO: 17037 - DNA, 203 bp, Homo sapiens
ggcgcgccagtcctctttcagccttctgacatttctgacatttctgacatttctgacatttctgacatttcttggcaaactgacatttctgacatttctgacatttcttggcaaactgacatttctgacatttctgacatttctgacatttctgacatttcttggcaaactgacatttctgacatttccgactcggaccgatg

SEQ ID NO: 17038 - DNA, 203 bp, Homo sapiens
ggcgcgccagtcctacctcagccatctgacatttctgacatttctgacatttctgacatttctgacatttcttggcaaactgacatttctgacatttctgacatttcttggcaaactgacatttctgacatttctgacatttcttggcaaactgacatttcttggcaaactgacatttctgacatttccgactcggaccgatg

SEQ ID NO: 17039 - DNA, 203 bp, Homo sapiens
ggcgcgccagtcctgcactgcacctctgacatttctgacatttctgacatttctgacatttctgacatttcttggcaaactgacatttctgacatttctgacatttcttggcaaactgacatttcttggcaaactgacatttctgacatttctgacatttctgacatttctgacatttctgacatttccgactcggaccgatg

SEQ ID NO: 17040 - DNA, 203 bp, Homo sapiens
ggcgcgccagtcctgtaagtcatgtctgacatttctgacatttctgacatttctgacatttctgacatttcttggcaaactgacatttctgacatttctgacatttcttggcaaactgacatttcttggcaaactgacatttctgacatttctgacatttcttggcaaactgacatttctgacatttccgactcggaccgatg

SEQ ID NO: 17041 - DNA, 203 bp, Homo sapiens
ggcgcgccagtcctagaaccttgctctgacatttctgacatttctgacatttctgacatttctgacatttcttggcaaactgacatttctgacatttctgacatttcttggcaaactgacatttcttggcaaactgacatttcttggcaaactgacatttctgacatttctgacatttctgacatttccgactcggaccgatg

SEQ ID NO: 17042 - DNA, 203 bp, Homo sapiens
ggcgcgccagtcctagaacctgtgtctgacatttctgacatttctgacatttctgacatttctgacatttcttggcaaactgacatttcttggcaaactgacatttctgacatttctgacatttctgacatttctgacatttctgacatttctgacatttctgacatttctgacatttctgacatttccgactcggaccgatg

SEQ ID NO: 17043 - DNA, 203 bp, Homo sapiens
ggcgcgccagtcctgaccgaaacatctgacatttctgacatttctgacatttctgacatttctgacatttcttggcaaactgacatttcttggcaaactgacatttctgacatttctgacatttcttggcaaactgacatttcttggcaaactgacatttctgacatttctgacatttctgacatttccgactcggaccgatg

SEQ ID NO: 17044 - DNA, 203 bp, Homo sapiens
ggcgcgccagtcctgttgatcctttctgacatttctgacatttctgacatttctgacatttctgacatttcttggcaaactgacatttcttggcaaactgacatttctgacatttctgacatttcttggcaaactgacatttcttggcaaactgacatttcttggcaaactgacatttctgacatttccgactcggaccgatg

SEQ ID NO: 17045 - DNA, 203 bp, Homo sapiens
ggcgcgccagtcctaaccgtgtattctgacatttctgacatttctgacatttctgacatttctgacatttcttggcaaactgacatttcttggcaaactgacatttcttggcaaactgacatttctgacatttctgacatttcttggcaaactgacatttctgacatttctgacatttctgacatttccgactcggaccgatg

SEQ ID NO: 17046 - DNA, 203 bp, Homo sapiens
ggcgcgccagtcctcgtgtacccatctgacatttctgacatttctgacatttctgacatttctgacatttcttggcaaactgacatttcttggcaaactgacatttcttggcaaactgacatttctgacatttctgacatttcttggcaaactgacatttcttggcaaactgacatttctgacatttccgactcggaccgatg

SEQ ID NO: 17047 - DNA, 203 bp, Homo sapiens
ggcgcgccagtcctcgtgtatctgtctgacatttctgacatttctgacatttctgacatttctgacatttctttaagccgcaggctccactcctggtggtgcccttccgtcaattcctttaagtttcagctttgcaaccatactccccccggaaccatttctgacatttctgacatttctgacatttccgactcggaccgatg

SEQ ID NO: 17048 - DNA, 203 bp, Homo sapiens
ggcgcgccagtcctgtcaacacgttctgacatttctgacatttctgacatttctgacatttctgacatttctttcttggcaaacatttctgacatttctgacatttctgacatttctgacatttctgacatttctgacatttctgacatttctgacatttctgacatttctgacatttctgtactccccgactcggaccgatg

SEQ ID NO: 17049 - DNA, 203 bp, Homo sapiens
ggcgcgccagtcctagtgttgatctctgacatttctgacatttctgacatttctgacatttctgacatttctttcttggcaaacatttctgacatttctgacatttctgacatttctgacatttctgacatttctgacatttctgacatttctgacatttctgacatttctgaccgtcaattcctttacgactcggaccgatg

SEQ ID NO: 17050 - DNA, 203 bp, Homo sapiens
ggcgcgccagtcctatgctgcttttctgacatttctgacatttctgacatttctgacatttctgacgtggtgcccttccgtcaattcctttaagtttcagctttgcaaccatactccccccggaacccaaagactttggtttcccggaagctgcccggcggggacatttctgacatttctgacatttccgactcggaccgatg

SEQ ID NO: 17051 - DNA, 203 bp, Homo sapiens
ggcgcgccagtccttgagtgcatgtctgacatttctgacatttctgacatttctgacatttctgatactcccgacatttctgacatttctgacatttctgacatttctgacatttctgacatttctgacatttctgacatttctgacatttctgacatttctgacatttctgacattttcttggcaaacgactcggaccgatg

SEQ ID NO: 17052 - DNA, 203 bp, Homo sapiens
ggcgcgccagtcctgctggacttttctgacatttctgacatttctgacatttctgacatttctgattcttggcaaatttctgacatttctgacatttctgacatttctgacatttctgacatttctgacatttctgacatttctgacatttctgacatttctgacatttctgaccgtcaattcctttacgactcggaccgatg

SEQ ID NO: 17053 - DNA, 203 bp, Homo sapiens
ggcgcgccagtcctgggtcccaactctgacatttctgacatttctgacatttctgacatttctgcaaaggaaccataactgatttaatgagccattcgcagtttcactgtaccggccgtgcgtactcagacatgcatggcttaatctttgagacaagcatatgccatttctgacatttctgacatttccgactcggaccgatg

SEQ ID NO: 17054 - DNA, 203 bp, Homo sapiens
ggcgcgccagtccttcccaaccgttctgacatttctgacatttctgacatttctgacatttctttcttggcaaacatttctgacatttctgacatttctgacatttctgacatttctgacatttctgacatttctgacatttctgacatttctgacatttctgacatttctgacatttcaccggccgtcgactcggaccgatg

SEQ ID NO: 17055 - DNA, 203 bp, Homo sapiens
ggcgcgccagtccttcccaggacttctgacatttctgacatttctgacatttctgacatttctttcttggcaaacatttctgacatttctgacatttctgacatttctgacatttctgacatttctgacatttctgacatttctgacatttctgacatttctgacatttctgacatttcccggcgggtcgactcggaccgatg

SEQ ID NO: 17056 - DNA, 203 bp, Homo sapiens
ggcgcgccagtcctcgtcccaacttctgacatttctgacatttctgacatttctgacatttgaccaaaggaaccataactgatttaatgagccattcgcagtttcactgtaccggccgtgcgtactcagacatgcatggcttaatctttgagacaagcatatgctacttctgacatttctgacatttccgactcggaccgatg

SEQ ID NO: 17057 - DNA, 203 bp, Homo sapiens
ggcgcgccagtcctatcccaaggatctgacatttctgacatttctgacatttctgacattttcctggtggtgcccttccgtcaattcctttaagtttcagctttgcaaccatactccccccggaacccaaagactttggtttcccggaagctgcccggcgggtcatgttctgacatttctgacatttccgactcggaccgatg

SEQ ID NO: 17058 - DNA, 203 bp, Homo sapiens
ggcgcgccagtcctttgggacctctctgacatttctgacatttctgacatttctgacgagcgaccaaaggaaccataactgatttaatgagccattcgcagtttcactgtaccggccgtgcgtactcagacatgcatggcttaatctttgagacaagcatatgctactggcgacatttctgacatttccgactcggaccgatg

SEQ ID NO: 17059 - DNA, 203 bp, Homo sapiens
ggcgcgccagtcctacctgggatatctgacatttctgacatttctgacatttctgacggtatctgatcgtcttcgaacctccgactttcgttcttgattaatgaaaacattcttggcaaatgctttcgctctggtccgtcttgcgccggtccaagaatttcacctctagcggccatttctgacatttccgactcggaccgatg

SEQ ID NO: 17060 - DNA, 203 bp, Homo sapiens
ggcgcgccagtcctctcatgggattctgacatttctgacatttctgacatttctgatccactcctggtggtgcccttccgtcaattcctttaagtttcagctttgcaaccatactccccccggaacccaaagactttggtttcccggaagctgcccggcgggtcatgggaatacatttctgacatttccgactcggaccgatg

SEQ ID NO: 17061 - DNA, 203 bp, Homo sapiens
ggcgcgccagtcctgcaacgctgatctgacatttctgacatttctgacatttctgcgtcaattcctttatctgacatttctgacatttctgacatttctgacatttctgacatttctgacatttctgacatttctgacatttctgacatttctgacatttctgacatttctgaccacggaatcgagaacgactcggaccgatg

SEQ ID NO: 17062 - DNA, 203 bp, Homo sapiens
ggcgcgccagtccttgtcgtgagctctgacatttctgacatttctgacatttctgctccactcctggtggtgcccttccgtcaattcctttaagtttcagctttgcaaccatactccccccggaacccaaagactttggtttcccggaagctgcccggcgggtcatgggaataaatttctgacatttccgactcggaccgatg

SEQ ID NO: 17063 - DNA, 203 bp, Homo sapiens
ggcgcgccagtcctacacgacgaatctgacatttctgacatttctgacatttctgtactccctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17064 - DNA, 203 bp, Homo sapiens
ggcgcgccagtccttgcggttgcatctgacatttctgacatttctgacatttcttggcaaactgacatttctgacatttctgacatttctgacatttctgacatttcttggcaaactgacatttctgacatttctgacatttcttggcaaactgacatttcttggcaaactgacatttctgacatttccgactcggaccgatg

SEQ ID NO: 17065 - DNA, 203 bp, Homo sapiens
ggcgcgccagtcctgcggttaggttctgacatttctgacatttctgacatttcttggcaaactgacatttctgacatttctgacatttctgacatttctgacatttcttggcaaactgacatttcttggcaaactgacatttctgacatttctgacatttctgacatttctgacatttctgacatttccgactcggaccgatg

SEQ ID NO: 17066 - DNA, 203 bp, Homo sapiens
ggcgcgccagtcctgcggtttgcctctgacatttctgacatttctgacatttcttggcaaactgacatttctgacatttctgacatttctgacatttctgacatttcttggcaaactgacatttcttggcaaactgacatttcttggcaaactgacatttctgacatttctgacatttctgacatttccgactcggaccgatg

SEQ ID NO: 17067 - DNA, 203 bp, Homo sapiens
ggcgcgccagtcctagttagcggttctgacatttctgacatttctgacatttcttggcaaactgacatttctgacatttctgacatttcttggcaaactgacatttctgacatttctgacatttcttggcaaactgacatttctgacatttctgacatttctgacatttctgacatttctgacatttccgactcggaccgatg

SEQ ID NO: 17068 - DNA, 203 bp, Homo sapiens
ggcgcgccagtccttgagcggtattctgacatttctgacatttctgacatttcttggcaaactgacatttctgacatttctgacatttcttggcaaactgacatttctgacatttctgacatttcttggcaaactgacatttctgacatttctgacatttcttggcaaactgacatttctgacatttccgactcggaccgatg

SEQ ID NO: 17069 - DNA, 203 bp, Homo sapiens
ggcgcgccagtcctctagcggtgctctgacatttctgacatttctgacatttcttggcaaactgacatttctgacatttctgacatttcttggcaaactgacatttctgacatttctgacatttcttggcaaactgacatttcttggcaaactgacatttctgacatttctgacatttctgacatttccgactcggaccgatg

SEQ ID NO: 17070 - DNA, 203 bp, Homo sapiens
ggcgcgccagtcctcagcggtgattctgacatttctgacatttctgacatttcttggcaaactgacatttctgacatttctgacatttcttggcaaactgacatttctgacatttctgacatttcttggcaaactgacatttcttggcaaactgacatttcttggcaaactgacatttctgacatttccgactcggaccgatg

SEQ ID NO: 17071 - DNA, 203 bp, Homo sapiens
ggcgcgccagtcctctgagcggtctctgacatttctgacatttctgacatttcttggcaaactgacatttctgacatttctgacatttcttggcaaactgacatttcttggcaaactgacatttctgacatttctgacatttctgacatttctgacatttcttggcaaactgacatttctgacatttccgactcggaccgatg

SEQ ID NO: 17072 - DNA, 203 bp, Homo sapiens
ggcgcgccagtcctaagcggtacttctgacatttctgacatttctgacatttcttggcaaactgacatttctgacatttctgacatttcttggcaaactgacatttcttggcaaactgacatttctgacatttctgacatttcttggcaaactgacatttctgacatttctgacatttctgacatttccgactcggaccgatg

SEQ ID NO: 17073 - DNA, 203 bp, Homo sapiens
ggcgcgccagtccttagaccgcattctgacatttctgacatttctgacatttcttggcaaactgacatttctgacatttctgacatttcttggcaaactgacatttcttggcaaactgacatttcttggcaaactgacatttcttggcaaactgacatttcttggcaaactgacatttctgacatttccgactcggaccgatg

SEQ ID NO: 17074 - DNA, 203 bp, Homo sapiens
ggcgcgccagtcctggcctaccgctctgacatttctgacatttctgacatttcttggcaaactgacatttcttggcaaactgacatttctgacatttctgacatttctgacatttctgacatttctgacatttctgacatttctgacatttctgacatttctgacatttctgacatttctgacatttccgactcggaccgatg

SEQ ID NO: 17075 - DNA, 203 bp, Homo sapiens
ggcgcgccagtcctaccgcaagattctgacatttctgacatttctgacatttcttggcaaactgacatttcttggcaaactgacatttctgacatttctgacatttctgacatttctgacatttcttggcaaactgacatttctgacatttctgacatttctgacatttctgacatttctgacatttccgactcggaccgatg

SEQ ID NO: 17076 - DNA, 203 bp, Homo sapiens
ggcgcgccagtccttgagaccgcgtctgacatttctgacatttctgacatttcttggcaaactgacatttcttggcaaactgacatttctgacatttctgacatttctgacatttctgacatttcttggcaaactgacatttcttggcaaactgacatttctgacatttctgacatttctgacatttccgactcggaccgatg

SEQ ID NO: 17077 - DNA, 203 bp, Homo sapiens
ggcgcgccagtccttaccgcactgtctgacatttctgacatttctgacatttcttggcaaactgacatttcttggcaaactgacatttctgacatttctgacatttcttggcaaactgacatttctgacatttctgacatttctgacatttctgacatttctgacatttctgacatttctgacatttccgactcggaccgatg

SEQ ID NO: 17078 - DNA, 203 bp, Homo sapiens
ggcgcgccagtcctatcaccgctgtctgacatttctgacatttctgacatttcttggcaaactgacatttcttggcaaactgacatttctgacatttctgacatttcttggcaaactgacatttcttggcaaactgacatttctgacatttctgacatttctgacatttctgacatttctgacatttccgactcggaccgatg

SEQ ID NO: 17079 - DNA, 203 bp, Homo sapiens
ggcgcgccagtcctagtcaccgcgtctgacatttctgacatttctgacatttcttggcaaactgacatttcttggcaaactgacatttctgacatttctgacatttcttggcaaactgacatttcttggcaaactgacatttctgacatttctgacatttcttggcaaactgacatttctgacatttccgactcggaccgatg

SEQ ID NO: 17080 - DNA, 203 bp, Homo sapiens
ggcgcgccagtcctcgaccgcttttctgacatttctgacatttctgacatttcttggcaaactgacatttcttggcaaactgacatttctgacatttctgacatttcttggcaaactgacatttcttggcaaactgacatttcttggcaaactgacatttcttggcaaactgacatttctgacatttccgactcggaccgatg

SEQ ID NO: 17081 - DNA, 203 bp, Homo sapiens
ggcgcgccagtcctgtaccgcacatctgacatttctgacatttctgacatttcttggcaaactgacatttcttggcaaactgacatttcttggcaaactgacatttctgacatttctgacatttcttggcaaactgacatttctgacatttctgacatttcttggcaaactgacatttctgacatttccgactcggaccgatg

SEQ ID NO: 17082 - DNA, 203 bp, Homo sapiens
ggcgcgccagtcctcgaataccgctctgacatttctgacatttctgacatttcttggcaaactgacatttcttggcaaactgacatttcttggcaaactgacatttctgacatttctgacatttcttggcaaactgacatttcttggcaaactgacatttctgacatttctgacatttctgacatttccgactcggaccgatg

SEQ ID NO: 17083 - DNA, 203 bp, Homo sapiens
ggcgcgccagtcctcgcaccttactctgacatttctgacatttctgacatttcttggcaaactgacatttcttggcaaactgacatttcttggcaaactgacatttcttggcaaactgacatttctgacatttctgacatttctgacatttctgacatttcttggcaaactgacatttctgacatttccgactcggaccgatg

SEQ ID NO: 17084 - DNA, 203 bp, Homo sapiens
ggcgcgccagtcctccagaatgactctgacatttctgacatttctgacatttcttggcaaactgacatttcttggcaaactgacatttcttggcaaactgacatttcttggcaaactgacatttcttggcaaactgacatttcttggcaaactgacatttcttggcaaactgacatttctgacatttccgactcggaccgatg

SEQ ID NO: 17085 - DNA, 203 bp, Homo sapiens
ggcgcgccagtccttaaagtctactctgacatttctgacatttctgacattttcttggcaaatgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 17086 - DNA, 203 bp, Homo sapiens
ggcgcgccagtcctgtcaaagtcttctgacatttctgacatttctgacattttcttggcaaatgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 17087 - DNA, 203 bp, Homo sapiens
ggcgcgccagtcctttaagacttctctgacatttctgacatttctgaccacggaatcgagaatgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 17088 - DNA, 203 bp, Homo sapiens
ggcgcgccagtccttgtaagtctctctgacatttctgacatttctgaccggccgtacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17089 - DNA, 203 bp, Homo sapiens
ggcgcgccagtcctaagtctttggtctgacatttctgacatttctgaccggccgtacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 17090 - DNA, 203 bp, Homo sapiens
ggcgcgccagtcctgtagcgtacttctgacatttctgacatttctgactactcccacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 17091 - DNA, 203 bp, Homo sapiens
ggcgcgccagtcctgttagcaatttctgacatttctgacatttctgaggagaggagcgagcgaccaaaggaaccataactgatttaatgagccattcgcagtttcactgtaccggccgtgcgtactcagacatgcatggcttaatctttgagacaagcatatgctactggcaggatcaaccacatttccgactcggaccgatg

SEQ ID NO: 17092 - DNA, 203 bp, Homo sapiens
ggcgcgccagtccttattgaacagtctgacatttctgacatttctgattcttggcaaatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 17093 - DNA, 203 bp, Homo sapiens
ggcgcgccagtcctatgcaatgcatctgacatttctgacatttctgcacggaatcgagaatctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 17094 - DNA, 203 bp, Homo sapiens
ggcgcgccagtcctcaatcatttttctgacatttctgacatttctgccggcgggtacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 17095 - DNA, 203 bp, Homo sapiens
ggcgcgccagtcctgcattgaacttctgacatttctgacatttctgccggcgggtacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17096 - DNA, 203 bp, Homo sapiens
ggcgcgccagtcctattgaaagaatctgacatttctgacatttctgcgtcaattcctttatctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 17097 - DNA, 203 bp, Homo sapiens
ggcgcgccagtcctattgcggtggtctgacatttctgacatttctgcgttatcggaattaaccagacaaatcgctccaccaactaagaacggccatgcaccaccacccacggaatcgagaaagagctatcaatctgtcaatcctgtccgtgtccgggccgggtgaggtttcccgtgttgagtcatttccgactcggaccgatg

SEQ ID NO: 17098 - DNA, 203 bp, Homo sapiens
ggcgcgccagtcctcattgctgcgtctgacatttctgacatttctgtactccctgacatttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 17099 - DNA, 203 bp, Homo sapiens
ggcgcgccagtcctgctcattgactctgacatttctgacatttctgtactccctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17100 - DNA, 203 bp, Homo sapiens
ggcgcgccagtccttgcaatgcactctgacatttctgacatttcttaggagaggagcgagcgaccaaaggaaccataactgatttaatgagccattcgcagtttcactgtaccggccgtgcgtactcagacatgcatggcttaatctttgagacaagcatatgctactggcaggatcaaccagatttccgactcggaccgatg

SEQ ID NO: 17101 - DNA, 203 bp, Homo sapiens
ggcgcgccagtcctaaaaccattgtctgacatttctgacatttcttcttggcaaaacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17102 - DNA, 203 bp, Homo sapiens
ggcgcgccagtcctatcagaattgtctgacatttctgaccacggaatcgagaatgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17103 - DNA, 203 bp, Homo sapiens
ggcgcgccagtccttgcatgcaattctgacatttctgacccggcgggtatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 17104 - DNA, 203 bp, Homo sapiens
ggcgcgccagtcctggtcaattcgtctgacatttctgaccggccgtacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17105 - DNA, 203 bp, Homo sapiens
ggcgcgccagtcctacaatctaagtctgacatttctgactactcccacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17106 - DNA, 203 bp, Homo sapiens
ggcgcgccagtcctccacattgattctgacatttctgcacggaatcgagaatctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 17107 - DNA, 203 bp, Homo sapiens
ggcgcgccagtcctcttcaaattgtctgacatttctgccggcgggtacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17108 - DNA, 203 bp, Homo sapiens
ggcgcgccagtcctgtcaattcagtctgacatttctgtactccctgacatttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 17109 - DNA, 203 bp, Homo sapiens
ggcgcgccagtcctgagcaatcattctgacatttcttcttggcaaaacatttctgacatttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 17110 - DNA, 203 bp, Homo sapiens
ggcgcgccagtcctggctgcaatatctgacatttcttggcaaactgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 17111 - DNA, 203 bp, Homo sapiens
ggcgcgccagtccttcaatggtattctgacatttcttggcaaactgacatttctgacatttctgacatttctgacatttctgacatttctgacatttctgacatttctgacatttctgacatttcttggcaaactgacatttctgacatttctgacatttctgacatttctgacatttctgacatttccgactcggaccgatg

SEQ ID NO: 17112 - DNA, 203 bp, Homo sapiens
ggcgcgccagtcctcaatactacctctgacatttcttggcaaactgacatttctgacatttctgacatttctgacatttctgacatttctgacatttctgacatttctgacatttctgacatttcttggcaaactgacatttcttggcaaactgacatttctgacatttctgacatttctgacatttccgactcggaccgatg

SEQ ID NO: 17113 - DNA, 203 bp, Homo sapiens
ggcgcgccagtccttcgctcaatgtctgacatttcttggcaaactgacatttctgacatttctgacatttctgacatttctgacatttctgacatttctgacatttcttggcaaactgacatttcttggcaaactgacatttcttggcaaactgacatttcttggcaaactgacatttctgacatttccgactcggaccgatg

SEQ ID NO: 17114 - DNA, 203 bp, Homo sapiens
ggcgcgccagtcctttcattgatttctgacatttcttggcaaactgacatttctgacatttctgacatttctgacatttctgacatttcttggcaaactgacatttctgacatttctgacatttctgacatttctgacatttctgacatttctgacatttctgacatttctgacatttctgacatttccgactcggaccgatg

SEQ ID NO: 17115 - DNA, 203 bp, Homo sapiens
ggcgcgccagtcctactgtattgctctgacatttcttggcaaactgacatttctgacatttctgacatttctgacatttctgacatttcttggcaaactgacatttctgacatttctgacatttctgacatttctgacatttcttggcaaactgacatttctgacatttctgacatttctgacatttccgactcggaccgatg

SEQ ID NO: 17116 - DNA, 203 bp, Homo sapiens
ggcgcgccagtcctaaattgagtatctgacatttcttggcaaactgacatttctgacatttctgacatttctgacatttctgacatttcttggcaaactgacatttctgacatttctgacatttcttggcaaactgacatttctgacatttctgacatttcttggcaaactgacatttctgacatttccgactcggaccgatg

SEQ ID NO: 17117 - DNA, 203 bp, Homo sapiens
ggcgcgccagtcctattgcacttgtctgacatttcttggcaaactgacatttctgacatttctgacatttctgacatttctgacatttcttggcaaactgacatttcttggcaaactgacatttctgacatttctgacatttctgacatttctgacatttcttggcaaactgacatttctgacatttccgactcggaccgatg

SEQ ID NO: 17118 - DNA, 203 bp, Homo sapiens
ggcgcgccagtcctcaatcttgattctgacatttcttggcaaactgacatttctgacatttctgacatttctgacatttctgacatttcttggcaaactgacatttcttggcaaactgacatttcttggcaaactgacatttctgacatttctgacatttcttggcaaactgacatttctgacatttccgactcggaccgatg

SEQ ID NO: 17119 - DNA, 203 bp, Homo sapiens
ggcgcgccagtcctcgcaatactctctgacatttcttggcaaactgacatttctgacatttctgacatttctgacatttctgacatttcttggcaaactgacatttcttggcaaactgacatttcttggcaaactgacatttcttggcaaactgacatttctgacatttctgacatttctgacatttccgactcggaccgatg

SEQ ID NO: 17120 - DNA, 203 bp, Homo sapiens
ggcgcgccagtccttcgtgattgctctgacatttcttggcaaactgacatttctgacatttctgacatttcttggcaaactgacatttctgacatttctgacatttctgacatttctgacatttctgacatttctgacatttctgacatttctgacatttcttggcaaactgacatttctgacatttccgactcggaccgatg

SEQ ID NO: 17121 - DNA, 203 bp, Homo sapiens
ggcgcgccagtcctaaacttcaattctgacatttcttggcaaactgacatttctgacatttctgacatttcttggcaaactgacatttctgacatttctgacatttctgacatttctgacatttctgacatttctgacatttcttggcaaactgacatttcttggcaaactgacatttctgacatttccgactcggaccgatg

SEQ ID NO: 17122 - DNA, 203 bp, Homo sapiens
ggcgcgccagtcctcaatggatcctctgacatttcttggcaaactgacatttctgacatttctgacatttcttggcaaactgacatttctgacatttctgacatttctgacatttctgacatttcttggcaaactgacatttctgacatttctgacatttctgacatttctgacatttctgacatttccgactcggaccgatg

SEQ ID NO: 17123 - DNA, 203 bp, Homo sapiens
ggcgcgccagtcctgatcgattgttctgacatttcttggcaaactgacatttctgacatttctgacatttcttggcaaactgacatttctgacatttctgacatttcttggcaaactgacatttctgacatttctgacatttctgacatttctgacatttctgacatttctgacatttctgacatttccgactcggaccgatg

SEQ ID NO: 17124 - DNA, 203 bp, Homo sapiens
ggcgcgccagtcctcgattgcaagtctgacatttcttggcaaactgacatttctgacatttctgacatttcttggcaaactgacatttctgacatttctgacatttcttggcaaactgacatttctgacatttctgacatttctgacatttctgacatttcttggcaaactgacatttctgacatttccgactcggaccgatg

SEQ ID NO: 17125 - DNA, 203 bp, Homo sapiens
ggcgcgccagtcctacattgaggttctgacatttcttggcaaactgacatttctgacatttctgacatttcttggcaaactgacatttctgacatttctgacatttcttggcaaactgacatttctgacatttctgacatttcttggcaaactgacatttctgacatttctgacatttctgacatttccgactcggaccgatg

SEQ ID NO: 17126 - DNA, 203 bp, Homo sapiens
ggcgcgccagtcctttacattgcttctgacatttcttggcaaactgacatttctgacatttctgacatttcttggcaaactgacatttctgacatttctgacatttcttggcaaactgacatttctgacatttctgacatttcttggcaaactgacatttcttggcaaactgacatttctgacatttccgactcggaccgatg

SEQ ID NO: 17127 - DNA, 203 bp, Homo sapiens
ggcgcgccagtcctaattgagatatctgacatttcttggcaaactgacatttctgacatttctgacatttcttggcaaactgacatttcttggcaaactgacatttctgacatttctgacatttctgacatttctgacatttctgacatttctgacatttctgacatttctgacatttctgacatttccgactcggaccgatg

SEQ ID NO: 17128 - DNA, 203 bp, Homo sapiens
ggcgcgccagtcctcttgcaatcatctgacatttcttggcaaactgacatttctgacatttctgacatttcttggcaaactgacatttcttggcaaactgacatttctgacatttctgacatttctgacatttctgacatttctgacatttctgacatttcttggcaaactgacatttctgacatttccgactcggaccgatg

SEQ ID NO: 17129 - DNA, 203 bp, Homo sapiens
ggcgcgccagtcctattgacggtatctgacatttcttggcaaactgacatttctgacatttctgacatttcttggcaaactgacatttcttggcaaactgacatttcttggcaaactgacatttctgacatttctgacatttctgacatttctgacatttctgacatttctgacatttctgacatttccgactcggaccgatg

SEQ ID NO: 17130 - DNA, 203 bp, Homo sapiens
ggcgcgccagtcctgtcaatcgactctgacatttcttggcaaactgacatttctgacatttctgacatttcttggcaaactgacatttcttggcaaactgacatttcttggcaaactgacatttcttggcaaactgacatttctgacatttctgacatttcttggcaaactgacatttctgacatttccgactcggaccgatg

SEQ ID NO: 17131 - DNA, 203 bp, Homo sapiens
ggcgcgccagtcctggtattgccatctgacatttcttggcaaactgacatttctgacatttctgacatttcttggcaaactgacatttcttggcaaactgacatttcttggcaaactgacatttcttggcaaactgacatttcttggcaaactgacatttctgacatttctgacatttctgacatttccgactcggaccgatg

SEQ ID NO: 17132 - DNA, 203 bp, Homo sapiens
ggcgcgccagtcctttacacattgtctgacatttcttggcaaactgacatttctgacatttctgacatttcttggcaaactgacatttcttggcaaactgacatttcttggcaaactgacatttcttggcaaactgacatttcttggcaaactgacatttcttggcaaactgacatttctgacatttccgactcggaccgatg

SEQ ID NO: 17133 - DNA, 203 bp, Homo sapiens
ggcgcgccagtcctcaatacacgatctgacatttcttggcaaactgacatttcttggcaaactgacatttctgacatttctgacatttctgacatttctgacatttctgacatttctgacatttctgacatttctgacatttcttggcaaactgacatttctgacatttctgacatttctgacatttccgactcggaccgatg

SEQ ID NO: 17134 - DNA, 203 bp, Homo sapiens
ggcgcgccagtcctgggtcaattctctgacatttcttggcaaactgacatttcttggcaaactgacatttctgacatttctgacatttctgacatttctgacatttctgacatttctgacatttcttggcaaactgacatttctgacatttctgacatttctgacatttctgacatttctgacatttccgactcggaccgatg

SEQ ID NO: 17135 - DNA, 203 bp, Homo sapiens
ggcgcgccagtcctaacagcaatatctgacatttcttggcaaactgacatttcttggcaaactgacatttctgacatttctgacatttctgacatttctgacatttcttggcaaactgacatttcttggcaaactgacatttctgacatttctgacatttcttggcaaactgacatttctgacatttccgactcggaccgatg

SEQ ID NO: 17136 - DNA, 203 bp, Homo sapiens
ggcgcgccagtcctgctcaattgctctgacatttcttggcaaactgacatttcttggcaaactgacatttctgacatttctgacatttctgacatttctgacatttcttggcaaactgacatttcttggcaaactgacatttcttggcaaactgacatttcttggcaaactgacatttctgacatttccgactcggaccgatg

SEQ ID NO: 17137 - DNA, 203 bp, Homo sapiens
ggcgcgccagtcctgcaatctctttctgacatttcttggcaaactgacatttcttggcaaactgacatttctgacatttctgacatttcttggcaaactgacatttctgacatttctgacatttctgacatttctgacatttctgacatttctgacatttctgacatttctgacatttctgacatttccgactcggaccgatg

SEQ ID NO: 17138 - DNA, 203 bp, Homo sapiens
ggcgcgccagtcctattgaccagttctgacatttcttggcaaactgacatttcttggcaaactgacatttctgacatttctgacatttcttggcaaactgacatttctgacatttctgacatttctgacatttctgacatttctgacatttctgacatttcttggcaaactgacatttctgacatttccgactcggaccgatg

SEQ ID NO: 17139 - DNA, 203 bp, Homo sapiens
ggcgcgccagtcctcaatcgttgctctgacatttcttggcaaactgacatttcttggcaaactgacatttctgacatttctgacatttcttggcaaactgacatttctgacatttctgacatttctgacatttctgacatttcttggcaaactgacatttcttggcaaactgacatttctgacatttccgactcggaccgatg

SEQ ID NO: 17140 - DNA, 203 bp, Homo sapiens
ggcgcgccagtcctctcattgaactctgacatttcttggcaaactgacatttcttggcaaactgacatttctgacatttctgacatttcttggcaaactgacatttctgacatttctgacatttcttggcaaactgacatttctgacatttctgacatttctgacatttctgacatttctgacatttccgactcggaccgatg

SEQ ID NO: 17141 - DNA, 203 bp, Homo sapiens
ggcgcgccagtcctacaagattgatctgacatttcttggcaaactgacatttcttggcaaactgacatttctgacatttctgacatttcttggcaaactgacatttcttggcaaactgacatttcttggcaaactgacatttctgacatttctgacatttctgacatttctgacatttctgacatttccgactcggaccgatg

SEQ ID NO: 17142 - DNA, 203 bp, Homo sapiens
ggcgcgccagtcctaacaatctgatctgacatttcttggcaaactgacatttcttggcaaactgacatttctgacatttctgacatttcttggcaaactgacatttcttggcaaactgacatttcttggcaaactgacatttcttggcaaactgacatttctgacatttctgacatttctgacatttccgactcggaccgatg

SEQ ID NO: 17143 - DNA, 203 bp, Homo sapiens
ggcgcgccagtccttatgtcattgtctgacatttcttggcaaactgacatttcttggcaaactgacatttctgacatttctgacatttcttggcaaactgacatttcttggcaaactgacatttcttggcaaactgacatttcttggcaaactgacatttcttggcaaactgacatttctgacatttccgactcggaccgatg

SEQ ID NO: 17144 - DNA, 203 bp, Homo sapiens
ggcgcgccagtcctttcgtaaccctctgacatttcttggcaaactgacatttcttggcaaactgacatttcttggcaaactgacatttctgacatttctgacatttcttggcaaactgacatttctgacatttctgacatttctgacatttctgacatttcttggcaaactgacatttctgacatttccgactcggaccgatg

SEQ ID NO: 17145 - DNA, 203 bp, Homo sapiens
ggcgcgccagtcctgggtcgtaaatctgacatttcttggcaaactgacatttcttggcaaactgacatttcttggcaaactgacatttctgacatttctgacatttcttggcaaactgacatttcttggcaaactgacatttctgacatttctgacatttctgacatttctgacatttctgacatttccgactcggaccgatg

SEQ ID NO: 17146 - DNA, 203 bp, Homo sapiens
ggcgcgccagtccttcttacgaagtctgacatttcttggcaaactgacatttcttggcaaactgacatttcttggcaaactgacatttctgacatttctgacatttcttggcaaactgacatttcttggcaaactgacatttctgacatttctgacatttcttggcaaactgacatttctgacatttccgactcggaccgatg

SEQ ID NO: 17147 - DNA, 203 bp, Homo sapiens
ggcgcgccagtcctgttacgagcatctgacatttcttggcaaactgacatttcttggcaaactgacatttcttggcaaactgacatttctgacatttctgacatttcttggcaaactgacatttcttggcaaactgacatttcttggcaaactgacatttctgacatttctgacatttctgacatttccgactcggaccgatg

SEQ ID NO: 17148 - DNA, 203 bp, Homo sapiens
ggcgcgccagtcctcactttacgatctgacatttcttggcaaactgacatttcttggcaaactgacatttcttggcaaactgacatttcttggcaaactgacatttctgacatttctgacatttcttggcaaactgacatttcttggcaaactgacatttctgacatttctgacatttctgacatttccgactcggaccgatg

SEQ ID NO: 17149 - DNA, 203 bp, Homo sapiens
ggcgcgccagtcctcccatgcagatctgacatttcttggcaaactgacatttcttggcaaactgacatttcttggcaaactgacatttcttggcaaactgacatttcttggcaaactgacatttctgacatttctgacatttctgacatttctgacatttctgacatttctgacatttctgacatttccgactcggaccgatg

SEQ ID NO: 17150 - DNA, 203 bp, Homo sapiens
ggcgcgccagtcctaagatcaaggtctgacatttcttggcaaactgacatttcttggcaaactgacatttcttggcaaactgacatttcttggcaaactgacatttcttggcaaactgacatttctgacatttctgacatttctgacatttctgacatttcttggcaaactgacatttctgacatttccgactcggaccgatg

SEQ ID NO: 17151 - DNA, 203 bp, Homo sapiens
ggcgcgccagtcctaaatcgacgttctgacatttcttggcaaactgacatttcttggcaaactgacatttcttggcaaactgacatttcttggcaaactgacatttcttggcaaactgacatttctgacatttctgacatttcttggcaaactgacatttctgacatttctgacatttctgacatttccgactcggaccgatg

SEQ ID NO: 17152 - DNA, 203 bp, Homo sapiens
ggcgcgccagtcctacgtcgactctctgacatttcttggcaaactgacatttcttggcaaactgacatttcttggcaaactgacatttcttggcaaactgacatttcttggcaaactgacatttcttggcaaactgacatttcttggcaaactgacatttctgacatttctgacatttctgacatttccgactcggaccgatg

SEQ ID NO: 17153 - DNA, 203 bp, Homo sapiens
ggcgcgccagtccttcgtcgattttctgacatttcttggcaaactgacatttcttggcaaactgacatttcttggcaaactgacatttcttggcaaactgacatttcttggcaaactgacatttcttggcaaactgacatttcttggcaaactgacatttcttggcaaactgacatttcttggcaaaccgactcggaccgatg

SEQ ID NO: 17154 - DNA, 203 bp, Homo sapiens
ggcgcgccagtcctactaccgccttctgacattttactcccttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 17155 - DNA, 203 bp, Homo sapiens
ggcgcgccagtcctttgctttgattctgaccgtcaattcctttatgacatttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 17156 - DNA, 203 bp, Homo sapiens
ggcgcgccagtccttcatgtcgagtctgttcttggcaaaatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17157 - DNA, 203 bp, Homo sapiens
ggcgcgccagtcctctgtcgaccctcttactcccctgacatttctgacatttctgacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17158 - DNA, 203 bp, Homo sapiens
ggcgcgccagtcctagtatgtcgatgtgtaaacacggaatcgagaattcacacggaatcgagaaggaacacggaatcgagaactgccacggaatcgagaagcagcacggaatcgagaaggttcacggaatcgagaaaggccacggaatcgagaatagtcacggaatcgagaatctcttttttggcatccgactcggaccgatg

SEQ ID NO: 17159 - DNA, 203 bp, Homo sapiens
ggcgcgccagtccttactcagccctgtgtaaagatgcagtgtaaggttcaagtgccaaatccctggaacacggaatcgagaactgccacggaatcgagaagcagcacggaatcgagaaggttcacggaatcgagaaaggccacggaatcgagaatagtcacggaatcgagaatctcttttttggcatccgactcggaccgatg

SEQ ID NO: 17160 - DNA, 203 bp, Homo sapiens
ggcgcgccagtcctacagcagccctgtgtaaagatgcagtgtaaggttcaagtgccaaatccctggaaccggcgggtctctactgcccggcgggtgctgtgcagccggcgggtacttcggttccggcgggtagcacaggcccggcgggtacgggtagtccggcgggtcatcctctcccggcgggtatccgactcggaccgatg

SEQ ID NO: 17161 - DNA, 203 bp, Homo sapiens
ggcgcgccagtcctgtcgcagccctgtgtaaagatgcagtgtaaggttcaagtgccaaatccctggaaggagtgaccctctactgcaccggccgtgctgtgcagaccggccgtacttcggttaccggccgtagcacaggcaccggccgtacgggtagtaccggccgtcatcctctcaccggccgtatccgactcggaccgatg

SEQ ID NO: 17162 - DNA, 203 bp, Homo sapiens
ggcgcgccagtcctgacaaggccctgtgtaaagatgcagtgtaaggttcaagtgccaaatccctggaaggagtgaccctctactgccacggaatcgagaagcagcacggaatcgagaaggttcacggaatcgagaaaggccacggaatcgagaatagtcacggaatcgagaatctcttttttggcatccgactcggaccgatg

SEQ ID NO: 17163 - DNA, 203 bp, Homo sapiens
ggcgcgccagtcctggttacgccctgtgtaaagatgcagtgtaaggttcaagtgccaaatccctggaaggagtgaccctctactgccctaggaatgctgtgcagaccggccgtacttcggttaccggccgtagcacaggcaccggccgtacgggtagtaccggccgtcatcctctcaccggccgtatccgactcggaccgatg

SEQ ID NO: 17164 - DNA, 203 bp, Homo sapiens
ggcgcgccagtcctgggcctggtctgtgtaaagatgcagtgtaaggttcaagtgccaaatccctggaaggagtgaccctctactgccctaggaatgctgtgcaggtacccccaacttcggttcacggaatcgagaaaggccacggaatcgagaatagtcacggaatcgagaatctcttttttggcatccgactcggaccgatg

SEQ ID NO: 17165 - DNA, 203 bp, Homo sapiens
ggcgcgccagtcctgggctcagcatgtgtaaagatgcagtgtaaggttcaagtgccaaatccctggaaggagtgaccctctactgccctaggaatgctgtgcaggtacccccaacttcggttccggcgggtagcacaggcccggcgggtacgggtagtccggcgggtcatcctctcccggcgggtatccgactcggaccgatg

SEQ ID NO: 17166 - DNA, 203 bp, Homo sapiens
ggcgcgccagtcctgggctacgtctgtgtaaagatgcagtgtaaggttcaagtgccaaatccctggaaggagtgaccctctactgccctaggaatgctgtgcaggtacccccaacttcggttggggatctgagcacaggccacggaatcgagaatagtcacggaatcgagaatctcttttttggcatccgactcggaccgatg

SEQ ID NO: 17167 - DNA, 203 bp, Homo sapiens
ggcgcgccagtcctgggctaggcttgtgtaaagatgcagtgtaaggttcaagtgccaaatccctggaaggagtgaccctctactgccctaggaatgctgtgcaggtacccccaacttcggttggggatctgagcacaggccgtcaattcctttatagtcgtcaattcctttatctcttttttggcatccgactcggaccgatg

SEQ ID NO: 17168 - DNA, 203 bp, Homo sapiens
ggcgcgccagtcctccacgttaagtgtgtaaagatgcagtgtaaggttcaagtgccaaatccctggaaggagtgaccctctactgccctaggaatgctgtgcaggtacccccaacttcggttggggatctgagcacaggctaattgtctacgggtagtcacggaatcgagaatctcttttttggcatccgactcggaccgatg

SEQ ID NO: 17169 - DNA, 203 bp, Homo sapiens
ggcgcgccagtcctaccacgttgttgtgtaaagatgcagtgtaaggttcaagtgccaaatccctggaaggagtgaccctctactgccctaggaatgctgtgcaggtacccccaacttcggttggggatctgagcacaggctaattgtctacgggtagtccggcgggtcatcctctcccggcgggtatccgactcggaccgatg

SEQ ID NO: 17170 - DNA, 203 bp, Homo sapiens
ggcgcgccagtccttccagtttcatgtgtaaagatgcagtgtaaggttcaagtgccaaatccctggaaggagtgaccctctactgccctaggaatgctgtgcaggtacccccaacttcggttggggatctgagcacaggctaattgtctacgggtagtcgtcaattcctttatctcttttttggcatccgactcggaccgatg

SEQ ID NO: 17171 - DNA, 203 bp, Homo sapiens
ggcgcgccagtccttgaaactttgtgtgtaaagatgcagtgtaaggttcaagtgccaaatccctggaaggagtgaccctctactgccctaggaatgctgtgcaggtacccccaacttcggttggggatctgagcacaggctaattgtctacgggtagttactccccccatcctctctactcccgcatccgactcggaccgatg

SEQ ID NO: 17172 - DNA, 203 bp, Homo sapiens
ggcgcgccagtcctcattgaaacttgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcaccggccgtatccgactcggaccgatg

SEQ ID NO: 17173 - DNA, 203 bp, Homo sapiens
ggcgcgccagtcctctgaaactcttgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcccggcgggtatccgactcggaccgatg

SEQ ID NO: 17174 - DNA, 203 bp, Homo sapiens
ggcgcgccagtccttgaaatgacatgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctctactcccgcatccgactcggaccgatg

SEQ ID NO: 17175 - DNA, 203 bp, Homo sapiens
ggcgcgccagtcctagcctgcacgtgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcttcttggcaaaccgactcggaccgatg

SEQ ID NO: 17176 - DNA, 203 bp, Homo sapiens
ggcgcgccagtcctatccacgaagtgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcttttttggcatccgactcggaccgatg

SEQ ID NO: 17177 - DNA, 203 bp, Homo sapiens
ggcgcgccagtcctagttcacgaatgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcttggcaaatcctctcttcttggcaaaccgactcggaccgatg

SEQ ID NO: 17178 - DNA, 203 bp, Homo sapiens
ggcgcgccagtccttagttcgtgatgtgtaaagatgcagtgtaaggttcaagtgccaaatccctggaaggagtgaccctctactgccctaggaatgctgtgcaggtacccccaacttcggttggggatctgagcacaggctactcccctacgggtagttactccccccatcctctctactcccgcatccgactcggaccgatg

SEQ ID NO: 17179 - DNA, 203 bp, Homo sapiens
ggcgcgccagtccttattcgtggatgtgtaaagatgcagtgtaaggttcaagtgccaaatccctggaaggagtgaccctctactgccctaggaatgctgtgcaggtacccccaacttcggttggggatctgagcacaggcttcttggcaaagggtagtttcttggcaaatcctctcttcttggcaaaccgactcggaccgatg

SEQ ID NO: 17180 - DNA, 203 bp, Homo sapiens
ggcgcgccagtccttccacgaagatgtgtaaagatgcagtgtaaggttcaagtgccaaatccctggaaggagtgaccctctactgccctaggaatgctgtgcaggtacccccaacttcggtttactccctgagcacaggctactcccctacgggtagttactccccccatcctctctactcccgcatccgactcggaccgatg

SEQ ID NO: 17181 - DNA, 203 bp, Homo sapiens
ggcgcgccagtcctcattcgtgcttgtgtaaagatgcagtgtaaggttcaagtgccaaatccctggaaggagtgaccctctactgccgtcaattcctttagcagcgtcaattcctttaggttcgtcaattcctttaaggccgtcaattcctttatagtcgtcaattcctttatctcttttttggcatccgactcggaccgatg

SEQ ID NO: 17182 - DNA, 203 bp, Homo sapiens
ggcgcgccagtccttggcactaactgtgtaaagatgcagtgtaaggttcacacggaatcgagaaggaacacggaatcgagaactgccacggaatcgagaagcagcacggaatcgagaaggttcacggaatcgagaaaggccacggaatcgagaatagtcacggaatcgagaatctcttttttggcatccgactcggaccgatg

SEQ ID NO: 17183 - DNA, 203 bp, Homo sapiens
ggcgcgccagtcctacgcaccagatgtgtaaagatgcagtgtaaggttcatactcccaatccctggaatactcccccctctactgctactcccatgctgtgcagtactccccaacttcggtttactccctgagcacaggctactcccctacgggtagttactccccccatcctctctactcccgcatccgactcggaccgatg

SEQ ID NO: 17184 - DNA, 203 bp, Homo sapiens
ggcgcgccagtcctacgcactgcgtgtgtaaagatgcagtgtaaggttcattcttggcaaacctggaattcttggcaaactactgcttcttggcaaatgtgcagttcttggcaaattcggttttcttggcaaacacaggcttcttggcaaagggtagtttcttggcaaatcctctcttcttggcaaaccgactcggaccgatg

SEQ ID NO: 17185 - DNA, 203 bp, Homo sapiens
ggcgcgccagtcctaacgcactagtgtgtaaatactccctgtaaggttcatactcccaatccctggaatactcccccctctactgctactcccatgctgtgcagtactccccaacttcggtttactccctgagcacaggctactcccctacgggtagttactccccccatcctctctactcccgcatccgactcggaccgatg

SEQ ID NO: 17186 - DNA, 203 bp, Homo sapiens
ggcgcgccagtcctcttgttacacttacttcaaccggccgtcaggtcaaaaccggccgtggcgcacctaccggccgtctgacacataccggccgtgcaccagcaaccggccgtacgctgacaaccggccgtagcgacttgaccggccgtaatttggctaccggccgtgagagccccaccggccgtagacgactcggaccgatg

SEQ ID NO: 17187 - DNA, 203 bp, Homo sapiens
ggcgcgccagtcctttcatacgctttacttcacactcagtccaggtcaaacgtcaattcctttaacctcgtcaattcctttaacatcgtcaattcctttaagcacgtcaattcctttagacacgtcaattcctttacttgcgtcaattcctttaggctcgtcaattcctttaccccgacaactgaagacgactcggaccgatg

SEQ ID NO: 17188 - DNA, 203 bp, Homo sapiens
ggcgcgccagtccttacgtcaggtttacttcacactcagtccaggtcaaaggtaaatcaggcgcacctcgtcaattcctttaacatcgtcaattcctttaagcacgtcaattcctttagacacgtcaattcctttacttgcgtcaattcctttaggctcgtcaattcctttaccccgacaactgaagacgactcggaccgatg

SEQ ID NO: 17189 - DNA, 203 bp, Homo sapiens
ggcgcgccagtcctacagtacgggttacttcacactcagtccaggtcaaaggtaaatcaggcgcaccttactcccacctgacacattactccccagcaccagcatactcccgaacgctgacatactcccgaagcgacttgtactcccccaatttggcttactcccctgagagcccctactcccgaagacgactcggaccgatg

SEQ ID NO: 17190 - DNA, 203 bp, Homo sapiens
ggcgcgccagtccttgttaacgggttacttcacactcagtccaggtcaaaggtaaatcaggcgcaccttggcaccacctgacacatccggcgggtgcaccagcaccggcgggtacgctgacaccggcgggtagcgacttgccggcgggtaatttggctccggcgggtgagagccccccggcgggtagacgactcggaccgatg

SEQ ID NO: 17191 - DNA, 203 bp, Homo sapiens
ggcgcgccagtcctagtcgacgggttacttcacactcagtccaggtcaaaggtaaatcaggcgcaccttggcaccacctgacacattgtacaccagcaccagcacacggaatcgagaagacacacggaatcgagaacttgcacggaatcgagaaggctcacggaatcgagaaccccgacaactgaagacgactcggaccgatg

SEQ ID NO: 17192 - DNA, 203 bp, Homo sapiens
ggcgcgccagtcctcccgtagctgttacttcacactcagtccaggtcaaaggtaaatcaggcgcaccttggcaccacctgacacattgtacaccagcaccagcaccggcgggtacgctgacaccggcgggtagcgacttgccggcgggtaatttggctccggcgggtgagagccccccggcgggtagacgactcggaccgatg

SEQ ID NO: 17193 - DNA, 203 bp, Homo sapiens
ggcgcgccagtcctcgtgcacgggttacttcacactcagtccaggtcaaaggtaaatcaggcgcaccttggcaccacctgacacattgtacaccagcaccagcacctgacagaacgctgacaaccggccgtagcgacttgaccggccgtaatttggctaccggccgtgagagccccaccggccgtagacgactcggaccgatg

SEQ ID NO: 17194 - DNA, 203 bp, Homo sapiens
ggcgcgccagtcctgcctttagaattacttcacactcagtccaggtcaaaggtaaatcaggcgcaccttggcaccacctgacacattgtacaccagcaccagcacctgacagaacgctgacagaagtcagaagcgacttgatcgcctccaatttggctaccggccgtgagagccccaccggccgtagacgactcggaccgatg

SEQ ID NO: 17195 - DNA, 203 bp, Homo sapiens
ggcgcgccagtcctcttctaactcttacttcacactcagtccaggtcaaaggtaaatcaggcgcaccttggcaccacctgacacattgtacaccagcaccagcacctgacagaacgctgacagaagtcagaagcgacttgatcgcctccaatttggctccggcgggtgagagccccccggcgggtagacgactcggaccgatg

SEQ ID NO: 17196 - DNA, 203 bp, Homo sapiens
ggcgcgccagtcctatacttctaattacttcacactcagtccaggtcaaaggtaaatcaggcgcaccttggcaccacctgacacattgtacaccagcaccagcacctgacagaacgctgacagaagtcagaagcgacttgatcgcctccaatttggcttactcccctgagagcccctactcccgaagacgactcggaccgatg

SEQ ID NO: 17197 - DNA, 203 bp, Homo sapiens
ggcgcgccagtcctttagaaggccttacttcacactcagtccaggtcaaaggtaaatcaggcgcaccttggcaccacctgacacattgtacaccagcaccagcacctgacagaacgctgacagaagtcagaagcgacttgatcgcctccaatttggctttcttggcaaagagccccttcttggcaaaacgactcggaccgatg

SEQ ID NO: 17198 - DNA, 203 bp, Homo sapiens
ggcgcgccagtcctctggtgtgtattacttcacactcagtccaggtcaaaggtaaatcaggcgcaccttggcaccacctgacacattgtacaccagcaccagcacctgacagaacgctgacattcttggcaaacgacttgttcttggcaaatttggctttcttggcaaagagccccttcttggcaaaacgactcggaccgatg

SEQ ID NO: 17199 - DNA, 203 bp, Homo sapiens
ggcgcgccagtcctagtgtgtacgttacttcacactcagtccaggtcaaaggtaaatcaggcgcaccttggcaccacctgacacattgtacaccagcaccagcacgtcaattcctttagacacgtcaattcctttacttgcgtcaattcctttaggctcgtcaattcctttaccccgacaactgaagacgactcggaccgatg

SEQ ID NO: 17200 - DNA, 203 bp, Homo sapiens
ggcgcgccagtcctccacgacgtgttacttcacactcagtccaggtcaaatactccccaggcgcaccttactcccacctgacacattactccccagcaccagcatactcccgaacgctgacatactcccgaagcgacttgtactcccccaatttggcttactcccctgagagcccctactcccgaagacgactcggaccgatg

SEQ ID NO: 17201 - DNA, 203 bp, Homo sapiens
ggcgcgccagtcctaaacaaggccttacttcacgtcaattcctttacaaacgtcaattcctttaacctcgtcaattcctttaacatcgtcaattcctttaagcacgtcaattcctttagacacgtcaattcctttacttgcgtcaattcctttaggctcgtcaattcctttaccccgacaactgaagacgactcggaccgatg

SEQ ID NO: 17202 - DNA, 20 bp, Unknown
  RNA secondary structure sequence
cgggtggagcccattgacgt

SEQ ID NO: 17203 - DNA, 20 bp, Unknown
  RNA secondary structure sequence
cttcactctcctgtaaaacg

SEQ ID NO: 17204 - DNA, 20 bp, Unknown
  RNA secondary structure sequence
gacaccaccatgaccggctc

SEQ ID NO: 17205 - DNA, 20 bp, Unknown
  RNA secondary structure sequence
gagagcgactttcaaactcg

SEQ ID NO: 17206 - DNA, 20 bp, Unknown
  RNA secondary structure sequence
cccgcgtgtgtgcgcctaat

SEQ ID NO: 17207 - DNA, 20 bp, Unknown
  RNA secondary structure sequence
ggctgaaggccgactgtgat

SEQ ID NO: 17208 - DNA, 20 bp, Unknown
  RNA secondary structure sequence
attggttggcggacggtgcg

SEQ ID NO: 17209 - DNA, 20 bp, Unknown
  RNA secondary structure sequence
cctccttcgccccggggccc

SEQ ID NO: 17210 - DNA, 20 bp, Unknown
  RNA secondary structure sequence
taagtgtttccggtggattc

SEQ ID NO: 17211 - DNA, 20 bp, Unknown
  RNA secondary structure sequence
aaccttgccgtgctggaatt

SEQ ID NO: 17212 - DNA, 20 bp, Unknown
  RNA secondary structure sequence
ctggcgtcacccctctgctc

SEQ ID NO: 17213 - DNA, 20 bp, Unknown
  RNA secondary structure sequence
cggctgaaggaggccccagg

SEQ ID NO: 17214 - DNA, 20 bp, Unknown
  RNA secondary structure sequence
catgttgagggggggaccgc

SEQ ID NO: 17215 - DNA, 20 bp, Unknown
  RNA secondary structure sequence
cttgaaactgcggctcggga

SEQ ID NO: 17216 - DNA, 20 bp, Unknown
  RNA secondary structure sequence
gcgcgctcgcatccccaaga

SEQ ID NO: 17217 - DNA, 20 bp, Unknown
  RNA secondary structure sequence
cctacggaggtggcagccat

SEQ ID NO: 17218 - DNA, 20 bp, Unknown
  RNA secondary structure sequence
ctggatggagcctttctctg

SEQ ID NO: 17219 - DNA, 20 bp, Unknown
  RNA secondary structure sequence
agattgtgggcggctgtgtc

SEQ ID NO: 17220 - DNA, 20 bp, Unknown
  RNA secondary structure sequence
tctgactccacatccagtcc

SEQ ID NO: 17221 - DNA, 20 bp, Unknown
  RNA secondary structure sequence
gtctcctgcgctcctgctgg

SEQ ID NO: 17222 - DNA, 20 bp, Unknown
  RNA secondary structure sequence
ctcatccgggttcccgggac

SEQ ID NO: 17223 - DNA, 20 bp, Unknown
  RNA secondary structure sequence
cctcacactcggtgcccgga

SEQ ID NO: 17224 - DNA, 20 bp, Unknown
  RNA secondary structure sequence
gcccgctgccctttgcctcc

SEQ ID NO: 17225 - DNA, 20 bp, Unknown
  RNA secondary structure sequence
aggggctgtgggcgcgcagc

SEQ ID NO: 17226 - DNA, 20 bp, Unknown
  RNA secondary structure sequence
acgctcccgggtcacgtgac

SEQ ID NO: 17227 - DNA, 20 bp, Unknown
  RNA secondary structure sequence
catgtacagtcctccccagt

SEQ ID NO: 17228 - DNA, 20 bp, Unknown
  RNA secondary structure sequence
aggcggcggcgcgaggcagt

SEQ ID NO: 17229 - DNA, 20 bp, Unknown
  RNA secondary structure sequence
aagcgatcccctcgccccag

SEQ ID NO: 17230 - DNA, 20 bp, Unknown
  RNA secondary structure sequence
ggacttggaacacctgtaac

SEQ ID NO: 17231 - DNA, 20 bp, Unknown
  RNA secondary structure sequence
cagaaggcgcagccatgaat

SEQ ID NO: 17232 - DNA, 20 bp, Unknown
  RNA secondary structure sequence
cagggcaggggtcctccgcc

SEQ ID NO: 17233 - DNA, 20 bp, Unknown
  RNA secondary structure sequence
cgagtgtggccaagggtgcc

SEQ ID NO: 17234 - DNA, 20 bp, Unknown
  RNA secondary structure sequence
tctggacccatccagctgag

SEQ ID NO: 17235 - DNA, 20 bp, Unknown
  RNA secondary structure sequence
ggcggcgccaccctccgggg

SEQ ID NO: 17236 - DNA, 20 bp, Unknown
  RNA secondary structure sequence
cggaggccaggagctcaacc

SEQ ID NO: 17237 - DNA, 20 bp, Unknown
  RNA secondary structure sequence
cggtcacctgtctccggtgg

SEQ ID NO: 17238 - DNA, 20 bp, Unknown
  RNA secondary structure sequence
gcttcgagcagggcatcgga

SEQ ID NO: 17239 - DNA, 20 bp, Unknown
  RNA secondary structure sequence
aagttgcacggtgaattggc

SEQ ID NO: 17240 - DNA, 20 bp, Unknown
  RNA secondary structure sequence
gtgcaggagtcctggggcat

SEQ ID NO: 17241 - DNA, 20 bp, Unknown
  RNA secondary structure sequence
cagttatcattagtctgcaa

SEQ ID NO: 17242 - DNA, 20 bp, Unknown
  RNA secondary structure sequence
agcgaaaagtattaaacaaa

SEQ ID NO: 17243 - DNA, 20 bp, Unknown
  RNA secondary structure sequence
ctgcctgctcccccgcccca

SEQ ID NO: 17244 - DNA, 20 bp, Unknown
  RNA secondary structure sequence
cagcgctgcgtcggcagtac

SEQ ID NO: 17245 - DNA, 20 bp, Unknown
  RNA secondary structure sequence
ccagctccttgcccagacca

SEQ ID NO: 17246 - DNA, 20 bp, Unknown
  RNA secondary structure sequence
gcatcttcttgcagattcca

SEQ ID NO: 17247 - DNA, 20 bp, Unknown
  RNA secondary structure sequence
gccagcccttttcccgaccc

SEQ ID NO: 17248 - DNA, 20 bp, Unknown
  RNA secondary structure sequence
ccaaccatggtgaacttggg

SEQ ID NO: 17249 - DNA, 20 bp, Unknown
  RNA secondary structure sequence
cccggacggcctcaccatga

SEQ ID NO: 17250 - DNA, 20 bp, Unknown
  RNA secondary structure sequence
aggctagaggctgcgcaagc

SEQ ID NO: 17251 - DNA, 20 bp, Unknown
  RNA secondary structure sequence
ccttgcgcaccaggaagtga

SEQ ID NO: 17252 - DNA, 20 bp, Unknown
  RNA secondary structure sequence
tcaccgtgttagccaagatg

SEQ ID NO: 17253 - DNA, 20 bp, Unknown
  RNA secondary structure sequence
tgtctggccttttgtccttg

SEQ ID NO: 17254 - DNA, 20 bp, Unknown
  RNA secondary structure sequence
cacacaccaccttacccctc

SEQ ID NO: 17255 - DNA, 20 bp, Unknown
  RNA secondary structure sequence
ccgcgttggctgggtggcct

SEQ ID NO: 17256 - DNA, 20 bp, Unknown
  RNA secondary structure sequence
aggtaacttccagggtgcgc

SEQ ID NO: 17257 - DNA, 20 bp, Unknown
  RNA secondary structure sequence
tctaagccgggcgcctcacc

SEQ ID NO: 17258 - DNA, 20 bp, Unknown
  RNA secondary structure sequence
tcggttggcgcgcaacgggt

SEQ ID NO: 17259 - DNA, 20 bp, Unknown
  RNA secondary structure sequence
tggcccgagagggatcccgg

SEQ ID NO: 17260 - DNA, 20 bp, Unknown
  RNA secondary structure sequence
cagccagggcagcgccagca

SEQ ID NO: 17261 - DNA, 20 bp, Unknown
  RNA secondary structure sequence
gctgctgcggttacctggat

SEQ ID NO: 17262 - DNA, 20 bp, Unknown
  RNA secondary structure sequence
ggcaagcggcgggaggggaa

SEQ ID NO: 17263 - DNA, 20 bp, Unknown
  RNA secondary structure sequence
aaggagaactacattcctca

SEQ ID NO: 17264 - DNA, 20 bp, Unknown
  RNA secondary structure sequence
ctggtgccacagcagctgag

SEQ ID NO: 17265 - DNA, 20 bp, Unknown
  RNA secondary structure sequence
ctggcagcggcgaggacccg

SEQ ID NO: 17266 - DNA, 20 bp, Unknown
  RNA secondary structure sequence
accgggtacccgggctatgg

SEQ ID NO: 17267 - DNA, 20 bp, Unknown
  RNA secondary structure sequence
aacagactccggcccactcc

SEQ ID NO: 17268 - DNA, 20 bp, Unknown
  RNA secondary structure sequence
agttcggggaagctgtacgc

SEQ ID NO: 17269 - DNA, 20 bp, Unknown
  RNA secondary structure sequence
cctttgctttcagccggact

SEQ ID NO: 17270 - DNA, 20 bp, Unknown
  RNA secondary structure sequence
caagatggcggcgcccgagg

SEQ ID NO: 17271 - DNA, 20 bp, Unknown
  RNA secondary structure sequence
gaggctctgtacctgcagtg

SEQ ID NO: 17272 - DNA, 20 bp, Unknown
  RNA secondary structure sequence
taaacaaggggcatccaaat

SEQ ID NO: 17273 - DNA, 20 bp, Unknown
  RNA secondary structure sequence
catcagtcttaccgaagcca

SEQ ID NO: 17274 - DNA, 20 bp, Unknown
  RNA secondary structure sequence
ggaagatggaactcattgtc

SEQ ID NO: 17275 - DNA, 20 bp, Unknown
  RNA secondary structure sequence
atccattttaatctgcgggg

SEQ ID NO: 17276 - DNA, 20 bp, Unknown
  RNA secondary structure sequence
catggcctagtaactgtccg

SEQ ID NO: 17277 - DNA, 20 bp, Unknown
  RNA secondary structure sequence
ccggttcgcgtctctctgct

SEQ ID NO: 17278 - DNA, 20 bp, Unknown
  RNA secondary structure sequence
gctcggctccgctccaatcc

SEQ ID NO: 17279 - DNA, 20 bp, Unknown
  RNA secondary structure sequence
ctgagagccatgtcggccag

SEQ ID NO: 17280 - DNA, 20 bp, Unknown
  RNA secondary structure sequence
agagaagtccggatcgtggt

SEQ ID NO: 17281 - DNA, 20 bp, Unknown
  RNA secondary structure sequence
gtgtggacgctgtgtatgaa

SEQ ID NO: 17282 - DNA, 20 bp, Unknown
  RNA secondary structure sequence
cccaaagccctgagattaca

SEQ ID NO: 17283 - DNA, 20 bp, Unknown
  RNA secondary structure sequence
ctgtgacactgctgctccct

SEQ ID NO: 17284 - DNA, 20 bp, Unknown
  RNA secondary structure sequence
gcttggcgatgcccagcaga

SEQ ID NO: 17285 - DNA, 20 bp, Unknown
  RNA secondary structure sequence
tcactccctgaggcagtggc

SEQ ID NO: 17286 - DNA, 20 bp, Unknown
  RNA secondary structure sequence
ctgcgccccggctgcgctcc

SEQ ID NO: 17287 - DNA, 20 bp, Unknown
  RNA secondary structure sequence
cagcctgggcggggccgcag

SEQ ID NO: 17288 - DNA, 20 bp, Unknown
  RNA secondary structure sequence
gcagagcgtcctagcagtgt

SEQ ID NO: 17289 - DNA, 20 bp, Unknown
  RNA secondary structure sequence
ctctgtgggcggccgccggg

SEQ ID NO: 17290 - DNA, 20 bp, Unknown
  RNA secondary structure sequence
cagcagagccgagccggccg

SEQ ID NO: 17291 - DNA, 20 bp, Unknown
  RNA secondary structure sequence
ggcatccggggcagtaaaac

SEQ ID NO: 17292 - DNA, 20 bp, Unknown
  RNA secondary structure sequence
ctgcgtccgacccccggccg

SEQ ID NO: 17293 - DNA, 20 bp, Unknown
  RNA secondary structure sequence
gcacctgatctttctcatcc

SEQ ID NO: 17294 - DNA, 20 bp, Unknown
  RNA secondary structure sequence
gcggctccaggcacccaaca

SEQ ID NO: 17295 - DNA, 20 bp, Unknown
  RNA secondary structure sequence
ccgggcggcaacctttgcag

SEQ ID NO: 17296 - DNA, 20 bp, Unknown
  RNA secondary structure sequence
ggccgcaggtgtatttacgg

SEQ ID NO: 17297 - DNA, 20 bp, Unknown
  RNA secondary structure sequence
aatggaatcggaaggaagaa

SEQ ID NO: 17298 - DNA, 20 bp, Unknown
  RNA secondary structure sequence
ggaagccagaccagagagcg

SEQ ID NO: 17299 - DNA, 20 bp, Unknown
  RNA secondary structure sequence
tgaggccctcaggtctctgc

SEQ ID NO: 17300 - DNA, 20 bp, Unknown
  RNA secondary structure sequence
gcgcaaccggaactagcctt

SEQ ID NO: 17301 - DNA, 20 bp, Unknown
  RNA secondary structure sequence
agaccatggcgaaagccggg

SEQ ID NO: 17302 - DNA, 20 bp, Unknown
  RNA secondary structure sequence
gcccctctcctgtctggagg

SEQ ID NO: 17303 - DNA, 20 bp, Unknown
  RNA secondary structure sequence
tgcacccacatccttctttc

SEQ ID NO: 17304 - DNA, 20 bp, Unknown
  RNA secondary structure sequence
tggttctaaagagtggtgag

SEQ ID NO: 17305 - DNA, 20 bp, Unknown
  RNA secondary structure sequence
gtctggagaaaaatgacctt

SEQ ID NO: 17306 - DNA, 20 bp, Unknown
  RNA secondary structure sequence
ttgtacggcggcttctcgcg

SEQ ID NO: 17307 - DNA, 20 bp, Unknown
  RNA secondary structure sequence
agctcccgccccggaagcgg

SEQ ID NO: 17308 - DNA, 20 bp, Unknown
  RNA secondary structure sequence
tgcgcgggtatctctgaagt

SEQ ID NO: 17309 - DNA, 20 bp, Unknown
  RNA secondary structure sequence
ttgtttgagtttcttcacac

SEQ ID NO: 17310 - DNA, 20 bp, Unknown
  RNA secondary structure sequence
caggaagatggcggcctctg

SEQ ID NO: 17311 - DNA, 20 bp, Unknown
  RNA secondary structure sequence
tgccaacccagcagccggct

SEQ ID NO: 17312 - DNA, 20 bp, Unknown
  RNA secondary structure sequence
tggtatattcaaggttggat

SEQ ID NO: 17313 - DNA, 20 bp, Unknown
  RNA secondary structure sequence
cccagcaacagttactcaaa

SEQ ID NO: 17314 - DNA, 20 bp, Unknown
  RNA secondary structure sequence
ggtggggtgtgtgtgtcaaa

SEQ ID NO: 17315 - DNA, 20 bp, Unknown
  RNA secondary structure sequence
gagcccatacttgctctttt

SEQ ID NO: 17316 - DNA, 20 bp, Unknown
  RNA secondary structure sequence
ggtgagagagtgagggggaa

SEQ ID NO: 17317 - DNA, 20 bp, Unknown
  RNA secondary structure sequence
tgccagctgagtcgtgggca

SEQ ID NO: 17318 - DNA, 20 bp, Unknown
  RNA secondary structure sequence
gagttacgattcaaactgaa

SEQ ID NO: 17319 - DNA, 20 bp, Unknown
  RNA secondary structure sequence
cagccccgactgctcctcct

SEQ ID NO: 17320 - DNA, 20 bp, Unknown
  RNA secondary structure sequence
tcttgggggctggaggacgt

SEQ ID NO: 17321 - DNA, 20 bp, Unknown
  RNA secondary structure sequence
gagcggagcccggtgacagg

SEQ ID NO: 17322 - DNA, 20 bp, Unknown
  RNA secondary structure sequence
ctacagcagcttcggcggcg

SEQ ID NO: 17323 - DNA, 20 bp, Unknown
  RNA secondary structure sequence
gccggactctatggggcggg

SEQ ID NO: 17324 - DNA, 20 bp, Unknown
  RNA secondary structure sequence
gaaagaggggaagagtatta

SEQ ID NO: 17325 - DNA, 20 bp, Unknown
  RNA secondary structure sequence
gtgaagcgatagcgttttgc

SEQ ID NO: 17326 - DNA, 20 bp, Unknown
  RNA secondary structure sequence
ccccggaagaggtagctcac

SEQ ID NO: 17327 - DNA, 20 bp, Unknown
  RNA secondary structure sequence
cagagccggtgtctccgcct

SEQ ID NO: 17328 - DNA, 20 bp, Unknown
  RNA secondary structure sequence
agctgtagtgcttctgggca

SEQ ID NO: 17329 - DNA, 20 bp, Unknown
  RNA secondary structure sequence
cggtcccggggccccctggg

SEQ ID NO: 17330 - DNA, 20 bp, Unknown
  RNA secondary structure sequence
cagtgaagccgccggcacct

SEQ ID NO: 17331 - DNA, 20 bp, Unknown
  RNA secondary structure sequence
cttcccgccaggcaagtgcc

SEQ ID NO: 17332 - DNA, 20 bp, Unknown
  RNA secondary structure sequence
cgagggaggtcttgctggag

SEQ ID NO: 17333 - DNA, 20 bp, Unknown
  RNA secondary structure sequence
cagccttcagctgcctgtgt

SEQ ID NO: 17334 - DNA, 20 bp, Unknown
  RNA secondary structure sequence
gctgaccgttttttgtggtg

SEQ ID NO: 17335 - DNA, 20 bp, Unknown
  RNA secondary structure sequence
ttgtcctgctggtccacgcc

SEQ ID NO: 17336 - DNA, 20 bp, Unknown
  RNA secondary structure sequence
agggagaatggcggcgcccg

SEQ ID NO: 17337 - DNA, 20 bp, Unknown
  RNA secondary structure sequence
gggggactctccaggaagaa

SEQ ID NO: 17338 - DNA, 20 bp, Unknown
  RNA secondary structure sequence
tgcgggggaggctgcccgga

SEQ ID NO: 17339 - DNA, 20 bp, Unknown
  RNA secondary structure sequence
gccacctttagccgccagga

SEQ ID NO: 17340 - DNA, 20 bp, Unknown
  RNA secondary structure sequence
gatgagaccggtgcgactca

SEQ ID NO: 17341 - DNA, 20 bp, Unknown
  RNA secondary structure sequence
gtgggcgcggccgggaagct

SEQ ID NO: 17342 - DNA, 20 bp, Unknown
  RNA secondary structure sequence
ccttcccgcggaatcggcgc

SEQ ID NO: 17343 - DNA, 20 bp, Unknown
  RNA secondary structure sequence
cccgcgctcccctcctcccc

SEQ ID NO: 17344 - DNA, 20 bp, Unknown
  RNA secondary structure sequence
gagggaatctgataaagaca

SEQ ID NO: 17345 - DNA, 20 bp, Unknown
  RNA secondary structure sequence
ccggtgcgttaccggcagct

SEQ ID NO: 17346 - DNA, 20 bp, Unknown
  RNA secondary structure sequence
aaagtttgaatcagcttctc

SEQ ID NO: 17347 - DNA, 20 bp, Unknown
  RNA secondary structure sequence
gtccttcctaggactgactt

SEQ ID NO: 17348 - DNA, 20 bp, Unknown
  RNA secondary structure sequence
ctccacaccccttgcgcccg

SEQ ID NO: 17349 - DNA, 20 bp, Unknown
  RNA secondary structure sequence
agtgccctctgcagctgaat

SEQ ID NO: 17350 - DNA, 20 bp, Unknown
  RNA secondary structure sequence
tgttgcagggagtgagggca

SEQ ID NO: 17351 - DNA, 20 bp, Unknown
  RNA secondary structure sequence
cgctgttcagtgccggtgtt

SEQ ID NO: 17352 - DNA, 20 bp, Unknown
  RNA secondary structure sequence
ccgggccctcccctcaggaa

SEQ ID NO: 17353 - DNA, 20 bp, Unknown
  RNA secondary structure sequence
ctccccaccaccaccatctc

SEQ ID NO: 17354 - DNA, 20 bp, Unknown
  RNA secondary structure sequence
atttcattttcctcaagttt

SEQ ID NO: 17355 - DNA, 20 bp, Unknown
  RNA secondary structure sequence
aaccgtcatgtttctgggga

SEQ ID NO: 17356 - DNA, 20 bp, Unknown
  RNA secondary structure sequence
cagcagaggagactgcagac

SEQ ID NO: 17357 - DNA, 20 bp, Unknown
  RNA secondary structure sequence
gacccaaccgcagtgaaggg

SEQ ID NO: 17358 - DNA, 20 bp, Unknown
  RNA secondary structure sequence
tcacctcaagctgtcccctc

SEQ ID NO: 17359 - DNA, 20 bp, Unknown
  RNA secondary structure sequence
cgaaggccccgcccctcaca

SEQ ID NO: 17360 - DNA, 20 bp, Unknown
  RNA secondary structure sequence
atttgttgtctgcccacttt

SEQ ID NO: 17361 - DNA, 20 bp, Unknown
  RNA secondary structure sequence
taccaagcgcctgtgtctgg

SEQ ID NO: 17362 - DNA, 20 bp, Unknown
  RNA secondary structure sequence
cttggtgaggtgactcgcgg

SEQ ID NO: 17363 - DNA, 20 bp, Unknown
  RNA secondary structure sequence
ttgaacccaaagtggatgat

SEQ ID NO: 17364 - DNA, 20 bp, Unknown
  RNA secondary structure sequence
ggcagccagggtggggccca

SEQ ID NO: 17365 - DNA, 20 bp, Unknown
  RNA secondary structure sequence
tgggccagcgggggcgccgc

SEQ ID NO: 17366 - DNA, 20 bp, Unknown
  RNA secondary structure sequence
tgcggcgccgcgcggtgagg

SEQ ID NO: 17367 - DNA, 20 bp, Unknown
  RNA secondary structure sequence
gaggcagtggaggctgaggc

SEQ ID NO: 17368 - DNA, 20 bp, Unknown
  RNA secondary structure sequence
aaatcaatataacctcttct

SEQ ID NO: 17369 - DNA, 20 bp, Unknown
  RNA secondary structure sequence
cctataccagcttccttaca

SEQ ID NO: 17370 - DNA, 20 bp, Unknown
  RNA secondary structure sequence
cagctacggcgaggaggggc

SEQ ID NO: 17371 - DNA, 20 bp, Unknown
  RNA secondary structure sequence
gccaccgagacgcgcagagg

SEQ ID NO: 17372 - DNA, 20 bp, Unknown
  RNA secondary structure sequence
ggaggacaacaaagggccgc

SEQ ID NO: 17373 - DNA, 20 bp, Unknown
  RNA secondary structure sequence
tcactctggaggatggggtg

SEQ ID NO: 17374 - DNA, 20 bp, Unknown
  RNA secondary structure sequence
gcgtatcatctgcgtttcta

SEQ ID NO: 17375 - DNA, 20 bp, Unknown
  RNA secondary structure sequence
ccctgtccggccagcccctc

SEQ ID NO: 17376 - DNA, 20 bp, Unknown
  RNA secondary structure sequence
ccagagatggcagtgagcga

SEQ ID NO: 17377 - DNA, 20 bp, Unknown
  RNA secondary structure sequence
ctaggaaaggctgcttcgcc

SEQ ID NO: 17378 - DNA, 20 bp, Unknown
  RNA secondary structure sequence
ttttctttgatacgggagtt

SEQ ID NO: 17379 - DNA, 20 bp, Unknown
  RNA secondary structure sequence
gccccgccagctgggccaaa

SEQ ID NO: 17380 - DNA, 20 bp, Unknown
  RNA secondary structure sequence
ctgtgaacactatagcgctg

SEQ ID NO: 17381 - DNA, 20 bp, Unknown
  RNA secondary structure sequence
tccttagccctgcccctctc

SEQ ID NO: 17382 - DNA, 20 bp, Unknown
  RNA secondary structure sequence
tcggcgctcaggaagcatgg

SEQ ID NO: 17383 - DNA, 20 bp, Unknown
  RNA secondary structure sequence
ctgatggcttcctccaaccc

SEQ ID NO: 17384 - DNA, 20 bp, Unknown
  RNA secondary structure sequence
ttcggtggtgaacgagtctc

SEQ ID NO: 17385 - DNA, 20 bp, Unknown
  RNA secondary structure sequence
gcctgcaccggtcaggcagt

SEQ ID NO: 17386 - DNA, 20 bp, Unknown
  RNA secondary structure sequence
cttgctgcccctttccagcc

SEQ ID NO: 17387 - DNA, 20 bp, Unknown
  RNA secondary structure sequence
gccaggaggaagggcagctt

SEQ ID NO: 17388 - DNA, 20 bp, Unknown
  RNA secondary structure sequence
ttgcggggcgcgcgccagcc

SEQ ID NO: 17389 - DNA, 20 bp, Unknown
  RNA secondary structure sequence
tgtgcagcaatggccaagat

SEQ ID NO: 17390 - DNA, 20 bp, Unknown
  RNA secondary structure sequence
gcagtcaccgcggagcagac

SEQ ID NO: 17391 - DNA, 20 bp, Unknown
  RNA secondary structure sequence
ccctgtcaactgagaattaa

SEQ ID NO: 17392 - DNA, 20 bp, Unknown
  RNA secondary structure sequence
agcgctgcaaggacaaccgg

SEQ ID NO: 17393 - DNA, 20 bp, Unknown
  RNA secondary structure sequence
gagagagaatgtcttttcga

SEQ ID NO: 17394 - DNA, 20 bp, Unknown
  RNA secondary structure sequence
cgcttctgtcagctctccct

SEQ ID NO: 17395 - DNA, 20 bp, Unknown
  RNA secondary structure sequence
tgctgaaaatccgaagtgcc

SEQ ID NO: 17396 - DNA, 20 bp, Unknown
  RNA secondary structure sequence
cccatgtgctgaaaatccga

SEQ ID NO: 17397 - DNA, 20 bp, Unknown
  RNA secondary structure sequence
tccaagtctccttggcaaga

SEQ ID NO: 17398 - DNA, 20 bp, Unknown
  RNA secondary structure sequence
ggtggtagtggcagtgttcg

SEQ ID NO: 17399 - DNA, 20 bp, Unknown
  RNA secondary structure sequence
taggaggggccgtcaggcgg

SEQ ID NO: 17400 - DNA, 20 bp, Unknown
  RNA secondary structure sequence
aaaaactttataaacccccc

SEQ ID NO: 17401 - DNA, 20 bp, Unknown
  RNA secondary structure sequence
tcactgccatccccgctgtc

SEQ ID NO: 17402 - DNA, 20 bp, Unknown
  RNA secondary structure sequence
gcgctagcgtccgggaccgg

SEQ ID NO: 17403 - DNA, 20 bp, Unknown
  RNA secondary structure sequence
agtcggcgcctcgggttcct

SEQ ID NO: 17404 - DNA, 20 bp, Unknown
  RNA secondary structure sequence
gtcctctcccgccctacagg

SEQ ID NO: 17405 - DNA, 20 bp, Unknown
  RNA secondary structure sequence
gaagagggcaccctccgcca

SEQ ID NO: 17406 - DNA, 20 bp, Unknown
  RNA secondary structure sequence
accatccccttgccccgccc

SEQ ID NO: 17407 - DNA, 20 bp, Unknown
  RNA secondary structure sequence
tacctcctgggcagtgagct

SEQ ID NO: 17408 - DNA, 20 bp, Unknown
  RNA secondary structure sequence
cgccttccgctcgtgggagt

SEQ ID NO: 17409 - DNA, 20 bp, Unknown
  RNA secondary structure sequence
cgggaagggatggatcgctg

SEQ ID NO: 17410 - DNA, 20 bp, Unknown
  RNA secondary structure sequence
catgctggtcctttatggac

SEQ ID NO: 17411 - DNA, 20 bp, Unknown
  RNA secondary structure sequence
aggaccgttacgtttcccgg

SEQ ID NO: 17412 - DNA, 20 bp, Unknown
  RNA secondary structure sequence
ccacggcggaggcgctgggt

SEQ ID NO: 17413 - DNA, 20 bp, Unknown
  RNA secondary structure sequence
ccaagggttggctgactgca

SEQ ID NO: 17414 - DNA, 20 bp, Unknown
  RNA secondary structure sequence
ccaagcttctgggtatttct

SEQ ID NO: 17415 - DNA, 20 bp, Unknown
  RNA secondary structure sequence
tcccggcgctccctccccga

SEQ ID NO: 17416 - DNA, 20 bp, Unknown
  RNA secondary structure sequence
atgcctagcccacaccagtt

SEQ ID NO: 17417 - DNA, 20 bp, Unknown
  RNA secondary structure sequence
cttcactggggcagtctctg

SEQ ID NO: 17418 - DNA, 20 bp, Unknown
  RNA secondary structure sequence
gcgggggtagttacggtgtt

SEQ ID NO: 17419 - DNA, 20 bp, Unknown
  RNA secondary structure sequence
aggacccggaggacgtccgg

SEQ ID NO: 17420 - DNA, 20 bp, Unknown
  RNA secondary structure sequence
cacagccacagcccctgact

SEQ ID NO: 17421 - DNA, 20 bp, Unknown
  RNA secondary structure sequence
gttaagtgactcacccaagg

SEQ ID NO: 17422 - DNA, 20 bp, Unknown
  RNA secondary structure sequence
acgggagcatcctgcaccgt

SEQ ID NO: 17423 - DNA, 20 bp, Unknown
  RNA secondary structure sequence
ctgggtggggtccgcgcagc

SEQ ID NO: 17424 - DNA, 20 bp, Unknown
  RNA secondary structure sequence
caggaggccatgtcgggtga

SEQ ID NO: 17425 - DNA, 20 bp, Unknown
  RNA secondary structure sequence
gcggcagcgccactcgggcg

SEQ ID NO: 17426 - DNA, 20 bp, Unknown
  RNA secondary structure sequence
gggtgggtggggccaggagg

SEQ ID NO: 17427 - DNA, 20 bp, Unknown
  RNA secondary structure sequence
aatgacagaggctcacagga

SEQ ID NO: 17428 - DNA, 20 bp, Unknown
  RNA secondary structure sequence
tcaccacattttagtgagaa

SEQ ID NO: 17429 - DNA, 20 bp, Unknown
  RNA secondary structure sequence
cacttcaccctctcgcctcg

SEQ ID NO: 17430 - DNA, 20 bp, Unknown
  RNA secondary structure sequence
cttctccctcccctccagaa

SEQ ID NO: 17431 - DNA, 20 bp, Unknown
  RNA secondary structure sequence
tgaagagaatttggattcat

SEQ ID NO: 17432 - DNA, 20 bp, Unknown
  RNA secondary structure sequence
gcgcagaccgagcatccgcg

SEQ ID NO: 17433 - DNA, 20 bp, Unknown
  RNA secondary structure sequence
taaactctcagagtaactgt

SEQ ID NO: 17434 - DNA, 20 bp, Unknown
  RNA secondary structure sequence
tgcaaaaagaaaaagagacg

SEQ ID NO: 17435 - DNA, 20 bp, Unknown
  RNA secondary structure sequence
gctaccgagcggtgccaggc

SEQ ID NO: 17436 - DNA, 20 bp, Unknown
  RNA secondary structure sequence
ggcaccttccactagcaaca

SEQ ID NO: 17437 - DNA, 20 bp, Unknown
  RNA secondary structure sequence
ctcgcagcgttgctcacaga

SEQ ID NO: 17438 - DNA, 20 bp, Unknown
  RNA secondary structure sequence
ccgcgcggagcccaccattg

SEQ ID NO: 17439 - DNA, 20 bp, Unknown
  RNA secondary structure sequence
cttgcggcgctggaggagct

SEQ ID NO: 17440 - DNA, 20 bp, Unknown
  RNA secondary structure sequence
ggtccaccacgccttccacc

SEQ ID NO: 17441 - DNA, 20 bp, Unknown
  RNA secondary structure sequence
cccacccctttctttttgag

SEQ ID NO: 17442 - DNA, 20 bp, Unknown
  RNA secondary structure sequence
tacaaataggaatagggtac

SEQ ID NO: 17443 - DNA, 20 bp, Unknown
  RNA secondary structure sequence
tgggcctcccaaaagacagt

SEQ ID NO: 17444 - DNA, 20 bp, Unknown
  RNA secondary structure sequence
ctctttccctgctgattcca

SEQ ID NO: 17445 - DNA, 20 bp, Unknown
  RNA secondary structure sequence
agcccggggcggcccagtcg

SEQ ID NO: 17446 - DNA, 20 bp, Unknown
  RNA secondary structure sequence
agcggggagtcgaggcggcg

SEQ ID NO: 17447 - DNA, 20 bp, Unknown
  RNA secondary structure sequence
tttgtctgtaggagcagcgg

SEQ ID NO: 17448 - DNA, 20 bp, Unknown
  RNA secondary structure sequence
caacaccaaaacgcatccac

SEQ ID NO: 17449 - DNA, 20 bp, Unknown
  RNA secondary structure sequence
gcacagctgggacctcctct

SEQ ID NO: 17450 - DNA, 20 bp, Unknown
  RNA secondary structure sequence
tgctccccgccgcttccgtt

SEQ ID NO: 17451 - DNA, 20 bp, Unknown
  RNA secondary structure sequence
gagcgcccgccgctgcattt

SEQ ID NO: 17452 - DNA, 20 bp, Unknown
  RNA secondary structure sequence
aggtcgagagagggatgcga

SEQ ID NO: 17453 - DNA, 20 bp, Unknown
  RNA secondary structure sequence
ctttccggacgccacgtgca

SEQ ID NO: 17454 - DNA, 20 bp, Unknown
  RNA secondary structure sequence
ccggcgttgctgtagcgcgt

SEQ ID NO: 17455 - DNA, 20 bp, Unknown
  RNA secondary structure sequence
gctaccgcgtctgctggacg

SEQ ID NO: 17456 - DNA, 20 bp, Unknown
  RNA secondary structure sequence
caggggcctctcacgtgacc

SEQ ID NO: 17457 - DNA, 20 bp, Unknown
  RNA secondary structure sequence
actccagtgcgcccccaacc

SEQ ID NO: 17458 - DNA, 20 bp, Unknown
  RNA secondary structure sequence
ttcactcctccattgtctgc

SEQ ID NO: 17459 - DNA, 20 bp, Unknown
  RNA secondary structure sequence
gtccttcactcctccattgt

SEQ ID NO: 17460 - DNA, 20 bp, Unknown
  RNA secondary structure sequence
gggcgtgtggccgcgggttt

SEQ ID NO: 17461 - DNA, 20 bp, Unknown
  RNA secondary structure sequence
cctgaccccctccccccgct

SEQ ID NO: 17462 - DNA, 20 bp, Unknown
  RNA secondary structure sequence
cacctgctgtggttatgatg

SEQ ID NO: 17463 - DNA, 20 bp, Unknown
  RNA secondary structure sequence
agaggccgagtctccgaggg

SEQ ID NO: 17464 - DNA, 20 bp, Unknown
  RNA secondary structure sequence
cggtagttccgccgggtctg

SEQ ID NO: 17465 - DNA, 20 bp, Unknown
  RNA secondary structure sequence
cgccaatgatgagctggatt

SEQ ID NO: 17466 - DNA, 20 bp, Unknown
  RNA secondary structure sequence
aagaatccaggttttgaggt

SEQ ID NO: 17467 - DNA, 20 bp, Unknown
  RNA secondary structure sequence
ctgccacctttgcctcctgg

SEQ ID NO: 17468 - DNA, 20 bp, Unknown
  RNA secondary structure sequence
ggggctgcccacgccccctt

SEQ ID NO: 17469 - DNA, 20 bp, Unknown
  RNA secondary structure sequence
agggtgtcgccgctgtgccg

SEQ ID NO: 17470 - DNA, 20 bp, Unknown
  RNA secondary structure sequence
gggacacggagccgcgagga

SEQ ID NO: 17471 - DNA, 20 bp, Unknown
  RNA secondary structure sequence
aatcttgggttgtatctccc

SEQ ID NO: 17472 - DNA, 20 bp, Unknown
  RNA secondary structure sequence
ctgggccaatatggcagcgc

SEQ ID NO: 17473 - DNA, 20 bp, Unknown
  RNA secondary structure sequence
taggggaggccacgggcttg

SEQ ID NO: 17474 - DNA, 20 bp, Unknown
  RNA secondary structure sequence
atggtgaattcgggcctctc

SEQ ID NO: 17475 - DNA, 20 bp, Unknown
  RNA secondary structure sequence
agccccagacacggaccccg

SEQ ID NO: 17476 - DNA, 20 bp, Unknown
  RNA secondary structure sequence
gagcagaccttccctggagc

SEQ ID NO: 17477 - DNA, 20 bp, Unknown
  RNA secondary structure sequence
gggccaaggccagggcctga

SEQ ID NO: 17478 - DNA, 20 bp, Unknown
  RNA secondary structure sequence
tctttccgccagtttttgta

SEQ ID NO: 17479 - DNA, 20 bp, Unknown
  RNA secondary structure sequence
ggctgaaccgcccggctgag

SEQ ID NO: 17480 - DNA, 20 bp, Unknown
  RNA secondary structure sequence
ccgtggcggggatgctgcga

SEQ ID NO: 17481 - DNA, 20 bp, Unknown
  RNA secondary structure sequence
ccctcggctgctgcagggat

SEQ ID NO: 17482 - DNA, 20 bp, Unknown
  RNA secondary structure sequence
gagctactgagggtctaagt

SEQ ID NO: 17483 - DNA, 20 bp, Unknown
  RNA secondary structure sequence
cggcggagagtgcggcatgc

SEQ ID NO: 17484 - DNA, 20 bp, Unknown
  RNA secondary structure sequence
tgaagctccctgtggcctgg

SEQ ID NO: 17485 - DNA, 20 bp, Unknown
  RNA secondary structure sequence
cgcagggagctggatggaga

SEQ ID NO: 17486 - DNA, 20 bp, Unknown
  RNA secondary structure sequence
gcgacccggcctcctagggg

SEQ ID NO: 17487 - DNA, 20 bp, Unknown
  RNA secondary structure sequence
gtcgtggtccagacagttta

SEQ ID NO: 17488 - DNA, 20 bp, Unknown
  RNA secondary structure sequence
gacaggaagcactttggtcc

SEQ ID NO: 17489 - DNA, 20 bp, Unknown
  RNA secondary structure sequence
agctgactcctgctgggccc

SEQ ID NO: 17490 - DNA, 20 bp, Unknown
  RNA secondary structure sequence
tagccgctgcctcctcctac

SEQ ID NO: 17491 - DNA, 20 bp, Unknown
  RNA secondary structure sequence
ctttttctcccgaaggaaga

SEQ ID NO: 17492 - DNA, 20 bp, Unknown
  RNA secondary structure sequence
gcgactctgtactccctgct

SEQ ID NO: 17493 - DNA, 20 bp, Unknown
  RNA secondary structure sequence
aactgtcatcgataggaata

SEQ ID NO: 17494 - DNA, 20 bp, Unknown
  RNA secondary structure sequence
caggctgagtgctgcggcgc

SEQ ID NO: 17495 - DNA, 20 bp, Unknown
  RNA secondary structure sequence
cggggagagcaggggttctg

SEQ ID NO: 17496 - DNA, 20 bp, Unknown
  RNA secondary structure sequence
ctcgccgtcggctctacctg

SEQ ID NO: 17497 - DNA, 20 bp, Unknown
  RNA secondary structure sequence
aggggaggagccgggtccac

SEQ ID NO: 17498 - DNA, 20 bp, Unknown
  RNA secondary structure sequence
gaggtgcaggtcgaagaggc

SEQ ID NO: 17499 - DNA, 20 bp, Unknown
  RNA secondary structure sequence
tccgaagcatggcgccggcg

SEQ ID NO: 17500 - DNA, 20 bp, Unknown
  RNA secondary structure sequence
gccactgtccggccacagcc

SEQ ID NO: 17501 - DNA, 20 bp, Unknown
  RNA secondary structure sequence
cttgggggatcgccgcggct

SEQ ID NO: 17502 - DNA, 20 bp, Unknown
  RNA secondary structure sequence
ttaaagtgcttccgcatggt

SEQ ID NO: 17503 - DNA, 20 bp, Unknown
  RNA secondary structure sequence
cagctctgctgagagagtgc

SEQ ID NO: 17504 - DNA, 20 bp, Unknown
  RNA secondary structure sequence
tccagctccagggacctgtc

SEQ ID NO: 17505 - DNA, 20 bp, Unknown
  RNA secondary structure sequence
tccctgcaacccggccggcg

SEQ ID NO: 17506 - DNA, 20 bp, Unknown
  RNA secondary structure sequence
caagactcccgtagtcccca

SEQ ID NO: 17507 - DNA, 20 bp, Unknown
  RNA secondary structure sequence
gtacaattggctgaggcgct

SEQ ID NO: 17508 - DNA, 20 bp, Unknown
  RNA secondary structure sequence
accagggcgcatgcgtaaca

SEQ ID NO: 17509 - DNA, 20 bp, Unknown
  RNA secondary structure sequence
ccggtgtacttcagtttccg

SEQ ID NO: 17510 - DNA, 20 bp, Unknown
  RNA secondary structure sequence
cgcgtcgactgcccagagtc

SEQ ID NO: 17511 - DNA, 20 bp, Unknown
  RNA secondary structure sequence
tttggggttgtccctggact

SEQ ID NO: 17512 - DNA, 20 bp, Unknown
  RNA secondary structure sequence
tgcagcccgttcgctcacac

SEQ ID NO: 17513 - DNA, 20 bp, Unknown
  RNA secondary structure sequence
gtcccggcatcggccaagat

SEQ ID NO: 17514 - DNA, 20 bp, Unknown
  RNA secondary structure sequence
acgctctgtccctgcgtgac

SEQ ID NO: 17515 - DNA, 20 bp, Unknown
  RNA secondary structure sequence
cgggcggcggtgaccccggc

SEQ ID NO: 17516 - DNA, 20 bp, Unknown
  RNA secondary structure sequence
ccgcacgggggccgcggcca

SEQ ID NO: 17517 - DNA, 20 bp, Unknown
  RNA secondary structure sequence
ggcctttcctaggaggtaac

SEQ ID NO: 17518 - DNA, 20 bp, Unknown
  RNA secondary structure sequence
ggacgccatggtaagcgcgg

SEQ ID NO: 17519 - DNA, 20 bp, Unknown
  RNA secondary structure sequence
ttaccggcggattaagctcg

SEQ ID NO: 17520 - DNA, 20 bp, Unknown
  RNA secondary structure sequence
tgtcgaaggaccaaaggcga

SEQ ID NO: 17521 - DNA, 20 bp, Unknown
  RNA secondary structure sequence
tggagcgcggcggaggtgag

SEQ ID NO: 17522 - DNA, 20 bp, Unknown
  RNA secondary structure sequence
tcaaccctcccggaagtgag

SEQ ID NO: 17523 - DNA, 20 bp, Unknown
  RNA secondary structure sequence
agaaatgaatgaaatgaaat

SEQ ID NO: 17524 - DNA, 20 bp, Unknown
  RNA secondary structure sequence
aagaagctgctgacatcctg

SEQ ID NO: 17525 - DNA, 20 bp, Unknown
  RNA secondary structure sequence
gccgcagtgacccagtaatg

SEQ ID NO: 17526 - DNA, 20 bp, Unknown
  RNA secondary structure sequence
tccggcgccagctacgccgc

SEQ ID NO: 17527 - DNA, 20 bp, Unknown
  RNA secondary structure sequence
gcgcttccctggtcaggcac

SEQ ID NO: 17528 - DNA, 20 bp, Unknown
  RNA secondary structure sequence
tagtttgcggcatcctgtgg

SEQ ID NO: 17529 - DNA, 20 bp, Unknown
  RNA secondary structure sequence
ggcagagaaacagctggaaa

SEQ ID NO: 17530 - DNA, 20 bp, Unknown
  RNA secondary structure sequence
aggcggtcagcctgcagcat

SEQ ID NO: 17531 - DNA, 20 bp, Unknown
  RNA secondary structure sequence
atcttcgggctgtcagagtt

SEQ ID NO: 17532 - DNA, 20 bp, Unknown
  RNA secondary structure sequence
ccgcggaagatgagcagcag

SEQ ID NO: 17533 - DNA, 20 bp, Unknown
  RNA secondary structure sequence
agcggcctggcgtcggcgct

SEQ ID NO: 17534 - DNA, 20 bp, Unknown
  RNA secondary structure sequence
cggcggtggtggctgagtcc

SEQ ID NO: 17535 - DNA, 20 bp, Unknown
  RNA secondary structure sequence
tgccacctccctctttcttc

SEQ ID NO: 17536 - DNA, 20 bp, Unknown
  RNA secondary structure sequence
gtgccctaggctcggccggc

SEQ ID NO: 17537 - DNA, 20 bp, Unknown
  RNA secondary structure sequence
ggcctctctgagcccggctt

SEQ ID NO: 17538 - DNA, 20 bp, Unknown
  RNA secondary structure sequence
ccgagctgcatcttagggag

SEQ ID NO: 17539 - DNA, 20 bp, Unknown
  RNA secondary structure sequence
aaaacgagtttttcacgact

SEQ ID NO: 17540 - DNA, 20 bp, Unknown
  RNA secondary structure sequence
ctggcggccgggtaagggtc

SEQ ID NO: 17541 - DNA, 20 bp, Unknown
  RNA secondary structure sequence
gccggccctgcgcctcccgc

SEQ ID NO: 17542 - DNA, 20 bp, Unknown
  RNA secondary structure sequence
cggtgcgggagaggggttgg

SEQ ID NO: 17543 - DNA, 20 bp, Unknown
  RNA secondary structure sequence
tggcctggagggagacctcg

SEQ ID NO: 17544 - DNA, 20 bp, Unknown
  RNA secondary structure sequence
cactcaccgccgctggggga

SEQ ID NO: 17545 - DNA, 20 bp, Unknown
  RNA secondary structure sequence
aagccccgggaccgccccgc

SEQ ID NO: 17546 - DNA, 20 bp, Unknown
  RNA secondary structure sequence
gaggctccatctccattctg

SEQ ID NO: 17547 - DNA, 20 bp, Unknown
  RNA secondary structure sequence
gtcccccagagtctccaact

SEQ ID NO: 17548 - DNA, 20 bp, Unknown
  RNA secondary structure sequence
gcaggggtggttggtgtcaa

SEQ ID NO: 17549 - DNA, 20 bp, Unknown
  RNA secondary structure sequence
gaggtgctgtgcaggaggcg

SEQ ID NO: 17550 - DNA, 20 bp, Unknown
  RNA secondary structure sequence
aaggggtcctccctgcgcca

SEQ ID NO: 17551 - DNA, 20 bp, Unknown
  RNA secondary structure sequence
ttgctgaggaggcggattag

SEQ ID NO: 17552 - DNA, 20 bp, Unknown
  RNA secondary structure sequence
tccccctcatttgcagatgc

SEQ ID NO: 17553 - DNA, 20 bp, Unknown
  RNA secondary structure sequence
tggcggcagtggcgtcactt

SEQ ID NO: 17554 - DNA, 20 bp, Unknown
  RNA secondary structure sequence
gtttcctgccagtcgggagg

SEQ ID NO: 17555 - DNA, 20 bp, Unknown
  RNA secondary structure sequence
cgtattgagaggagatacac

SEQ ID NO: 17556 - DNA, 20 bp, Unknown
  RNA secondary structure sequence
actccggccttccctgccct

SEQ ID NO: 17557 - DNA, 20 bp, Unknown
  RNA secondary structure sequence
agttcgacggtaaacgaccc

SEQ ID NO: 17558 - DNA, 20 bp, Unknown
  RNA secondary structure sequence
cccccgggggaggccatgaa

SEQ ID NO: 17559 - DNA, 20 bp, Unknown
  RNA secondary structure sequence
attcgaagctacttcacagt

SEQ ID NO: 17560 - DNA, 20 bp, Unknown
  RNA secondary structure sequence
gtgcacatggggtgttggag

SEQ ID NO: 17561 - DNA, 20 bp, Unknown
  RNA secondary structure sequence
agagctggggtcgtggcggc

SEQ ID NO: 17562 - DNA, 20 bp, Unknown
  RNA secondary structure sequence
gggtgaggagctggtggcgt

SEQ ID NO: 17563 - DNA, 20 bp, Unknown
  RNA secondary structure sequence
accctagtgacaggagccga

SEQ ID NO: 17564 - DNA, 20 bp, Unknown
  RNA secondary structure sequence
gaggcagcggagacagaggc

SEQ ID NO: 17565 - DNA, 20 bp, Unknown
  RNA secondary structure sequence
gcacgcagtccgacttggcc

SEQ ID NO: 17566 - DNA, 20 bp, Unknown
  RNA secondary structure sequence
gcgacccccgggcggggcca

SEQ ID NO: 17567 - DNA, 20 bp, Unknown
  RNA secondary structure sequence
agagccggagccgtggcctg

SEQ ID NO: 17568 - DNA, 20 bp, Unknown
  RNA secondary structure sequence
caagcgccggcgttctctgc

SEQ ID NO: 17569 - DNA, 20 bp, Unknown
  RNA secondary structure sequence
tgggcagagggattggcaag

SEQ ID NO: 17570 - DNA, 20 bp, Unknown
  RNA secondary structure sequence
ggcgcagtaaacagtctcct

SEQ ID NO: 17571 - DNA, 20 bp, Unknown
  RNA secondary structure sequence
tttgggattctggaattcga

SEQ ID NO: 17572 - DNA, 20 bp, Unknown
  RNA secondary structure sequence
ttgagtcgggcaaggaagag

SEQ ID NO: 17573 - DNA, 20 bp, Unknown
  RNA secondary structure sequence
cctttgtcaagtcatcccct

SEQ ID NO: 17574 - DNA, 20 bp, Unknown
  RNA secondary structure sequence
gatcctgaggaggcagctgc

SEQ ID NO: 17575 - DNA, 20 bp, Unknown
  RNA secondary structure sequence
ccgggagcggcggcggccat

SEQ ID NO: 17576 - DNA, 20 bp, Unknown
  RNA secondary structure sequence
aggagcatcagaccacagat

SEQ ID NO: 17577 - DNA, 20 bp, Unknown
  RNA secondary structure sequence
cgtccctcgcacacgcagag

SEQ ID NO: 17578 - DNA, 20 bp, Unknown
  RNA secondary structure sequence
gcgagctagccagcaggcat

SEQ ID NO: 17579 - DNA, 20 bp, Unknown
  RNA secondary structure sequence
ggggcgggccacagtctcca

SEQ ID NO: 17580 - DNA, 20 bp, Unknown
  RNA secondary structure sequence
tcggaagcctaggaggctgg

SEQ ID NO: 17581 - DNA, 20 bp, Unknown
  RNA secondary structure sequence
ggagcctctagaactatgag

SEQ ID NO: 17582 - DNA, 20 bp, Unknown
  RNA secondary structure sequence
attgcctattggcctgtgct

SEQ ID NO: 17583 - DNA, 20 bp, Unknown
  RNA secondary structure sequence
ctgaaataacagaagctgtg

SEQ ID NO: 17584 - DNA, 20 bp, Unknown
  RNA secondary structure sequence
gtcactgcgccggggtagtg

SEQ ID NO: 17585 - DNA, 20 bp, Unknown
  RNA secondary structure sequence
cgtaagtccctctcgtgcgc

SEQ ID NO: 17586 - DNA, 20 bp, Unknown
  RNA secondary structure sequence
gcgtccctctctccacgagg

SEQ ID NO: 17587 - DNA, 20 bp, Unknown
  RNA secondary structure sequence
ctggagccagactgtggtct

SEQ ID NO: 17588 - DNA, 20 bp, Unknown
  RNA secondary structure sequence
gcctcagtctccccagctct

SEQ ID NO: 17589 - DNA, 20 bp, Unknown
  RNA secondary structure sequence
cctttgccccctcacacctc

SEQ ID NO: 17590 - DNA, 20 bp, Unknown
  RNA secondary structure sequence
agcctggacccttagcggtg

SEQ ID NO: 17591 - DNA, 20 bp, Unknown
  RNA secondary structure sequence
aaccaattagtgacaacact

SEQ ID NO: 17592 - DNA, 20 bp, Unknown
  RNA secondary structure sequence
caggactttagccggttgag

SEQ ID NO: 17593 - DNA, 20 bp, Unknown
  RNA secondary structure sequence
tggacttgcagaccggaatg

SEQ ID NO: 17594 - DNA, 20 bp, Unknown
  RNA secondary structure sequence
caacccactttccgcgggga

SEQ ID NO: 17595 - DNA, 20 bp, Unknown
  RNA secondary structure sequence
tgctccccgcgccaccctcc

SEQ ID NO: 17596 - DNA, 20 bp, Unknown
  RNA secondary structure sequence
actgcagcccagtgctgaat

SEQ ID NO: 17597 - DNA, 20 bp, Unknown
  RNA secondary structure sequence
taaaggcttgtctttcccct

SEQ ID NO: 17598 - DNA, 20 bp, Unknown
  RNA secondary structure sequence
ctgagtgactgccaaggaag

SEQ ID NO: 17599 - DNA, 20 bp, Unknown
  RNA secondary structure sequence
ctctcggcgctcactgctct

SEQ ID NO: 17600 - DNA, 20 bp, Unknown
  RNA secondary structure sequence
ccggcgggcccagtgttgga

SEQ ID NO: 17601 - DNA, 20 bp, Unknown
  RNA secondary structure sequence
cagcccaaaagggcccggtc

SEQ ID NO: 17602 - DNA, 20 bp, Unknown
  RNA secondary structure sequence
caggtctctgacttcgggct

SEQ ID NO: 17603 - DNA, 20 bp, Unknown
  RNA secondary structure sequence
tttgccgggtgcttcagatc

SEQ ID NO: 17604 - DNA, 20 bp, Unknown
  RNA secondary structure sequence
cctcgccagccaggtgctcg

SEQ ID NO: 17605 - DNA, 20 bp, Unknown
  RNA secondary structure sequence
actgtgaaccaggagtgagt

SEQ ID NO: 17606 - DNA, 20 bp, Unknown
  RNA secondary structure sequence
tagtcgaccgtgtccgcgcg

SEQ ID NO: 17607 - DNA, 20 bp, Unknown
  RNA secondary structure sequence
cttctttgcggctcggccat

SEQ ID NO: 17608 - DNA, 20 bp, Unknown
  RNA secondary structure sequence
tctccagtcctgacgacacc

SEQ ID NO: 17609 - DNA, 20 bp, Unknown
  RNA secondary structure sequence
tcgcaagctgaaaatcttgc

SEQ ID NO: 17610 - DNA, 20 bp, Unknown
  RNA secondary structure sequence
ttccctcttgtcgcccaggc

SEQ ID NO: 17611 - DNA, 20 bp, Unknown
  RNA secondary structure sequence
cccgcggtggcgggggttgg

SEQ ID NO: 17612 - DNA, 20 bp, Unknown
  RNA secondary structure sequence
aattttatttcagggtaaac

SEQ ID NO: 17613 - DNA, 20 bp, Unknown
  RNA secondary structure sequence
agaagcttataaaatagctt

SEQ ID NO: 17614 - DNA, 20 bp, Unknown
  RNA secondary structure sequence
cgggcggcggctgtgttgcg

SEQ ID NO: 17615 - DNA, 20 bp, Unknown
  RNA secondary structure sequence
ggagccagcgcggagcacct

SEQ ID NO: 17616 - DNA, 20 bp, Unknown
  RNA secondary structure sequence
gggagggagagagagcgcgc

SEQ ID NO: 17617 - DNA, 20 bp, Unknown
  RNA secondary structure sequence
cccttgcttaaaaaatttta

SEQ ID NO: 17618 - DNA, 20 bp, Unknown
  RNA secondary structure sequence
agatggcagccccgggggac

SEQ ID NO: 17619 - DNA, 20 bp, Unknown
  RNA secondary structure sequence
tcccgcaacccgataccatc

SEQ ID NO: 17620 - DNA, 20 bp, Unknown
  RNA secondary structure sequence
cctccaccgggccttgcagg

SEQ ID NO: 17621 - DNA, 20 bp, Unknown
  RNA secondary structure sequence
tgacccccgagaaggaggct

SEQ ID NO: 17622 - DNA, 20 bp, Unknown
  RNA secondary structure sequence
accccttcctcgggtttagg

SEQ ID NO: 17623 - DNA, 20 bp, Unknown
  RNA secondary structure sequence
ggcctgaggctgctcccgga

SEQ ID NO: 17624 - DNA, 20 bp, Unknown
  RNA secondary structure sequence
cccgaccgcattttacgtgg

SEQ ID NO: 17625 - DNA, 20 bp, Unknown
  RNA secondary structure sequence
ctcctctcagatttgtgtgc

SEQ ID NO: 17626 - DNA, 20 bp, Unknown
  RNA secondary structure sequence
ctgctttcatgccctttctt

SEQ ID NO: 17627 - DNA, 20 bp, Unknown
  RNA secondary structure sequence
gcgctggccagagatgcctg

SEQ ID NO: 17628 - DNA, 20 bp, Unknown
  RNA secondary structure sequence
tactgggattctctgaccga

SEQ ID NO: 17629 - DNA, 20 bp, Unknown
  RNA secondary structure sequence
ccctgctttctgcattcttc

SEQ ID NO: 17630 - DNA, 20 bp, Unknown
  RNA secondary structure sequence
gttagcccgtcagtccctgc

SEQ ID NO: 17631 - DNA, 20 bp, Unknown
  RNA secondary structure sequence
gcgacactatccgtgcggcc

SEQ ID NO: 17632 - DNA, 20 bp, Unknown
  RNA secondary structure sequence
ggcggcgacctggtcgcaag

SEQ ID NO: 17633 - DNA, 20 bp, Unknown
  RNA secondary structure sequence
ctgctgtttctcagacagca

SEQ ID NO: 17634 - DNA, 20 bp, Unknown
  RNA secondary structure sequence
caggcggttgcgttccccgt

SEQ ID NO: 17635 - DNA, 20 bp, Unknown
  RNA secondary structure sequence
gcgtcgcgccctggggccgg

SEQ ID NO: 17636 - DNA, 20 bp, Unknown
  RNA secondary structure sequence
gagtggaatggccgcgggcg

SEQ ID NO: 17637 - DNA, 20 bp, Unknown
  RNA secondary structure sequence
gctgtctccctcggcctgtg

SEQ ID NO: 17638 - DNA, 20 bp, Unknown
  RNA secondary structure sequence
cgcttccgcccgctgtcctg

SEQ ID NO: 17639 - DNA, 20 bp, Unknown
  RNA secondary structure sequence
ggaggatatacctttttttc

SEQ ID NO: 17640 - DNA, 20 bp, Unknown
  RNA secondary structure sequence
cgagtccgaccccgcccttc

SEQ ID NO: 17641 - DNA, 20 bp, Unknown
  RNA secondary structure sequence
ggtgcttgcgtgtggtggtg

SEQ ID NO: 17642 - DNA, 20 bp, Unknown
  RNA secondary structure sequence
gaagacttacaggcagagag

SEQ ID NO: 17643 - DNA, 20 bp, Unknown
  RNA secondary structure sequence
actaatggaagaaatctgct

SEQ ID NO: 17644 - DNA, 20 bp, Unknown
  RNA secondary structure sequence
ccccgagaagccgtccagga

SEQ ID NO: 17645 - DNA, 20 bp, Unknown
  RNA secondary structure sequence
ctgagaagtaaatggtattt

SEQ ID NO: 17646 - DNA, 20 bp, Unknown
  RNA secondary structure sequence
aagcgagccgggctacgggg

SEQ ID NO: 17647 - DNA, 20 bp, Unknown
  RNA secondary structure sequence
tctcgggagatgcaggatgt

SEQ ID NO: 17648 - DNA, 20 bp, Unknown
  RNA secondary structure sequence
ttggcatcgccactctgggc

SEQ ID NO: 17649 - DNA, 20 bp, Unknown
  RNA secondary structure sequence
gtaacggcttggtaattatg

SEQ ID NO: 17650 - DNA, 20 bp, Unknown
  RNA secondary structure sequence
cccaaggggttttaggaaag

SEQ ID NO: 17651 - DNA, 20 bp, Unknown
  RNA secondary structure sequence
gggccggccttcaagcaaga

SEQ ID NO: 17652 - DNA, 20 bp, Unknown
  RNA secondary structure sequence
tcctaagcttctggcaagta

SEQ ID NO: 17653 - DNA, 20 bp, Unknown
  RNA secondary structure sequence
gaagcctgcgagttccggaa

SEQ ID NO: 17654 - DNA, 20 bp, Unknown
  RNA secondary structure sequence
ctcggcgctcgggttacccc

SEQ ID NO: 17655 - DNA, 20 bp, Unknown
  RNA secondary structure sequence
gcccttctccgagctgtgcg

SEQ ID NO: 17656 - DNA, 20 bp, Unknown
  RNA secondary structure sequence
tgtgacggcgcgtttctatt

SEQ ID NO: 17657 - DNA, 20 bp, Unknown
  RNA secondary structure sequence
gatggcggcctcatgcttgg

SEQ ID NO: 17658 - DNA, 20 bp, Unknown
  RNA secondary structure sequence
cgcgcccctagaacgctttg

SEQ ID NO: 17659 - DNA, 20 bp, Unknown
  RNA secondary structure sequence
aaacagaaattccaccagcc

SEQ ID NO: 17660 - DNA, 20 bp, Unknown
  RNA secondary structure sequence
gggtccctgagcctcagctg

SEQ ID NO: 17661 - DNA, 20 bp, Unknown
  RNA secondary structure sequence
catgaggggtgacagaggcc

SEQ ID NO: 17662 - DNA, 20 bp, Unknown
  RNA secondary structure sequence
cggtggaaccgaggagaacg

SEQ ID NO: 17663 - DNA, 20 bp, Unknown
  RNA secondary structure sequence
ccctcccgggctgcggctgc

SEQ ID NO: 17664 - DNA, 20 bp, Unknown
  RNA secondary structure sequence
ccagcagcggcagcgggagc

SEQ ID NO: 17665 - DNA, 20 bp, Unknown
  RNA secondary structure sequence
cccttagtgagctgtatttt

SEQ ID NO: 17666 - DNA, 20 bp, Unknown
  RNA secondary structure sequence
gcgattctctgctgccagag

SEQ ID NO: 17667 - DNA, 20 bp, Unknown
  RNA secondary structure sequence
ggttttgctcagattggtgt

SEQ ID NO: 17668 - DNA, 20 bp, Unknown
  RNA secondary structure sequence
cagggaactaccttgagtat

SEQ ID NO: 17669 - DNA, 20 bp, Unknown
  RNA secondary structure sequence
ctccctttctcctcctcctc

SEQ ID NO: 17670 - DNA, 20 bp, Unknown
  RNA secondary structure sequence
gtgacttcccccaaccgcag

SEQ ID NO: 17671 - DNA, 20 bp, Unknown
  RNA secondary structure sequence
tcacagctgctgttgtctgc

SEQ ID NO: 17672 - DNA, 20 bp, Unknown
  RNA secondary structure sequence
ctgggacgggggaaaggaga

SEQ ID NO: 17673 - DNA, 20 bp, Unknown
  RNA secondary structure sequence
gggagtgtctgggcgctcag

SEQ ID NO: 17674 - DNA, 20 bp, Unknown
  RNA secondary structure sequence
gggactgccagtgtgtggag

SEQ ID NO: 17675 - DNA, 20 bp, Unknown
  RNA secondary structure sequence
ccttccgggtcactgccatg

SEQ ID NO: 17676 - DNA, 20 bp, Unknown
  RNA secondary structure sequence
tcctgcctggattccacagc

SEQ ID NO: 17677 - DNA, 20 bp, Unknown
  RNA secondary structure sequence
tggtgatcactaggtgccaa

SEQ ID NO: 17678 - DNA, 20 bp, Unknown
  RNA secondary structure sequence
cagatctcgcgaggttcagg

SEQ ID NO: 17679 - DNA, 20 bp, Unknown
  RNA secondary structure sequence
gcggtagtgacggtggcgtt

SEQ ID NO: 17680 - DNA, 20 bp, Unknown
  RNA secondary structure sequence
tctcggaacgcgccgcagaa

SEQ ID NO: 17681 - DNA, 20 bp, Unknown
  RNA secondary structure sequence
caagtttagggaagtgaaag

SEQ ID NO: 17682 - DNA, 20 bp, Unknown
  RNA secondary structure sequence
caatcttcgctcctccaatc

SEQ ID NO: 17683 - DNA, 20 bp, Unknown
  RNA secondary structure sequence
ccatcatggcggatcaaggt

SEQ ID NO: 17684 - DNA, 20 bp, Unknown
  RNA secondary structure sequence
cgcgccggagcgggaccgac

SEQ ID NO: 17685 - DNA, 20 bp, Unknown
  RNA secondary structure sequence
acccacataaaatctacgag

SEQ ID NO: 17686 - DNA, 20 bp, Unknown
  RNA secondary structure sequence
tctccaggagcaacctctac

SEQ ID NO: 17687 - DNA, 20 bp, Unknown
  RNA secondary structure sequence
acagaatggctgcacattaa

SEQ ID NO: 17688 - DNA, 20 bp, Unknown
  RNA secondary structure sequence
cccgggtctcggacaggcgg

SEQ ID NO: 17689 - DNA, 20 bp, Unknown
  RNA secondary structure sequence
cctcgggagtaaatatcttc

SEQ ID NO: 17690 - DNA, 20 bp, Unknown
  RNA secondary structure sequence
tgcaagcctagttccaaccc

SEQ ID NO: 17691 - DNA, 20 bp, Unknown
  RNA secondary structure sequence
gccttgtctacctcttgccc

SEQ ID NO: 17692 - DNA, 20 bp, Unknown
  RNA secondary structure sequence
ttcccttccgcccccttctc

SEQ ID NO: 17693 - DNA, 20 bp, Unknown
  RNA secondary structure sequence
cggagtgttggtgagtgacg

SEQ ID NO: 17694 - DNA, 20 bp, Unknown
  RNA secondary structure sequence
gactctatatatacagaggg

SEQ ID NO: 17695 - DNA, 20 bp, Unknown
  RNA secondary structure sequence
gagggagcttcctagctggg

SEQ ID NO: 17696 - DNA, 20 bp, Unknown
  RNA secondary structure sequence
cccgggaggagagggcggag

SEQ ID NO: 17697 - DNA, 20 bp, Unknown
  RNA secondary structure sequence
ggacgggagccggaccctgg

SEQ ID NO: 17698 - DNA, 20 bp, Unknown
  RNA secondary structure sequence
acctcccccagaggctgcag

SEQ ID NO: 17699 - DNA, 20 bp, Unknown
  RNA secondary structure sequence
cccggacatgatggcacatg

SEQ ID NO: 17700 - DNA, 20 bp, Unknown
  RNA secondary structure sequence
gggcacgacgagaaagtccg

SEQ ID NO: 17701 - DNA, 20 bp, Unknown
  RNA secondary structure sequence
gcacacagagcaccagctcc

SEQ ID NO: 17702 - DNA, 20 bp, Unknown
  RNA secondary structure sequence
ctcccagggcgatgcaaagc

SEQ ID NO: 17703 - DNA, 20 bp, Unknown
  RNA secondary structure sequence
agcggagagcaaagtgggct

SEQ ID NO: 17704 - DNA, 20 bp, Unknown
  RNA secondary structure sequence
accctgtgcagccaggagcc

SEQ ID NO: 17705 - DNA, 20 bp, Unknown
  RNA secondary structure sequence
tcatgctcgcttcacggagg

SEQ ID NO: 17706 - DNA, 20 bp, Unknown
  RNA secondary structure sequence
ggacagggaagggttaaagg

SEQ ID NO: 17707 - DNA, 20 bp, Unknown
  RNA secondary structure sequence
ttctcggagagcacggaact

SEQ ID NO: 17708 - DNA, 20 bp, Unknown
  RNA secondary structure sequence
cacgcctgccaggagcaagc

SEQ ID NO: 17709 - DNA, 20 bp, Unknown
  RNA secondary structure sequence
ggcaatggggaactctgagg

SEQ ID NO: 17710 - DNA, 20 bp, Unknown
  RNA secondary structure sequence
cacagacatctcctttcccg

SEQ ID NO: 17711 - DNA, 20 bp, Unknown
  RNA secondary structure sequence
ctgtaggacgacctcgggtc

SEQ ID NO: 17712 - DNA, 20 bp, Unknown
  RNA secondary structure sequence
taacggcaatgcggctgcaa

SEQ ID NO: 17713 - DNA, 20 bp, Unknown
  RNA secondary structure sequence
ccagcatcttggcctctgtg

SEQ ID NO: 17714 - DNA, 20 bp, Unknown
  RNA secondary structure sequence
gatagctgcttggtctgaag

SEQ ID NO: 17715 - DNA, 20 bp, Unknown
  RNA secondary structure sequence
aggaggagatcatcgagctc

SEQ ID NO: 17716 - DNA, 20 bp, Unknown
  RNA secondary structure sequence
gtcagcagaagagataaaag

SEQ ID NO: 17717 - DNA, 20 bp, Unknown
  RNA secondary structure sequence
tcaggctccgtgctgttgga

SEQ ID NO: 17718 - DNA, 20 bp, Unknown
  RNA secondary structure sequence
gaagaaggcaggggccctta

SEQ ID NO: 17719 - DNA, 20 bp, Unknown
  RNA secondary structure sequence
acggccctgaccgcccgcgg

SEQ ID NO: 17720 - DNA, 20 bp, Unknown
  RNA secondary structure sequence
ggcgccgacatcgcgacagc

SEQ ID NO: 17721 - DNA, 20 bp, Unknown
  RNA secondary structure sequence
cccgggtgctactttatggg

SEQ ID NO: 17722 - DNA, 20 bp, Unknown
  RNA secondary structure sequence
ataagtaatgactttcagtg

SEQ ID NO: 17723 - DNA, 20 bp, Unknown
  RNA secondary structure sequence
cctcgcagctcgcattcgga

SEQ ID NO: 17724 - DNA, 20 bp, Unknown
  RNA secondary structure sequence
acccctcggtggagataaag

SEQ ID NO: 17725 - DNA, 20 bp, Unknown
  RNA secondary structure sequence
tgtcgctgaagcagatgagt

SEQ ID NO: 17726 - DNA, 20 bp, Unknown
  RNA secondary structure sequence
gcgtagcgccagggcctgag

SEQ ID NO: 17727 - DNA, 20 bp, Unknown
  RNA secondary structure sequence
gctgggcggatggagcagga

SEQ ID NO: 17728 - DNA, 20 bp, Unknown
  RNA secondary structure sequence
ccgggaagatggcggccgtg

SEQ ID NO: 17729 - DNA, 20 bp, Unknown
  RNA secondary structure sequence
gtggggtacgagcttcctgc

SEQ ID NO: 17730 - DNA, 20 bp, Unknown
  RNA secondary structure sequence
gtccagagtccagggactcg

SEQ ID NO: 17731 - DNA, 20 bp, Unknown
  RNA secondary structure sequence
ggagagactaccgtcctgga

SEQ ID NO: 17732 - DNA, 20 bp, Unknown
  RNA secondary structure sequence
cccagcaaagagcaacacag

SEQ ID NO: 17733 - DNA, 20 bp, Unknown
  RNA secondary structure sequence
ctgatttttagaactccaca

SEQ ID NO: 17734 - DNA, 20 bp, Unknown
  RNA secondary structure sequence
aaaaatcaactgccctgctg

SEQ ID NO: 17735 - DNA, 20 bp, Unknown
  RNA secondary structure sequence
ctatcgcctccctctagtct

SEQ ID NO: 17736 - DNA, 20 bp, Unknown
  RNA secondary structure sequence
taaatgaacttgtctggttt

SEQ ID NO: 17737 - DNA, 20 bp, Unknown
  RNA secondary structure sequence
gggtgaccttggttaatatt

SEQ ID NO: 17738 - DNA, 20 bp, Unknown
  RNA secondary structure sequence
gcgggccgcgcggcgcattt

SEQ ID NO: 17739 - DNA, 20 bp, Unknown
  RNA secondary structure sequence
gaggggcggcaacctcctgc

SEQ ID NO: 17740 - DNA, 20 bp, Unknown
  RNA secondary structure sequence
ctgctgctgctcactcagtt

SEQ ID NO: 17741 - DNA, 20 bp, Unknown
  RNA secondary structure sequence
ttctgagccaggtacaatga

SEQ ID NO: 17742 - DNA, 20 bp, Unknown
  RNA secondary structure sequence
ttgaggagagcttgaggaga

SEQ ID NO: 17743 - DNA, 20 bp, Unknown
  RNA secondary structure sequence
gcacattcggcccccgcgac

SEQ ID NO: 17744 - DNA, 20 bp, Unknown
  RNA secondary structure sequence
tggctttgtgagtgcgggca

SEQ ID NO: 17745 - DNA, 20 bp, Unknown
  RNA secondary structure sequence
gcattccccacacaacaccc

SEQ ID NO: 17746 - DNA, 20 bp, Unknown
  RNA secondary structure sequence
cccccgagcacgaagttggc

SEQ ID NO: 17747 - DNA, 20 bp, Unknown
  RNA secondary structure sequence
aaactgggctcccactcagc

SEQ ID NO: 17748 - DNA, 20 bp, Unknown
  RNA secondary structure sequence
ctgcacctcaaccgtgcgga

SEQ ID NO: 17749 - DNA, 20 bp, Unknown
  RNA secondary structure sequence
cagacccgccgccatgacgc

SEQ ID NO: 17750 - DNA, 20 bp, Unknown
  RNA secondary structure sequence
agggcgaggggcggggagcg

SEQ ID NO: 17751 - DNA, 20 bp, Unknown
  RNA secondary structure sequence
acacctgaaagcagcaccaa

SEQ ID NO: 17752 - DNA, 20 bp, Unknown
  RNA secondary structure sequence
cagcgacagagccaaaatca

SEQ ID NO: 17753 - DNA, 20 bp, Unknown
  RNA secondary structure sequence
cttggtgcccacctgtgcgc

SEQ ID NO: 17754 - DNA, 20 bp, Unknown
  RNA secondary structure sequence
cccaggccgcggcccagctg

SEQ ID NO: 17755 - DNA, 20 bp, Unknown
  RNA secondary structure sequence
gacgtcgccgagcgcgaggg

SEQ ID NO: 17756 - DNA, 20 bp, Unknown
  RNA secondary structure sequence
cgtcacgggcctcagctggg

SEQ ID NO: 17757 - DNA, 20 bp, Unknown
  RNA secondary structure sequence
cccgagggacgagtgacagc

SEQ ID NO: 17758 - DNA, 20 bp, Unknown
  RNA secondary structure sequence
accgccgctccggcctcccg

SEQ ID NO: 17759 - DNA, 20 bp, Unknown
  RNA secondary structure sequence
gggtctgactgacttgcagc

SEQ ID NO: 17760 - DNA, 20 bp, Unknown
  RNA secondary structure sequence
ggaaaatcctgttgtgaata

SEQ ID NO: 17761 - DNA, 20 bp, Unknown
  RNA secondary structure sequence
tcatttatctttattcttaa

SEQ ID NO: 17762 - DNA, 20 bp, Unknown
  RNA secondary structure sequence
cactgtgagcgattcggaaa

SEQ ID NO: 17763 - DNA, 20 bp, Unknown
  RNA secondary structure sequence
cgggtgtcgagggcgggttg

SEQ ID NO: 17764 - DNA, 20 bp, Unknown
  RNA secondary structure sequence
aggctgagaagatcgtgagg

SEQ ID NO: 17765 - DNA, 20 bp, Unknown
  RNA secondary structure sequence
gaggagctaagcgtcatcgc

SEQ ID NO: 17766 - DNA, 20 bp, Unknown
  RNA secondary structure sequence
acgcagcgagcgatcggccg

SEQ ID NO: 17767 - DNA, 20 bp, Unknown
  RNA secondary structure sequence
tgcgctcggctccgcctggt

SEQ ID NO: 17768 - DNA, 20 bp, Unknown
  RNA secondary structure sequence
ctggtgactcggctgcagaa

SEQ ID NO: 17769 - DNA, 20 bp, Unknown
  RNA secondary structure sequence
ggctgtgggtgccgctgagc

SEQ ID NO: 17770 - DNA, 20 bp, Unknown
  RNA secondary structure sequence
agatgaagctgaacatctcc

SEQ ID NO: 17771 - DNA, 20 bp, Unknown
  RNA secondary structure sequence
gccccccgtcccggcccccc

SEQ ID NO: 17772 - DNA, 20 bp, Unknown
  RNA secondary structure sequence
ttttcgctcgtcgactgcgg

SEQ ID NO: 17773 - DNA, 20 bp, Unknown
  RNA secondary structure sequence
actgcttacccacaatctgc

SEQ ID NO: 17774 - DNA, 20 bp, Unknown
  RNA secondary structure sequence
cccggaagtggcctgaaggc

SEQ ID NO: 17775 - DNA, 20 bp, Unknown
  RNA secondary structure sequence
gcctctctcttgctgcctag

SEQ ID NO: 17776 - DNA, 20 bp, Unknown
  RNA secondary structure sequence
ccgccatgagggagatcgtg

SEQ ID NO: 17777 - DNA, 20 bp, Unknown
  RNA secondary structure sequence
gtctgtggtggcgcgggcga

SEQ ID NO: 17778 - DNA, 20 bp, Unknown
  RNA secondary structure sequence
tcctctcaccggcccctgga

SEQ ID NO: 17779 - DNA, 20 bp, Unknown
  RNA secondary structure sequence
gactcaagttcttcagttca

SEQ ID NO: 17780 - DNA, 20 bp, Unknown
  RNA secondary structure sequence
tctgcttagcgacttggggt

SEQ ID NO: 17781 - DNA, 20 bp, Unknown
  RNA secondary structure sequence
cccacgacatcttcgcaggg

SEQ ID NO: 17782 - DNA, 20 bp, Unknown
  RNA secondary structure sequence
ccggcgccggaagtgagctg

SEQ ID NO: 17783 - DNA, 20 bp, Unknown
  RNA secondary structure sequence
ttgcgacataggccgagcag

SEQ ID NO: 17784 - DNA, 20 bp, Unknown
  RNA secondary structure sequence
gttcgcggagttcgcccgct

SEQ ID NO: 17785 - DNA, 20 bp, Unknown
  RNA secondary structure sequence
agggagctgagtgtttacag

SEQ ID NO: 17786 - DNA, 20 bp, Unknown
  RNA secondary structure sequence
gggccaaacgccggcctaga

SEQ ID NO: 17787 - DNA, 20 bp, Unknown
  RNA secondary structure sequence
gtctttctcaacggcaaatt

SEQ ID NO: 17788 - DNA, 20 bp, Unknown
  RNA secondary structure sequence
cgcgctgagaccgggaccgg

SEQ ID NO: 17789 - DNA, 20 bp, Unknown
  RNA secondary structure sequence
gaagctaaggctgcgttggg

SEQ ID NO: 17790 - DNA, 20 bp, Unknown
  RNA secondary structure sequence
agctcagcccagcccagccc

SEQ ID NO: 17791 - DNA, 20 bp, Unknown
  RNA secondary structure sequence
gagcggctgcttcctccggg

SEQ ID NO: 17792 - DNA, 20 bp, Unknown
  RNA secondary structure sequence
cctatgcagcctggtttcta

SEQ ID NO: 17793 - DNA, 20 bp, Unknown
  RNA secondary structure sequence
ggcccacagtcaccgccgct

SEQ ID NO: 17794 - DNA, 20 bp, Unknown
  RNA secondary structure sequence
agctggaacccatctcccgt

SEQ ID NO: 17795 - DNA, 20 bp, Unknown
  RNA secondary structure sequence
cgccgctgtccccgctgcgc

SEQ ID NO: 17796 - DNA, 20 bp, Unknown
  RNA secondary structure sequence
actctctttgtgggcaacct

SEQ ID NO: 17797 - DNA, 20 bp, Unknown
  RNA secondary structure sequence
gggcctgggaggcggcccgg

SEQ ID NO: 17798 - DNA, 20 bp, Unknown
  RNA secondary structure sequence
ctccccgcctcgcagagttg

SEQ ID NO: 17799 - DNA, 20 bp, Unknown
  RNA secondary structure sequence
ctccagacccgcacgccgcg

SEQ ID NO: 17800 - DNA, 20 bp, Unknown
  RNA secondary structure sequence
ctcccaaccccaagagccca

SEQ ID NO: 17801 - DNA, 20 bp, Unknown
  RNA secondary structure sequence
acccgctttcctcaactctc

SEQ ID NO: 17802 - DNA, 20 bp, Unknown
  RNA secondary structure sequence
gtggtggcggctgaggcggc

SEQ ID NO: 17803 - DNA, 20 bp, Unknown
  RNA secondary structure sequence
gcagcggctagggcggcggt

SEQ ID NO: 17804 - DNA, 20 bp, Unknown
  RNA secondary structure sequence
agcagccaacacaccagccc

SEQ ID NO: 17805 - DNA, 20 bp, Unknown
  RNA secondary structure sequence
ttaaagttcctcgtaatttt

SEQ ID NO: 17806 - DNA, 20 bp, Unknown
  RNA secondary structure sequence
gcagcacacatcggtccacc

SEQ ID NO: 17807 - DNA, 20 bp, Unknown
  RNA secondary structure sequence
gaacttttgctgaagcgaag

SEQ ID NO: 17808 - DNA, 20 bp, Unknown
  RNA secondary structure sequence
acacgggctcattgcggtgt

SEQ ID NO: 17809 - DNA, 20 bp, Unknown
  RNA secondary structure sequence
ggttccaagaaggctgtgac

SEQ ID NO: 17810 - DNA, 20 bp, Unknown
  RNA secondary structure sequence
aaatggcgcctccggccccc

SEQ ID NO: 17811 - DNA, 20 bp, Unknown
  RNA secondary structure sequence
tgcctggagggcgggaggga

SEQ ID NO: 17812 - DNA, 20 bp, Unknown
  RNA secondary structure sequence
gagccagagtctgtcaggcg

SEQ ID NO: 17813 - DNA, 20 bp, Unknown
  RNA secondary structure sequence
ccttcgcggtgcccactcca

SEQ ID NO: 17814 - DNA, 20 bp, Unknown
  RNA secondary structure sequence
ccagctcccaggaaagctgg

SEQ ID NO: 17815 - DNA, 20 bp, Unknown
  RNA secondary structure sequence
caactggcacaagcgccgca

SEQ ID NO: 17816 - DNA, 20 bp, Unknown
  RNA secondary structure sequence
gtcggaagggcgtcgcgcgg

SEQ ID NO: 17817 - DNA, 20 bp, Unknown
  RNA secondary structure sequence
gatggacgtactggtgtctg

SEQ ID NO: 17818 - DNA, 20 bp, Unknown
  RNA secondary structure sequence
ggatgtgggcggtcgcagct

SEQ ID NO: 17819 - DNA, 20 bp, Unknown
  RNA secondary structure sequence
cagctggttgtgggagagtt

SEQ ID NO: 17820 - DNA, 20 bp, Unknown
  RNA secondary structure sequence
ggtcccgggcgcgtttcggg

SEQ ID NO: 17821 - DNA, 20 bp, Unknown
  RNA secondary structure sequence
caccacagtaggtccctcgg

SEQ ID NO: 17822 - DNA, 20 bp, Unknown
  RNA secondary structure sequence
catgcatgctcccgggaagg

SEQ ID NO: 17823 - DNA, 20 bp, Unknown
  RNA secondary structure sequence
ctttcctcgcacagccaggc

SEQ ID NO: 17824 - DNA, 20 bp, Unknown
  RNA secondary structure sequence
aaaacgcgcggggggcgtcc

SEQ ID NO: 17825 - DNA, 20 bp, Unknown
  RNA secondary structure sequence
ccgagctgtcgccgccgccg

SEQ ID NO: 17826 - DNA, 20 bp, Unknown
  RNA secondary structure sequence
acgaccacgcctgtgccgct

SEQ ID NO: 17827 - DNA, 20 bp, Unknown
  RNA secondary structure sequence
gctccgaccgcgagcgtctc

SEQ ID NO: 17828 - DNA, 20 bp, Unknown
  RNA secondary structure sequence
tccagaggccatggacaggc

SEQ ID NO: 17829 - DNA, 20 bp, Unknown
  RNA secondary structure sequence
gcggacgccatggcgaccaa

SEQ ID NO: 17830 - DNA, 20 bp, Unknown
  RNA secondary structure sequence
cgacttccctaagggcattt

SEQ ID NO: 17831 - DNA, 20 bp, Unknown
  RNA secondary structure sequence
ccatgaagttcaatcccttc

SEQ ID NO: 17832 - DNA, 20 bp, Unknown
  RNA secondary structure sequence
cagccatgtctctagtgatc

SEQ ID NO: 17833 - DNA, 20 bp, Unknown
  RNA secondary structure sequence
ggatccctagatcccgtggg

SEQ ID NO: 17834 - DNA, 20 bp, Unknown
  RNA secondary structure sequence
tgggtttggctggcctcgat

SEQ ID NO: 17835 - DNA, 20 bp, Unknown
  RNA secondary structure sequence
ggaaacggggaagtcaggtg

SEQ ID NO: 17836 - DNA, 20 bp, Unknown
  RNA secondary structure sequence
aggccaagtcgcgctcgtcc

SEQ ID NO: 17837 - DNA, 20 bp, Unknown
  RNA secondary structure sequence
actctcttccagcctccgac

SEQ ID NO: 17838 - DNA, 20 bp, Unknown
  RNA secondary structure sequence
tggaaggaggggccgtgagg

SEQ ID NO: 17839 - DNA, 20 bp, Unknown
  RNA secondary structure sequence
cggttgctgcttgctgtgag

SEQ ID NO: 17840 - DNA, 20 bp, Unknown
  RNA secondary structure sequence
tctcgcggggcggctgcggt

SEQ ID NO: 17841 - DNA, 20 bp, Unknown
  RNA secondary structure sequence
gggcggagaggcggcggtgg

SEQ ID NO: 17842 - DNA, 20 bp, Unknown
  RNA secondary structure sequence
gttcatttgagtagatcgga

SEQ ID NO: 17843 - DNA, 20 bp, Unknown
  RNA secondary structure sequence
cccaatccttcgccatccga

SEQ ID NO: 17844 - DNA, 20 bp, Unknown
  RNA secondary structure sequence
agggttggtgggagttgcga

SEQ ID NO: 17845 - DNA, 20 bp, Unknown
  RNA secondary structure sequence
agtcagagttgagagacaga

SEQ ID NO: 17846 - DNA, 20 bp, Unknown
  RNA secondary structure sequence
tccgacccccatttcggctg

SEQ ID NO: 17847 - DNA, 20 bp, Unknown
  RNA secondary structure sequence
ccctgtcgccaccgaggtcg

SEQ ID NO: 17848 - DNA, 20 bp, Unknown
  RNA secondary structure sequence
cggacgccgggaggaggaga

SEQ ID NO: 17849 - DNA, 20 bp, Unknown
  RNA secondary structure sequence
gctattccgctgtaacagct

SEQ ID NO: 17850 - DNA, 20 bp, Unknown
  RNA secondary structure sequence
tagcgagcgagctcccaggc

SEQ ID NO: 17851 - DNA, 20 bp, Unknown
  RNA secondary structure sequence
cgacctcgcgagccttccgc

SEQ ID NO: 17852 - DNA, 20 bp, Unknown
  RNA secondary structure sequence
gcttgtggcgtctccgccgc

SEQ ID NO: 17853 - DNA, 20 bp, Unknown
  RNA secondary structure sequence
tcccgacccctgggagcgcc

SEQ ID NO: 17854 - DNA, 20 bp, Unknown
  RNA secondary structure sequence
tgatcagatccgccccggct

SEQ ID NO: 17855 - DNA, 20 bp, Unknown
  RNA secondary structure sequence
tctcaaactgtgagtaacta

SEQ ID NO: 17856 - DNA, 20 bp, Unknown
  RNA secondary structure sequence
ccgttagcggcgttggggtt

SEQ ID NO: 17857 - DNA, 20 bp, Unknown
  RNA secondary structure sequence
caaggttgaggccgagttcc

SEQ ID NO: 17858 - DNA, 20 bp, Unknown
  RNA secondary structure sequence
tcctcgcttcctccgcggtc

SEQ ID NO: 17859 - DNA, 20 bp, Unknown
  RNA secondary structure sequence
tgatgcttccctgctccctc

SEQ ID NO: 17860 - DNA, 20 bp, Unknown
  RNA secondary structure sequence
gcaccctcgcgggcggaccc

SEQ ID NO: 17861 - DNA, 20 bp, Unknown
  RNA secondary structure sequence
gaagcggcgtcggcggctgg

SEQ ID NO: 17862 - DNA, 20 bp, Unknown
  RNA secondary structure sequence
aaatggcggcctacctgcag

SEQ ID NO: 17863 - DNA, 20 bp, Unknown
  RNA secondary structure sequence
ctgcagcgcggagcagaaag

SEQ ID NO: 17864 - DNA, 20 bp, Unknown
  RNA secondary structure sequence
cggtgtgggcgcaggctgca

SEQ ID NO: 17865 - DNA, 20 bp, Unknown
  RNA secondary structure sequence
tcccttcttcctctcccttt

SEQ ID NO: 17866 - DNA, 20 bp, Unknown
  RNA secondary structure sequence
cccgactctgtcctggacag

SEQ ID NO: 17867 - DNA, 20 bp, Unknown
  RNA secondary structure sequence
ggttctggaaacgccgggag

SEQ ID NO: 17868 - DNA, 20 bp, Unknown
  RNA secondary structure sequence
cgccggtgtccgcccgtgtc

SEQ ID NO: 17869 - DNA, 20 bp, Unknown
  RNA secondary structure sequence
ttcaggaaagcaagcagccc

SEQ ID NO: 17870 - DNA, 20 bp, Unknown
  RNA secondary structure sequence
gcgattgagtggccgaggaa

SEQ ID NO: 17871 - DNA, 20 bp, Unknown
  RNA secondary structure sequence
aaaatgacgaacacaaaggg

SEQ ID NO: 17872 - DNA, 20 bp, Unknown
  RNA secondary structure sequence
gattgtggtgttcagcatta

SEQ ID NO: 17873 - DNA, 20 bp, Unknown
  RNA secondary structure sequence
ctgtggagagccgggtgcga

SEQ ID NO: 17874 - DNA, 20 bp, Unknown
  RNA secondary structure sequence
ggaggacttgcaacactccg

SEQ ID NO: 17875 - DNA, 20 bp, Unknown
  RNA secondary structure sequence
tccatccatcttaaaggaag

SEQ ID NO: 17876 - DNA, 20 bp, Unknown
  RNA secondary structure sequence
ggcggcggcggcggtggctg

SEQ ID NO: 17877 - DNA, 20 bp, Unknown
  RNA secondary structure sequence
cccggatgtcagccccccgc

SEQ ID NO: 17878 - DNA, 20 bp, Unknown
  RNA secondary structure sequence
agtgttagcggggaacgctg

SEQ ID NO: 17879 - DNA, 20 bp, Unknown
  RNA secondary structure sequence
gcctccgccgcggctcgtgg

SEQ ID NO: 17880 - DNA, 20 bp, Unknown
  RNA secondary structure sequence
tctagacttcagtttcagtt

SEQ ID NO: 17881 - DNA, 20 bp, Unknown
  RNA secondary structure sequence
gaactgagaattacaccatc

SEQ ID NO: 17882 - DNA, 20 bp, Unknown
  RNA secondary structure sequence
ctggaacttccgcctggcag

SEQ ID NO: 17883 - DNA, 20 bp, Unknown
  RNA secondary structure sequence
cgcctcttgtgaggcgcgcg

SEQ ID NO: 17884 - DNA, 20 bp, Unknown
  RNA secondary structure sequence
aggcccgggtgcgaggaggg

SEQ ID NO: 17885 - DNA, 20 bp, Unknown
  RNA secondary structure sequence
tgctcaaaccgagttctgga

SEQ ID NO: 17886 - DNA, 20 bp, Unknown
  RNA secondary structure sequence
gtcgcaaatcctcctaagcc

SEQ ID NO: 17887 - DNA, 20 bp, Unknown
  RNA secondary structure sequence
tctagaaccgtagccagaca

SEQ ID NO: 17888 - DNA, 20 bp, Unknown
  RNA secondary structure sequence
ggctccttcctgcggtgctt

SEQ ID NO: 17889 - DNA, 20 bp, Unknown
  RNA secondary structure sequence
tcgcaccaaaaccgtgaaga

SEQ ID NO: 17890 - DNA, 20 bp, Unknown
  RNA secondary structure sequence
caaccagctagcgtgcaagg

SEQ ID NO: 17891 - DNA, 20 bp, Unknown
  RNA secondary structure sequence
tctccgcgcctgacccctcc

SEQ ID NO: 17892 - DNA, 20 bp, Unknown
  RNA secondary structure sequence
cgtgctctcgcgagatttgg

SEQ ID NO: 17893 - DNA, 20 bp, Unknown
  RNA secondary structure sequence
tccctcgggtccagttcagc

SEQ ID NO: 17894 - DNA, 20 bp, Unknown
  RNA secondary structure sequence
agtagctcctgggacatcgc

SEQ ID NO: 17895 - DNA, 20 bp, Unknown
  RNA secondary structure sequence
atttcaagagtggccaggtg

SEQ ID NO: 17896 - DNA, 20 bp, Unknown
  RNA secondary structure sequence
gagctccgcgtgtagctacg

SEQ ID NO: 17897 - DNA, 20 bp, Unknown
  RNA secondary structure sequence
agaaacataagtcccgcgcg

SEQ ID NO: 17898 - DNA, 20 bp, Unknown
  RNA secondary structure sequence
atgctttgttaacagtgaag

SEQ ID NO: 17899 - DNA, 20 bp, Unknown
  RNA secondary structure sequence
atggcgacggagcatcccga

SEQ ID NO: 17900 - DNA, 20 bp, Unknown
  RNA secondary structure sequence
ccgcgctcggcacgacatga

SEQ ID NO: 17901 - DNA, 20 bp, Unknown
  RNA secondary structure sequence
gtgagggacaagcgtttgcc

SEQ ID NO: 17902 - DNA, 20 bp, Unknown
  RNA secondary structure sequence
gctggcgaggcgcgtgggac

SEQ ID NO: 17903 - DNA, 20 bp, Unknown
  RNA secondary structure sequence
ggaactgggactccctgtgg

SEQ ID NO: 17904 - DNA, 20 bp, Unknown
  RNA secondary structure sequence
tctctcgccaggcgtcctcg

SEQ ID NO: 17905 - DNA, 20 bp, Unknown
  RNA secondary structure sequence
gcggcggcggcggctgcagc

SEQ ID NO: 17906 - DNA, 20 bp, Unknown
  RNA secondary structure sequence
ttgtgtagcctgaggcggcg

SEQ ID NO: 17907 - DNA, 20 bp, Unknown
  RNA secondary structure sequence
gaacctcaagagagggaggt

SEQ ID NO: 17908 - DNA, 20 bp, Unknown
  RNA secondary structure sequence
cccaggggccggcgcacgaa

SEQ ID NO: 17909 - DNA, 20 bp, Unknown
  RNA secondary structure sequence
agagaaggtctcattcggtg

SEQ ID NO: 17910 - DNA, 20 bp, Unknown
  RNA secondary structure sequence
caccatcgagccgggaagat

SEQ ID NO: 17911 - DNA, 20 bp, Unknown
  RNA secondary structure sequence
ggccgcaccgtgtgggctgt

SEQ ID NO: 17912 - DNA, 20 bp, Unknown
  RNA secondary structure sequence
ggcgcctggctgccaggcta

SEQ ID NO: 17913 - DNA, 20 bp, Unknown
  RNA secondary structure sequence
ccgagcgaacttggcccagg

SEQ ID NO: 17914 - DNA, 20 bp, Unknown
  RNA secondary structure sequence
gagccggggtcccggtagct

SEQ ID NO: 17915 - DNA, 20 bp, Unknown
  RNA secondary structure sequence
tggcacgggttcgcacaccc

SEQ ID NO: 17916 - DNA, 20 bp, Unknown
  RNA secondary structure sequence
aacattgaccaccacacact

SEQ ID NO: 17917 - DNA, 20 bp, Unknown
  RNA secondary structure sequence
gcgagccggaggaggccgcg

SEQ ID NO: 17918 - DNA, 20 bp, Unknown
  RNA secondary structure sequence
cccctcgcccttggcagcct

SEQ ID NO: 17919 - DNA, 20 bp, Unknown
  RNA secondary structure sequence
ccccgggagccgcactccag

SEQ ID NO: 17920 - DNA, 20 bp, Unknown
  RNA secondary structure sequence
ctgacggattcgtactacaa

SEQ ID NO: 17921 - DNA, 20 bp, Unknown
  RNA secondary structure sequence
cagagaggcgctgctgacac

SEQ ID NO: 17922 - DNA, 20 bp, Unknown
  RNA secondary structure sequence
agggccggggtcttgggagt

SEQ ID NO: 17923 - DNA, 20 bp, Unknown
  RNA secondary structure sequence
ctgaactggctcctggggcc

SEQ ID NO: 17924 - DNA, 20 bp, Unknown
  RNA secondary structure sequence
ctccctagccgatgggaaat

SEQ ID NO: 17925 - DNA, 20 bp, Unknown
  RNA secondary structure sequence
tacactggctttttgattct

SEQ ID NO: 17926 - DNA, 20 bp, Unknown
  RNA secondary structure sequence
gaggaagggagggggagaga

SEQ ID NO: 17927 - DNA, 20 bp, Unknown
  RNA secondary structure sequence
ccttgcttgctcgcgctttc

SEQ ID NO: 17928 - DNA, 20 bp, Unknown
  RNA secondary structure sequence
agtggactccggggctccta

SEQ ID NO: 17929 - DNA, 20 bp, Unknown
  RNA secondary structure sequence
ggagacccccacattcaaga

SEQ ID NO: 17930 - DNA, 20 bp, Unknown
  RNA secondary structure sequence
ctgtgaggtgttcagcatta

SEQ ID NO: 17931 - DNA, 20 bp, Unknown
  RNA secondary structure sequence
ctctcctccttccccgctgc

SEQ ID NO: 17932 - DNA, 20 bp, Unknown
  RNA secondary structure sequence
gtccggactctttttcctct

SEQ ID NO: 17933 - DNA, 20 bp, Unknown
  RNA secondary structure sequence
ggaggctgcccttcggggtc

SEQ ID NO: 17934 - DNA, 20 bp, Unknown
  RNA secondary structure sequence
atatttgagtaaagtgagtt

SEQ ID NO: 17935 - DNA, 20 bp, Unknown
  RNA secondary structure sequence
gcgtgggccaaacctgcgcc

SEQ ID NO: 17936 - DNA, 20 bp, Unknown
  RNA secondary structure sequence
cccagataatcttccaatgg

SEQ ID NO: 17937 - DNA, 20 bp, Unknown
  RNA secondary structure sequence
accgggagacaggagcgggg

SEQ ID NO: 17938 - DNA, 20 bp, Unknown
  RNA secondary structure sequence
accttccaggactgggccca

SEQ ID NO: 17939 - DNA, 20 bp, Unknown
  RNA secondary structure sequence
gcgggtgacgcgacgacggc

SEQ ID NO: 17940 - DNA, 20 bp, Unknown
  RNA secondary structure sequence
catcgcgggaggcgcatggc

SEQ ID NO: 17941 - DNA, 20 bp, Unknown
  RNA secondary structure sequence
agctcagctgatcggttgcc

SEQ ID NO: 17942 - DNA, 20 bp, Unknown
  RNA secondary structure sequence
actgccgtgatgctgaagtt

SEQ ID NO: 17943 - DNA, 20 bp, Unknown
  RNA secondary structure sequence
ggcgacggcgaggagatagt

SEQ ID NO: 17944 - DNA, 20 bp, Unknown
  RNA secondary structure sequence
cgcctcctgacaagcgggag

SEQ ID NO: 17945 - DNA, 20 bp, Unknown
  RNA secondary structure sequence
tgcgaccgtatccgctagcg

SEQ ID NO: 17946 - DNA, 20 bp, Unknown
  RNA secondary structure sequence
aatcaggtaggtaactctct

SEQ ID NO: 17947 - DNA, 20 bp, Unknown
  RNA secondary structure sequence
gtgggagtggagtggagcgg

SEQ ID NO: 17948 - DNA, 20 bp, Unknown
  RNA secondary structure sequence
aacaactgctcagagtgcga

SEQ ID NO: 17949 - DNA, 20 bp, Unknown
  RNA secondary structure sequence
ggtgtgtttatatgcctgac

SEQ ID NO: 17950 - DNA, 20 bp, Unknown
  RNA secondary structure sequence
cgcctcgctcctcttcaggg

SEQ ID NO: 17951 - DNA, 20 bp, Unknown
  RNA secondary structure sequence
cacgctctgcgaggccttga

SEQ ID NO: 17952 - DNA, 20 bp, Unknown
  RNA secondary structure sequence
gccccgcctgagctcaggag

SEQ ID NO: 17953 - DNA, 20 bp, Unknown
  RNA secondary structure sequence
ctcgagcagtctctggaaca

SEQ ID NO: 17954 - DNA, 20 bp, Unknown
  RNA secondary structure sequence
aagaagaagagggggaggag

SEQ ID NO: 17955 - DNA, 20 bp, Unknown
  RNA secondary structure sequence
cgcgtcacgcggtggtgaat

SEQ ID NO: 17956 - DNA, 20 bp, Unknown
  RNA secondary structure sequence
gaagtggtcccgcagaggcg

SEQ ID NO: 17957 - DNA, 20 bp, Unknown
  RNA secondary structure sequence
cagcgctgccatggctgggg

SEQ ID NO: 17958 - DNA, 20 bp, Unknown
  RNA secondary structure sequence
ccagatcttttctcggatcc

SEQ ID NO: 17959 - DNA, 20 bp, Unknown
  RNA secondary structure sequence
gagacatccaggagggcgac

SEQ ID NO: 17960 - DNA, 20 bp, Unknown
  RNA secondary structure sequence
ccaccgtccgggagccgccg

SEQ ID NO: 17961 - DNA, 20 bp, Unknown
  RNA secondary structure sequence
tttgggggcttggcttagcg

SEQ ID NO: 17962 - DNA, 20 bp, Unknown
  RNA secondary structure sequence
ttggtctcaggtgtggactc

SEQ ID NO: 17963 - DNA, 20 bp, Unknown
  RNA secondary structure sequence
ggctgccgggagagatgctg

SEQ ID NO: 17964 - DNA, 20 bp, Unknown
  RNA secondary structure sequence
gaaggcagagtatgtgcatc

SEQ ID NO: 17965 - DNA, 20 bp, Unknown
  RNA secondary structure sequence
gcgccagcgctgcatccctg

SEQ ID NO: 17966 - DNA, 20 bp, Unknown
  RNA secondary structure sequence
agatccttgttgccgtccct

SEQ ID NO: 17967 - DNA, 20 bp, Unknown
  RNA secondary structure sequence
agccttcgtccctgcggtgc

SEQ ID NO: 17968 - DNA, 20 bp, Unknown
  RNA secondary structure sequence
ccagcgtccgaacgggcaga

SEQ ID NO: 17969 - DNA, 20 bp, Unknown
  RNA secondary structure sequence
gccccctagttcccaaaggg

SEQ ID NO: 17970 - DNA, 20 bp, Unknown
  RNA secondary structure sequence
ctgtttctttctttcttcct

SEQ ID NO: 17971 - DNA, 20 bp, Unknown
  RNA secondary structure sequence
tggagccctgacattgctgc

SEQ ID NO: 17972 - DNA, 20 bp, Unknown
  RNA secondary structure sequence
tccgtcttccttctgactgg

SEQ ID NO: 17973 - DNA, 20 bp, Unknown
  RNA secondary structure sequence
cctgtctgtggcaccagaca

SEQ ID NO: 17974 - DNA, 20 bp, Unknown
  RNA secondary structure sequence
tcccgggcagaaaggcgaca

SEQ ID NO: 17975 - DNA, 20 bp, Unknown
  RNA secondary structure sequence
ccagcgtcctgtcgcctcct

SEQ ID NO: 17976 - DNA, 20 bp, Unknown
  RNA secondary structure sequence
ctgcctcatggaaatgcctt

SEQ ID NO: 17977 - DNA, 20 bp, Unknown
  RNA secondary structure sequence
accggccgcgggcataaaag

SEQ ID NO: 17978 - DNA, 20 bp, Unknown
  RNA secondary structure sequence
cacggcccatgtgtcgcact

SEQ ID NO: 17979 - DNA, 20 bp, Unknown
  RNA secondary structure sequence
ggaggccgcgcccgggaccc

SEQ ID NO: 17980 - DNA, 20 bp, Unknown
  RNA secondary structure sequence
aggtgcggaccttaaactca

SEQ ID NO: 17981 - DNA, 20 bp, Unknown
  RNA secondary structure sequence
agccacgggcccacgcccgc

SEQ ID NO: 17982 - DNA, 20 bp, Unknown
  RNA secondary structure sequence
gctcggggcgacgcggcgct

SEQ ID NO: 17983 - DNA, 20 bp, Unknown
  RNA secondary structure sequence
tctttcttaaaggactgatt

SEQ ID NO: 17984 - DNA, 20 bp, Unknown
  RNA secondary structure sequence
ctcgcaggcgccctcagatc

SEQ ID NO: 17985 - DNA, 20 bp, Unknown
  RNA secondary structure sequence
ctccaactccagttctttcc

SEQ ID NO: 17986 - DNA, 20 bp, Unknown
  RNA secondary structure sequence
ggagccagacgtgtggagtc

SEQ ID NO: 17987 - DNA, 20 bp, Unknown
  RNA secondary structure sequence
ggcaactcccacgcaggccg

SEQ ID NO: 17988 - DNA, 20 bp, Unknown
  RNA secondary structure sequence
gcgccgccccgcctcctgtc

SEQ ID NO: 17989 - DNA, 20 bp, Unknown
  RNA secondary structure sequence
gctggaggcatgcccacagc

SEQ ID NO: 17990 - DNA, 20 bp, Unknown
  RNA secondary structure sequence
gagtgcggcgcagcgcagct

SEQ ID NO: 17991 - DNA, 20 bp, Unknown
  RNA secondary structure sequence
gtccttccgaggtgaaggaa

SEQ ID NO: 17992 - DNA, 20 bp, Unknown
  RNA secondary structure sequence
gagtagtctgcctgaccacc

SEQ ID NO: 17993 - DNA, 20 bp, Unknown
  RNA secondary structure sequence
ctcaggcgttgctgtttctt

SEQ ID NO: 17994 - DNA, 20 bp, Unknown
  RNA secondary structure sequence
cctcgcagagttgtttctcg

SEQ ID NO: 17995 - DNA, 20 bp, Unknown
  RNA secondary structure sequence
cctccagccagtgctgacca

SEQ ID NO: 17996 - DNA, 20 bp, Unknown
  RNA secondary structure sequence
gcgcctatcgctggctcttg

SEQ ID NO: 17997 - DNA, 20 bp, Unknown
  RNA secondary structure sequence
ctcagtccatcagggggggg

SEQ ID NO: 17998 - DNA, 20 bp, Unknown
  RNA secondary structure sequence
ccagaactagtggcgggctg

SEQ ID NO: 17999 - DNA, 20 bp, Unknown
  RNA secondary structure sequence
tcaggggacaggccaaccca

SEQ ID NO: 18000 - DNA, 20 bp, Unknown
  RNA secondary structure sequence
tggcggcggtggcggctgcg

SEQ ID NO: 18001 - DNA, 20 bp, Unknown
  RNA secondary structure sequence
gtcctcccgggcagaaaggc

SEQ ID NO: 18002 - DNA, 20 bp, Unknown
  RNA secondary structure sequence
ttctgaggccttcccagcta

SEQ ID NO: 18003 - DNA, 20 bp, Unknown
  RNA secondary structure sequence
gaaggcggacggcgagcgcc

SEQ ID NO: 18004 - DNA, 20 bp, Unknown
  RNA secondary structure sequence
gagggaggagaactgggggc

SEQ ID NO: 18005 - DNA, 20 bp, Unknown
  RNA secondary structure sequence
tcgaggctcctcccgctgcg

SEQ ID NO: 18006 - DNA, 20 bp, Unknown
  RNA secondary structure sequence
cacagctggttggcgtcgcc

SEQ ID NO: 18007 - DNA, 20 bp, Unknown
  RNA secondary structure sequence
tcctgcctcccggcctggtc

SEQ ID NO: 18008 - DNA, 20 bp, Unknown
  RNA secondary structure sequence
gtcctggtccacgagttgga

SEQ ID NO: 18009 - DNA, 20 bp, Unknown
  RNA secondary structure sequence
ttccccgtaggcagcccgcc

SEQ ID NO: 18010 - DNA, 20 bp, Unknown
  RNA secondary structure sequence
ttccagtggctcgcaagcct

SEQ ID NO: 18011 - DNA, 20 bp, Unknown
  RNA secondary structure sequence
agccctcaggcgaacctctc

SEQ ID NO: 18012 - DNA, 20 bp, Unknown
  RNA secondary structure sequence
aaaagctcctaggtgcgcgg

SEQ ID NO: 18013 - DNA, 20 bp, Unknown
  RNA secondary structure sequence
gttgtgcatccagaggtgga

SEQ ID NO: 18014 - DNA, 20 bp, Unknown
  RNA secondary structure sequence
gtccctgactttatatggct

SEQ ID NO: 18015 - DNA, 20 bp, Unknown
  RNA secondary structure sequence
ccgtttgtcccttgcggtac

SEQ ID NO: 18016 - DNA, 20 bp, Unknown
  RNA secondary structure sequence
cgagccctgcgagggccgat

SEQ ID NO: 18017 - DNA, 20 bp, Unknown
  RNA secondary structure sequence
gcaccttcttgccaagcctc

SEQ ID NO: 18018 - DNA, 20 bp, Unknown
  RNA secondary structure sequence
acaaaccccacccacaaagc

SEQ ID NO: 18019 - DNA, 20 bp, Unknown
  RNA secondary structure sequence
ggcgagcaacgctggagcat

SEQ ID NO: 18020 - DNA, 20 bp, Unknown
  RNA secondary structure sequence
tgccggcagctcttgacccg

SEQ ID NO: 18021 - DNA, 20 bp, Unknown
  RNA secondary structure sequence
ggccggtgagctcactagct

SEQ ID NO: 18022 - DNA, 20 bp, Unknown
  RNA secondary structure sequence
ggcgctggtgtaggctccaa

SEQ ID NO: 18023 - DNA, 20 bp, Unknown
  RNA secondary structure sequence
ctctgggccgccacctccgc

SEQ ID NO: 18024 - DNA, 20 bp, Unknown
  RNA secondary structure sequence
cactccgaagtggcagcagc

SEQ ID NO: 18025 - DNA, 20 bp, Unknown
  RNA secondary structure sequence
tcaatttggtactctgtaac

SEQ ID NO: 18026 - DNA, 20 bp, Unknown
  RNA secondary structure sequence
gcttctttgtttcgtgaaga

SEQ ID NO: 18027 - DNA, 20 bp, Unknown
  RNA secondary structure sequence
aggaacgccggctcttcgcc

SEQ ID NO: 18028 - DNA, 20 bp, Unknown
  RNA secondary structure sequence
gacagggaacagccagacga

SEQ ID NO: 18029 - DNA, 20 bp, Unknown
  RNA secondary structure sequence
tggcagtgcgggcagagccc

SEQ ID NO: 18030 - DNA, 20 bp, Unknown
  RNA secondary structure sequence
ccatccccgtaatcagtgaa

SEQ ID NO: 18031 - DNA, 20 bp, Unknown
  RNA secondary structure sequence
agagctgtccccggttctcc

SEQ ID NO: 18032 - DNA, 20 bp, Unknown
  RNA secondary structure sequence
tgcactgcagcgtagccgct

SEQ ID NO: 18033 - DNA, 20 bp, Unknown
  RNA secondary structure sequence
ttaatgcgaagagggggagg

SEQ ID NO: 18034 - DNA, 20 bp, Unknown
  RNA secondary structure sequence
cactctcagaaatcagactt

SEQ ID NO: 18035 - DNA, 20 bp, Unknown
  RNA secondary structure sequence
ggatctttgtcgctagctcc

SEQ ID NO: 18036 - DNA, 20 bp, Unknown
  RNA secondary structure sequence
gtagttccacctcccgccgc

SEQ ID NO: 18037 - DNA, 20 bp, Unknown
  RNA secondary structure sequence
ggaggggaaggcgcgaggtt

SEQ ID NO: 18038 - DNA, 20 bp, Unknown
  RNA secondary structure sequence
tcttgctgctcccctgaggt

SEQ ID NO: 18039 - DNA, 20 bp, Unknown
  RNA secondary structure sequence
cgccgcgtcgccggtgcctg

SEQ ID NO: 18040 - DNA, 20 bp, Unknown
  RNA secondary structure sequence
ccccagtcgtcgtcacacac

SEQ ID NO: 18041 - DNA, 20 bp, Unknown
  RNA secondary structure sequence
ctcctgctctggggtagtac

SEQ ID NO: 18042 - DNA, 20 bp, Unknown
  RNA secondary structure sequence
ccgtctcctgcgcctcccag

SEQ ID NO: 18043 - DNA, 20 bp, Unknown
  RNA secondary structure sequence
acatcgggctggggagtgac

SEQ ID NO: 18044 - DNA, 20 bp, Unknown
  RNA secondary structure sequence
acgcaaacgtggggccgcct

SEQ ID NO: 18045 - DNA, 20 bp, Unknown
  RNA secondary structure sequence
aggccctgcttagcccttcc

SEQ ID NO: 18046 - DNA, 20 bp, Unknown
  RNA secondary structure sequence
gcggggtcgcagggttggga

SEQ ID NO: 18047 - DNA, 20 bp, Unknown
  RNA secondary structure sequence
ctgcctcagccactgcctcc

SEQ ID NO: 18048 - DNA, 20 bp, Unknown
  RNA secondary structure sequence
gcctaaccctccttctcttc

SEQ ID NO: 18049 - DNA, 20 bp, Unknown
  RNA secondary structure sequence
ggcggccgaaccctccgcaa

SEQ ID NO: 18050 - DNA, 20 bp, Unknown
  RNA secondary structure sequence
cttcgccccggagctggccc

SEQ ID NO: 18051 - DNA, 20 bp, Unknown
  RNA secondary structure sequence
ttcaaaaaacccgcacacac

SEQ ID NO: 18052 - DNA, 20 bp, Unknown
  RNA secondary structure sequence
cctgctgcgggggaccgcgc

SEQ ID NO: 18053 - DNA, 20 bp, Unknown
  RNA secondary structure sequence
ggccgggctcggggacgccc

SEQ ID NO: 18054 - DNA, 20 bp, Unknown
  RNA secondary structure sequence
tccgcgcaaactctggcttc

SEQ ID NO: 18055 - DNA, 20 bp, Unknown
  RNA secondary structure sequence
agtgctgcgcgggaaggcac

SEQ ID NO: 18056 - DNA, 20 bp, Unknown
  RNA secondary structure sequence
cgcgaggagctagagagagc

SEQ ID NO: 18057 - DNA, 20 bp, Unknown
  RNA secondary structure sequence
ccccaggacttctgtgactc

SEQ ID NO: 18058 - DNA, 20 bp, Unknown
  RNA secondary structure sequence
gccgtagggcggtcagaagg

SEQ ID NO: 18059 - DNA, 20 bp, Unknown
  RNA secondary structure sequence
ggcggtgagagaggcggggg

SEQ ID NO: 18060 - DNA, 20 bp, Unknown
  RNA secondary structure sequence
gatggcggctgcgtcggggt

SEQ ID NO: 18061 - DNA, 20 bp, Unknown
  RNA secondary structure sequence
cgccccccggcaaactttcg

SEQ ID NO: 18062 - DNA, 20 bp, Unknown
  RNA secondary structure sequence
ccaaaatggcgcgggtgctg

SEQ ID NO: 18063 - DNA, 20 bp, Unknown
  RNA secondary structure sequence
gactctcaaaaggaaatagg

SEQ ID NO: 18064 - DNA, 20 bp, Unknown
  RNA secondary structure sequence
tccgccctcacagccaccgc

SEQ ID NO: 18065 - DNA, 20 bp, Unknown
  RNA secondary structure sequence
ggggaccgaacgagcagccc

SEQ ID NO: 18066 - DNA, 20 bp, Unknown
  RNA secondary structure sequence
gattctctcccaggccacaa

SEQ ID NO: 18067 - DNA, 20 bp, Unknown
  RNA secondary structure sequence
tccggcagctactggtcatg

SEQ ID NO: 18068 - DNA, 20 bp, Unknown
  RNA secondary structure sequence
tggctgctgtgattgcacat

SEQ ID NO: 18069 - DNA, 20 bp, Unknown
  RNA secondary structure sequence
gtgcgcgcctgggacctgaa

SEQ ID NO: 18070 - DNA, 20 bp, Unknown
  RNA secondary structure sequence
tggcccgagccagcatgatc

SEQ ID NO: 18071 - DNA, 20 bp, Unknown
  RNA secondary structure sequence
ccacgtgcgaaagccccgga

SEQ ID NO: 18072 - DNA, 20 bp, Unknown
  RNA secondary structure sequence
acggcttccccacgggagga

SEQ ID NO: 18073 - DNA, 20 bp, Unknown
  RNA secondary structure sequence
gctggccgccttggcgctgc

SEQ ID NO: 18074 - DNA, 20 bp, Unknown
  RNA secondary structure sequence
gctttctgccccttctctcg

SEQ ID NO: 18075 - DNA, 20 bp, Unknown
  RNA secondary structure sequence
caggggcacgagccgggggc

SEQ ID NO: 18076 - DNA, 20 bp, Unknown
  RNA secondary structure sequence
tcccgcgacagcaagaggcc

SEQ ID NO: 18077 - DNA, 20 bp, Unknown
  RNA secondary structure sequence
ttctgccaagatcggaactg

SEQ ID NO: 18078 - DNA, 20 bp, Unknown
  RNA secondary structure sequence
ctgccttatgctgtctcatc

SEQ ID NO: 18079 - DNA, 20 bp, Unknown
  RNA secondary structure sequence
cctcgcctggctcccagctg

SEQ ID NO: 18080 - DNA, 20 bp, Unknown
  RNA secondary structure sequence
actgcctcccttcctctttc

SEQ ID NO: 18081 - DNA, 20 bp, Unknown
  RNA secondary structure sequence
gaccgcctcgcggctgcttc

SEQ ID NO: 18082 - DNA, 20 bp, Unknown
  RNA secondary structure sequence
ggcgttctagcgcatcgcgg

SEQ ID NO: 18083 - DNA, 20 bp, Unknown
  RNA secondary structure sequence
gaagcggaggttccgggctc

SEQ ID NO: 18084 - DNA, 20 bp, Unknown
  RNA secondary structure sequence
ccgacgcttccgccgggtcc

SEQ ID NO: 18085 - DNA, 20 bp, Unknown
  RNA secondary structure sequence
cacgccggctcttcccgggg

SEQ ID NO: 18086 - DNA, 20 bp, Unknown
  RNA secondary structure sequence
catgtataagctggcctcct

SEQ ID NO: 18087 - DNA, 20 bp, Unknown
  RNA secondary structure sequence
gggaatcgcagtggccgagg

SEQ ID NO: 18088 - DNA, 20 bp, Unknown
  RNA secondary structure sequence
cagcagggtccaggggtaga

SEQ ID NO: 18089 - DNA, 20 bp, Unknown
  RNA secondary structure sequence
gcaggttttcctagtcccta

SEQ ID NO: 18090 - DNA, 20 bp, Unknown
  RNA secondary structure sequence
gcgaacccgcgtgcaacctg

SEQ ID NO: 18091 - DNA, 20 bp, Unknown
  RNA secondary structure sequence
cgcttccgtctccgccgggg

SEQ ID NO: 18092 - DNA, 20 bp, Unknown
  RNA secondary structure sequence
gtggcgcgcgggtccggcgg

SEQ ID NO: 18093 - DNA, 20 bp, Unknown
  RNA secondary structure sequence
caaattttgccacattaaca

SEQ ID NO: 18094 - DNA, 20 bp, Unknown
  RNA secondary structure sequence
gacctgctcggctggaacgt

SEQ ID NO: 18095 - DNA, 20 bp, Unknown
  RNA secondary structure sequence
ccgaggtgctaggagttgcc

SEQ ID NO: 18096 - DNA, 20 bp, Unknown
  RNA secondary structure sequence
gcttcacttgtggcaagatc

SEQ ID NO: 18097 - DNA, 20 bp, Unknown
  RNA secondary structure sequence
tctggcggagggaggtgttt

SEQ ID NO: 18098 - DNA, 20 bp, Unknown
  RNA secondary structure sequence
cctaattcgggaaacgtgca

SEQ ID NO: 18099 - DNA, 20 bp, Unknown
  RNA secondary structure sequence
tgggcctccttgcgtttccg

SEQ ID NO: 18100 - DNA, 20 bp, Unknown
  RNA secondary structure sequence
ccgccatggaagacacgccg

SEQ ID NO: 18101 - DNA, 20 bp, Unknown
  RNA secondary structure sequence
tgctgcctgccgggcagatg

SEQ ID NO: 18102 - DNA, 20 bp, Unknown
  RNA secondary structure sequence
attttgacaatgtcaagatt

SEQ ID NO: 18103 - DNA, 20 bp, Unknown
  RNA secondary structure sequence
ccggacgaggctcgctgcgc

SEQ ID NO: 18104 - DNA, 20 bp, Unknown
  RNA secondary structure sequence
tctccggtagctcctacccc

SEQ ID NO: 18105 - DNA, 20 bp, Unknown
  RNA secondary structure sequence
gcgcgcgcgaggccttggga

SEQ ID NO: 18106 - DNA, 20 bp, Unknown
  RNA secondary structure sequence
gtggcgttggtgggaagcgc

SEQ ID NO: 18107 - DNA, 20 bp, Unknown
  RNA secondary structure sequence
cgattggaacgcctccccat

SEQ ID NO: 18108 - DNA, 20 bp, Unknown
  RNA secondary structure sequence
ggaaaggcctggccgagagc

SEQ ID NO: 18109 - DNA, 20 bp, Unknown
  RNA secondary structure sequence
gccgtggctccgacttgggc

SEQ ID NO: 18110 - DNA, 20 bp, Unknown
  RNA secondary structure sequence
gattacgtacagagcgagtc

SEQ ID NO: 18111 - DNA, 20 bp, Unknown
  RNA secondary structure sequence
gcgcagcttgcagaggtctc

SEQ ID NO: 18112 - DNA, 20 bp, Unknown
  RNA secondary structure sequence
acatgcgcaatagcgagacg

SEQ ID NO: 18113 - DNA, 20 bp, Unknown
  RNA secondary structure sequence
gaaaatttcagctgtagccc

SEQ ID NO: 18114 - DNA, 20 bp, Unknown
  RNA secondary structure sequence
cccctccggctagctcgctg

SEQ ID NO: 18115 - DNA, 20 bp, Unknown
  RNA secondary structure sequence
gtcaaactcccgcagacttc

SEQ ID NO: 18116 - DNA, 20 bp, Unknown
  RNA secondary structure sequence
actatctttctagacaaggc

SEQ ID NO: 18117 - DNA, 20 bp, Unknown
  RNA secondary structure sequence
gggagcgcgagagccccccg

SEQ ID NO: 18118 - DNA, 20 bp, Unknown
  RNA secondary structure sequence
cccaggaggcctggcgggcc

SEQ ID NO: 18119 - DNA, 20 bp, Unknown
  RNA secondary structure sequence
agactcggcggtcgccacct

SEQ ID NO: 18120 - DNA, 20 bp, Unknown
  RNA secondary structure sequence
ccaggggatttcaaagagct

SEQ ID NO: 18121 - DNA, 20 bp, Unknown
  RNA secondary structure sequence
cgccaatcttcgaacgcagg

SEQ ID NO: 18122 - DNA, 20 bp, Unknown
  RNA secondary structure sequence
gtgtcttctggttggagtct

SEQ ID NO: 18123 - DNA, 20 bp, Unknown
  RNA secondary structure sequence
ggaggaggaggagatgactg

SEQ ID NO: 18124 - DNA, 20 bp, Unknown
  RNA secondary structure sequence
gccccgcgccgcttctccct

SEQ ID NO: 18125 - DNA, 20 bp, Unknown
  RNA secondary structure sequence
caaagaagaaccatgaggct

SEQ ID NO: 18126 - DNA, 20 bp, Unknown
  RNA secondary structure sequence
tcgttaactaattcaacaaa

SEQ ID NO: 18127 - DNA, 20 bp, Unknown
  RNA secondary structure sequence
tcgcagtcggctggcggcga

SEQ ID NO: 18128 - DNA, 20 bp, Unknown
  RNA secondary structure sequence
ccccgagtggaggtcggctg

SEQ ID NO: 18129 - DNA, 20 bp, Unknown
  RNA secondary structure sequence
gactcgcgctccggctgctg

SEQ ID NO: 18130 - DNA, 20 bp, Unknown
  RNA secondary structure sequence
tcaaccagctactcattgga

SEQ ID NO: 18131 - DNA, 20 bp, Unknown
  RNA secondary structure sequence
ttttttctccccccttctct

SEQ ID NO: 18132 - DNA, 20 bp, Unknown
  RNA secondary structure sequence
ctgtctgggtactgccagcc

SEQ ID NO: 18133 - DNA, 20 bp, Unknown
  RNA secondary structure sequence
ccacctgccctgcgccatct

SEQ ID NO: 18134 - DNA, 20 bp, Unknown
  RNA secondary structure sequence
ggggacagccgggcaagcag

SEQ ID NO: 18135 - DNA, 20 bp, Unknown
  RNA secondary structure sequence
ccctttcgggaggaagtttt

SEQ ID NO: 18136 - DNA, 20 bp, Unknown
  RNA secondary structure sequence
gcaaacacagcttccaaacc

SEQ ID NO: 18137 - DNA, 20 bp, Unknown
  RNA secondary structure sequence
tctatttccggtgtattgta

SEQ ID NO: 18138 - DNA, 20 bp, Unknown
  RNA secondary structure sequence
ttagcgccatctgctcgcgg

SEQ ID NO: 18139 - DNA, 20 bp, Unknown
  RNA secondary structure sequence
gcggttagggctgtgtaggg

SEQ ID NO: 18140 - DNA, 20 bp, Unknown
  RNA secondary structure sequence
tgtctcaagaatcagagtcg

SEQ ID NO: 18141 - DNA, 20 bp, Unknown
  RNA secondary structure sequence
aaccccggcagccctacaca

SEQ ID NO: 18142 - DNA, 20 bp, Unknown
  RNA secondary structure sequence
ccggagccgactacggagga

SEQ ID NO: 18143 - DNA, 20 bp, Unknown
  RNA secondary structure sequence
ccaagcatgccctgctctct

SEQ ID NO: 18144 - DNA, 20 bp, Unknown
  RNA secondary structure sequence
gacctggatgccctgctctc

SEQ ID NO: 18145 - DNA, 20 bp, Unknown
  RNA secondary structure sequence
tagacttcgggctccttgag

SEQ ID NO: 18146 - DNA, 20 bp, Unknown
  RNA secondary structure sequence
ctaccacctcgcacatgcca

SEQ ID NO: 18147 - DNA, 20 bp, Unknown
  RNA secondary structure sequence
taacagcagcctgcctgcag

SEQ ID NO: 18148 - DNA, 20 bp, Unknown
  RNA secondary structure sequence
gggccgcccccgaggaggtg

SEQ ID NO: 18149 - DNA, 20 bp, Unknown
  RNA secondary structure sequence
tctgggaacgaggcactagg

SEQ ID NO: 18150 - DNA, 20 bp, Unknown
  RNA secondary structure sequence
gtgctgctgctgcttctgag

SEQ ID NO: 18151 - DNA, 20 bp, Unknown
  RNA secondary structure sequence
caaccccctcagaccactct

SEQ ID NO: 18152 - DNA, 20 bp, Unknown
  RNA secondary structure sequence
ccaatcaggcgcggagggcg

SEQ ID NO: 18153 - DNA, 20 bp, Unknown
  RNA secondary structure sequence
cgtccttcctcagccgcggg

SEQ ID NO: 18154 - DNA, 20 bp, Unknown
  RNA secondary structure sequence
taaagtagtcgcggagacgg

SEQ ID NO: 18155 - DNA, 20 bp, Unknown
  RNA secondary structure sequence
acagctgtcggaaggtggcg

SEQ ID NO: 18156 - DNA, 20 bp, Unknown
  RNA secondary structure sequence
tttccttcggcttccgttct

SEQ ID NO: 18157 - DNA, 20 bp, Unknown
  RNA secondary structure sequence
agagcctgaaaaaggactgc

SEQ ID NO: 18158 - DNA, 20 bp, Unknown
  RNA secondary structure sequence
catgcaggcgcagcagctgc

SEQ ID NO: 18159 - DNA, 20 bp, Unknown
  RNA secondary structure sequence
tttgtgtagtgccttggagc

SEQ ID NO: 18160 - DNA, 20 bp, Unknown
  RNA secondary structure sequence
ttggagacccgaggaaagcc

SEQ ID NO: 18161 - DNA, 20 bp, Unknown
  RNA secondary structure sequence
gctctggctgtttaaaagct

SEQ ID NO: 18162 - DNA, 20 bp, Unknown
  RNA secondary structure sequence
cccttctcggcagtggtacc

SEQ ID NO: 18163 - DNA, 20 bp, Unknown
  RNA secondary structure sequence
ctccagagacctcctagagc

SEQ ID NO: 18164 - DNA, 20 bp, Unknown
  RNA secondary structure sequence
gctgtgggaataagatggcg

SEQ ID NO: 18165 - DNA, 20 bp, Unknown
  RNA secondary structure sequence
ttcggctggtgtcatcggtg

SEQ ID NO: 18166 - DNA, 20 bp, Unknown
  RNA secondary structure sequence
ggcgcggcaggaggacgagg

SEQ ID NO: 18167 - DNA, 20 bp, Unknown
  RNA secondary structure sequence
gtctgcgcggggccgctgac

SEQ ID NO: 18168 - DNA, 20 bp, Unknown
  RNA secondary structure sequence
accctccgacatgatatctc

SEQ ID NO: 18169 - DNA, 20 bp, Unknown
  RNA secondary structure sequence
tccgccccgcagcgccggag

SEQ ID NO: 18170 - DNA, 20 bp, Unknown
  RNA secondary structure sequence
gaccatggctgacgttttcc

SEQ ID NO: 18171 - DNA, 20 bp, Unknown
  RNA secondary structure sequence
aaatctcgtttctcttggac

SEQ ID NO: 18172 - DNA, 20 bp, Unknown
  RNA secondary structure sequence
tcccgccccgcggcagccct

SEQ ID NO: 18173 - DNA, 20 bp, Unknown
  RNA secondary structure sequence
tcctgagctgcgccgtgcca

SEQ ID NO: 18174 - DNA, 20 bp, Unknown
  RNA secondary structure sequence
caccgtggagagcgcggtcc

SEQ ID NO: 18175 - DNA, 20 bp, Unknown
  RNA secondary structure sequence
caatcactttcttcatcatc

SEQ ID NO: 18176 - DNA, 20 bp, Unknown
  RNA secondary structure sequence
gggggaaaggctgtttccaa

SEQ ID NO: 18177 - DNA, 20 bp, Unknown
  RNA secondary structure sequence
tccggcgaagttaaaccctc

SEQ ID NO: 18178 - DNA, 20 bp, Unknown
  RNA secondary structure sequence
gtagatccctcccgttagct

SEQ ID NO: 18179 - DNA, 20 bp, Unknown
  RNA secondary structure sequence
gctggccggtctgcctccgg

SEQ ID NO: 18180 - DNA, 20 bp, Unknown
  RNA secondary structure sequence
agccgctcgccttcctttca

SEQ ID NO: 18181 - DNA, 20 bp, Unknown
  RNA secondary structure sequence
aaaggtgaagcaggacatgc

SEQ ID NO: 18182 - DNA, 20 bp, Unknown
  RNA secondary structure sequence
gaaggtctcattcggtgttt

SEQ ID NO: 18183 - DNA, 20 bp, Unknown
  RNA secondary structure sequence
tccgcgggtggcaagcgggc

SEQ ID NO: 18184 - DNA, 20 bp, Unknown
  RNA secondary structure sequence
gctagtttctctaagccatc

SEQ ID NO: 18185 - DNA, 20 bp, Unknown
  RNA secondary structure sequence
cctaaatccaggcagggaaa

SEQ ID NO: 18186 - DNA, 20 bp, Unknown
  RNA secondary structure sequence
taaacccgcgcgcccgccag

SEQ ID NO: 18187 - DNA, 20 bp, Unknown
  RNA secondary structure sequence
tcgctccgaggtccccgcgc

SEQ ID NO: 18188 - DNA, 20 bp, Unknown
  RNA secondary structure sequence
taaggcggcacagggccgag

SEQ ID NO: 18189 - DNA, 20 bp, Unknown
  RNA secondary structure sequence
cttgttcagggctggtgggg

SEQ ID NO: 18190 - DNA, 20 bp, Unknown
  RNA secondary structure sequence
ccctaaagacgctagcgctg

SEQ ID NO: 18191 - DNA, 20 bp, Unknown
  RNA secondary structure sequence
cgcagtttgccggccgccat

SEQ ID NO: 18192 - DNA, 20 bp, Unknown
  RNA secondary structure sequence
ggagctgtgaggcagtgctg

SEQ ID NO: 18193 - DNA, 20 bp, Unknown
  RNA secondary structure sequence
ggattgaggcgccgccattt

SEQ ID NO: 18194 - DNA, 20 bp, Unknown
  RNA secondary structure sequence
cctcgtgcgcccccgccccc

SEQ ID NO: 18195 - DNA, 20 bp, Unknown
  RNA secondary structure sequence
tctcggcccttgacttctac

SEQ ID NO: 18196 - DNA, 20 bp, Unknown
  RNA secondary structure sequence
tatcagcacagcacttcttg

SEQ ID NO: 18197 - DNA, 20 bp, Unknown
  RNA secondary structure sequence
acaatctgtggcctcagccc

SEQ ID NO: 18198 - DNA, 20 bp, Unknown
  RNA secondary structure sequence
tccgagtttggtgttttgca

SEQ ID NO: 18199 - DNA, 20 bp, Unknown
  RNA secondary structure sequence
gggccacgtgataagcccgg

SEQ ID NO: 18200 - DNA, 20 bp, Unknown
  RNA secondary structure sequence
acctgggcttggtcgcctcc

SEQ ID NO: 18201 - DNA, 20 bp, Unknown
  RNA secondary structure sequence
acccctccccccgccttccc

SEQ ID NO: 18202 - DNA, 20 bp, Unknown
  RNA secondary structure sequence
agctaaggcaccccagccgg

SEQ ID NO: 18203 - DNA, 20 bp, Unknown
  RNA secondary structure sequence
gcagcgcttgagggtagcgg

SEQ ID NO: 18204 - DNA, 20 bp, Unknown
  RNA secondary structure sequence
ccgcgcgcgtcgcaacggag

SEQ ID NO: 18205 - DNA, 20 bp, Unknown
  RNA secondary structure sequence
gggaccaccgggggtggtga

SEQ ID NO: 18206 - DNA, 20 bp, Unknown
  RNA secondary structure sequence
caggaggcgtgcgtggcagg

SEQ ID NO: 18207 - DNA, 20 bp, Unknown
  RNA secondary structure sequence
cgtgcgtgaggcgtttactg

SEQ ID NO: 18208 - DNA, 20 bp, Unknown
  RNA secondary structure sequence
tccctccgggctcaagttgc

SEQ ID NO: 18209 - DNA, 20 bp, Unknown
  RNA secondary structure sequence
tgctctgcggctcagggagc

SEQ ID NO: 18210 - DNA, 20 bp, Unknown
  RNA secondary structure sequence
cgccacgcgcatatccctgc

SEQ ID NO: 18211 - DNA, 20 bp, Unknown
  RNA secondary structure sequence
cgagaagtcaagttctcatg

SEQ ID NO: 18212 - DNA, 20 bp, Unknown
  RNA secondary structure sequence
cctctttccctaagcagcct

SEQ ID NO: 18213 - DNA, 20 bp, Unknown
  RNA secondary structure sequence
agggcctgactttgggagcc

SEQ ID NO: 18214 - DNA, 20 bp, Unknown
  RNA secondary structure sequence
agacccagagggagggagga

SEQ ID NO: 18215 - DNA, 20 bp, Unknown
  RNA secondary structure sequence
agttctcccaaaatccaccg

SEQ ID NO: 18216 - DNA, 20 bp, Unknown
  RNA secondary structure sequence
gcctttgtgccatccgggtc

SEQ ID NO: 18217 - DNA, 20 bp, Unknown
  RNA secondary structure sequence
tctacccaagctccctcagc

SEQ ID NO: 18218 - DNA, 20 bp, Unknown
  RNA secondary structure sequence
gtgtcggtcgcctagtctgg

SEQ ID NO: 18219 - DNA, 20 bp, Unknown
  RNA secondary structure sequence
tcgcctagtctggagaacta

SEQ ID NO: 18220 - DNA, 20 bp, Unknown
  RNA secondary structure sequence
tgaacaagctgagtggaggc

SEQ ID NO: 18221 - DNA, 20 bp, Unknown
  RNA secondary structure sequence
tcctcccccctgttccccgc

SEQ ID NO: 18222 - DNA, 20 bp, Unknown
  RNA secondary structure sequence
ctttttgaacccacttattg

SEQ ID NO: 18223 - DNA, 20 bp, Unknown
  RNA secondary structure sequence
ctgtgtctggtacacattgt

SEQ ID NO: 18224 - DNA, 20 bp, Unknown
  RNA secondary structure sequence
ccgcttctcgactctgttgt

SEQ ID NO: 18225 - DNA, 20 bp, Unknown
  RNA secondary structure sequence
ctgtactgacgcgccctcgc

SEQ ID NO: 18226 - DNA, 20 bp, Unknown
  RNA secondary structure sequence
ctgcttggtcgcgtctgagg

SEQ ID NO: 18227 - DNA, 20 bp, Unknown
  RNA secondary structure sequence
gtgttctacgaagtctcttt

SEQ ID NO: 18228 - DNA, 20 bp, Unknown
  RNA secondary structure sequence
tccggcgatgccgccccagc

SEQ ID NO: 18229 - DNA, 20 bp, Unknown
  RNA secondary structure sequence
gcagctcggagcctgtggcg

SEQ ID NO: 18230 - DNA, 20 bp, Unknown
  RNA secondary structure sequence
gagtgagaaagagaaatctg

SEQ ID NO: 18231 - DNA, 20 bp, Unknown
  RNA secondary structure sequence
tagacctgcccttcgcctgg

SEQ ID NO: 18232 - DNA, 20 bp, Unknown
  RNA secondary structure sequence
gccagtcctttggctccgtt

SEQ ID NO: 18233 - DNA, 20 bp, Unknown
  RNA secondary structure sequence
tctcccgctccgtctcacac

SEQ ID NO: 18234 - DNA, 20 bp, Unknown
  RNA secondary structure sequence
ccaggcgccgcgaggcactg

SEQ ID NO: 18235 - DNA, 20 bp, Unknown
  RNA secondary structure sequence
catggtctcgccctagggag

SEQ ID NO: 18236 - DNA, 20 bp, Unknown
  RNA secondary structure sequence
ctctacgctcggcctcgatc

SEQ ID NO: 18237 - DNA, 20 bp, Unknown
  RNA secondary structure sequence
gggccgcagtgaccaacccc

SEQ ID NO: 18238 - DNA, 20 bp, Unknown
  RNA secondary structure sequence
acagcgccaagagcggcggc

SEQ ID NO: 18239 - DNA, 20 bp, Unknown
  RNA secondary structure sequence
aggggtgttcggccaggggc

SEQ ID NO: 18240 - DNA, 20 bp, Unknown
  RNA secondary structure sequence
ggagtaagcggcgcggtagc

SEQ ID NO: 18241 - DNA, 20 bp, Unknown
  RNA secondary structure sequence
agctgggggcccagctccgg

SEQ ID NO: 18242 - DNA, 20 bp, Unknown
  RNA secondary structure sequence
tggtgggcgggcgggagctg

SEQ ID NO: 18243 - DNA, 20 bp, Unknown
  RNA secondary structure sequence
ggctgcagcggggtgagcgg

SEQ ID NO: 18244 - DNA, 20 bp, Unknown
  RNA secondary structure sequence
tgccgggaagtgatccccaa

SEQ ID NO: 18245 - DNA, 20 bp, Unknown
  RNA secondary structure sequence
aggcagggtgagagttcccc

SEQ ID NO: 18246 - DNA, 20 bp, Unknown
  RNA secondary structure sequence
tgtgtttccaaaatggcggc

SEQ ID NO: 18247 - DNA, 20 bp, Unknown
  RNA secondary structure sequence
ggggctggcaggaggggagg

SEQ ID NO: 18248 - DNA, 20 bp, Unknown
  RNA secondary structure sequence
gtgaacagtggctgacaaca

SEQ ID NO: 18249 - DNA, 20 bp, Unknown
  RNA secondary structure sequence
ctgctgtgacgcgcggacag

SEQ ID NO: 18250 - DNA, 20 bp, Unknown
  RNA secondary structure sequence
gaagcgctggtcggcgtctg

SEQ ID NO: 18251 - DNA, 20 bp, Unknown
  RNA secondary structure sequence
cggcggcggcggcgtcggcg

SEQ ID NO: 18252 - DNA, 20 bp, Unknown
  RNA secondary structure sequence
gggcgaggaggttcccgtgg

SEQ ID NO: 18253 - DNA, 20 bp, Unknown
  RNA secondary structure sequence
acctcagcgcgagcgccagg

SEQ ID NO: 18254 - DNA, 20 bp, Unknown
  RNA secondary structure sequence
cgctctgagccctgccacca

SEQ ID NO: 18255 - DNA, 20 bp, Unknown
  RNA secondary structure sequence
gagatgaaatgcgaccgggt

SEQ ID NO: 18256 - DNA, 20 bp, Unknown
  RNA secondary structure sequence
ccgccgcaccgctgggggcc

SEQ ID NO: 18257 - DNA, 20 bp, Unknown
  RNA secondary structure sequence
tgtgggcgcggcagggcgca

SEQ ID NO: 18258 - DNA, 20 bp, Unknown
  RNA secondary structure sequence
ctggggagggctgtgcctga

SEQ ID NO: 18259 - DNA, 20 bp, Unknown
  RNA secondary structure sequence
tccggacatctccctgggag

SEQ ID NO: 18260 - DNA, 20 bp, Unknown
  RNA secondary structure sequence
ggccgcccgggacgagctcg

SEQ ID NO: 18261 - DNA, 20 bp, Unknown
  RNA secondary structure sequence
tgtcccctgcctctggggcc

SEQ ID NO: 18262 - DNA, 20 bp, Unknown
  RNA secondary structure sequence
tctctcgttttcggacggct

SEQ ID NO: 18263 - DNA, 20 bp, Unknown
  RNA secondary structure sequence
cgcgacggctgcagaacatc

SEQ ID NO: 18264 - DNA, 20 bp, Unknown
  RNA secondary structure sequence
atctcctgtctccgccgcct

SEQ ID NO: 18265 - DNA, 20 bp, Unknown
  RNA secondary structure sequence
cgtgctgttctgcggcaagg

SEQ ID NO: 18266 - DNA, 20 bp, Unknown
  RNA secondary structure sequence
cttgttcagcagaacaggtg

SEQ ID NO: 18267 - DNA, 20 bp, Unknown
  RNA secondary structure sequence
gcgggtatcatgggtgctgt

SEQ ID NO: 18268 - DNA, 20 bp, Unknown
  RNA secondary structure sequence
tgagattggcgaggggagag

SEQ ID NO: 18269 - DNA, 20 bp, Unknown
  RNA secondary structure sequence
aatggccgtggagcagcccc

SEQ ID NO: 18270 - DNA, 20 bp, Unknown
  RNA secondary structure sequence
gtggcctcgctccccgcccg

SEQ ID NO: 18271 - DNA, 20 bp, Unknown
  RNA secondary structure sequence
agagctacaagagcctggaa

SEQ ID NO: 18272 - DNA, 20 bp, Unknown
  RNA secondary structure sequence
taggctcccctgtgacagcc

SEQ ID NO: 18273 - DNA, 20 bp, Unknown
  RNA secondary structure sequence
aatttgcaacctccgctgcc

SEQ ID NO: 18274 - DNA, 20 bp, Unknown
  RNA secondary structure sequence
ggtagatccatggcttcctg

SEQ ID NO: 18275 - DNA, 20 bp, Unknown
  RNA secondary structure sequence
gagcgccgcgtcgggagcgg

SEQ ID NO: 18276 - DNA, 20 bp, Unknown
  RNA secondary structure sequence
tcatgctgtgcaaaaacttg

SEQ ID NO: 18277 - DNA, 20 bp, Unknown
  RNA secondary structure sequence
tggccgccgagcgggatctg

SEQ ID NO: 18278 - DNA, 20 bp, Unknown
  RNA secondary structure sequence
agccagagagaagaagataa

SEQ ID NO: 18279 - DNA, 20 bp, Unknown
  RNA secondary structure sequence
cctcattgcccagcggaccc

SEQ ID NO: 18280 - DNA, 20 bp, Unknown
  RNA secondary structure sequence
accccgaggtggctgaggct

SEQ ID NO: 18281 - DNA, 20 bp, Unknown
  RNA secondary structure sequence
gtgatggcggggccggtgaa

SEQ ID NO: 18282 - DNA, 20 bp, Unknown
  RNA secondary structure sequence
gcacagatgtcatctgctgc

SEQ ID NO: 18283 - DNA, 20 bp, Unknown
  RNA secondary structure sequence
cgctccggacgggcgacggt

SEQ ID NO: 18284 - DNA, 20 bp, Unknown
  RNA secondary structure sequence
tgcttcgggcttccacctca

SEQ ID NO: 18285 - DNA, 20 bp, Unknown
  RNA secondary structure sequence
gctccagtgccaaaacttcc

SEQ ID NO: 18286 - DNA, 20 bp, Unknown
  RNA secondary structure sequence
aacgagagactgcttgctgc

SEQ ID NO: 18287 - DNA, 20 bp, Unknown
  RNA secondary structure sequence
gaagtggtcgtttattggct

SEQ ID NO: 18288 - DNA, 20 bp, Unknown
  RNA secondary structure sequence
caggcgtcggtactcagcgg

SEQ ID NO: 18289 - DNA, 20 bp, Unknown
  RNA secondary structure sequence
ggcgggcggaaaccggtctc

SEQ ID NO: 18290 - DNA, 20 bp, Unknown
  RNA secondary structure sequence
gttcctccccagctcgaatg

SEQ ID NO: 18291 - DNA, 20 bp, Unknown
  RNA secondary structure sequence
taggagtcggcgattaagga

SEQ ID NO: 18292 - DNA, 20 bp, Unknown
  RNA secondary structure sequence
gcgcaccgctccgagggcca

SEQ ID NO: 18293 - DNA, 20 bp, Unknown
  RNA secondary structure sequence
tcattcctcccagggacccc

SEQ ID NO: 18294 - DNA, 20 bp, Unknown
  RNA secondary structure sequence
gcgaaagagcagcagaagtg

SEQ ID NO: 18295 - DNA, 20 bp, Unknown
  RNA secondary structure sequence
ctgcgttcggacccagaccc

SEQ ID NO: 18296 - DNA, 20 bp, Unknown
  RNA secondary structure sequence
gagcggaggaggaggaggag

SEQ ID NO: 18297 - DNA, 20 bp, Unknown
  RNA secondary structure sequence
aacgtcaggccacccgccgc

SEQ ID NO: 18298 - DNA, 20 bp, Unknown
  RNA secondary structure sequence
gaggaagtcggacgtgggcg

SEQ ID NO: 18299 - DNA, 20 bp, Unknown
  RNA secondary structure sequence
cacctagtacaacatcttac

SEQ ID NO: 18300 - DNA, 20 bp, Unknown
  RNA secondary structure sequence
ggatgaggcagaagattcag

SEQ ID NO: 18301 - DNA, 20 bp, Unknown
  RNA secondary structure sequence
gctggctcacaacaagatgc

SEQ ID NO: 18302 - DNA, 20 bp, Unknown
  RNA secondary structure sequence
acggacgtggctcgagtttc

SEQ ID NO: 18303 - DNA, 20 bp, Unknown
  RNA secondary structure sequence
ccggtcccttgcagcgctgc

SEQ ID NO: 18304 - DNA, 20 bp, Unknown
  RNA secondary structure sequence
cgcagcgcctacgggagtcc

SEQ ID NO: 18305 - DNA, 20 bp, Unknown
  RNA secondary structure sequence
taaccttcctgaagaggaca

SEQ ID NO: 18306 - DNA, 20 bp, Unknown
  RNA secondary structure sequence
tccggctcccacccgacgct

SEQ ID NO: 18307 - DNA, 20 bp, Unknown
  RNA secondary structure sequence
gaatgccactagagggtctg

SEQ ID NO: 18308 - DNA, 20 bp, Unknown
  RNA secondary structure sequence
attagggttgggagcaggaa

SEQ ID NO: 18309 - DNA, 20 bp, Unknown
  RNA secondary structure sequence
cggctgcgtggggctcggcc

SEQ ID NO: 18310 - DNA, 20 bp, Unknown
  RNA secondary structure sequence
agaaggccttggctccttga

SEQ ID NO: 18311 - DNA, 20 bp, Unknown
  RNA secondary structure sequence
ctgctctgcttccttcccat

SEQ ID NO: 18312 - DNA, 20 bp, Unknown
  RNA secondary structure sequence
aaggtcctctctgatgacat

SEQ ID NO: 18313 - DNA, 20 bp, Unknown
  RNA secondary structure sequence
aggacccgccccggccttga

SEQ ID NO: 18314 - DNA, 20 bp, Unknown
  RNA secondary structure sequence
cgaggcagcagttgcggccg

SEQ ID NO: 18315 - DNA, 20 bp, Unknown
  RNA secondary structure sequence
aagacggctcggatgccggc

SEQ ID NO: 18316 - DNA, 20 bp, Unknown
  RNA secondary structure sequence
gctgggctgggctgggctgg

SEQ ID NO: 18317 - DNA, 20 bp, Unknown
  RNA secondary structure sequence
tccacctgggaccggccggg

SEQ ID NO: 18318 - DNA, 20 bp, Unknown
  RNA secondary structure sequence
cttgaagcagaggagcagca

SEQ ID NO: 18319 - DNA, 20 bp, Unknown
  RNA secondary structure sequence
cggtctcgcatcggcggcga

SEQ ID NO: 18320 - DNA, 20 bp, Unknown
  RNA secondary structure sequence
gagggccagagactaagtta

SEQ ID NO: 18321 - DNA, 20 bp, Unknown
  RNA secondary structure sequence
gctccggcagcgttcctggg

SEQ ID NO: 18322 - DNA, 20 bp, Unknown
  RNA secondary structure sequence
gtgttgctccggcagcgttc

SEQ ID NO: 18323 - DNA, 20 bp, Unknown
  RNA secondary structure sequence
cggagggatctccgtggggc

SEQ ID NO: 18324 - DNA, 20 bp, Unknown
  RNA secondary structure sequence
ctgtgttttcttggttcagc

SEQ ID NO: 18325 - DNA, 20 bp, Unknown
  RNA secondary structure sequence
ttgtccttgggctgcctgtt

SEQ ID NO: 18326 - DNA, 20 bp, Unknown
  RNA secondary structure sequence
ctaccgtcgcggccgccgta

SEQ ID NO: 18327 - DNA, 20 bp, Unknown
  RNA secondary structure sequence
cggcagacaacaggggaccc

SEQ ID NO: 18328 - DNA, 20 bp, Unknown
  RNA secondary structure sequence
tggagacctgatttctaact

SEQ ID NO: 18329 - DNA, 20 bp, Unknown
  RNA secondary structure sequence
tcacgtcgcactcctcgcag

SEQ ID NO: 18330 - DNA, 20 bp, Unknown
  RNA secondary structure sequence
tcggactcgcgcccgtgggc

SEQ ID NO: 18331 - DNA, 20 bp, Unknown
  RNA secondary structure sequence
aagaagctggcggccgacgc

SEQ ID NO: 18332 - DNA, 20 bp, Unknown
  RNA secondary structure sequence
gctggaggcagtttctggtg

SEQ ID NO: 18333 - DNA, 20 bp, Unknown
  RNA secondary structure sequence
ccccatctccacttcctccc

SEQ ID NO: 18334 - DNA, 20 bp, Unknown
  RNA secondary structure sequence
gggcggcggcggtagctgcg

SEQ ID NO: 18335 - DNA, 20 bp, Unknown
  RNA secondary structure sequence
ccagggtcgtcaggggtgta

SEQ ID NO: 18336 - DNA, 20 bp, Unknown
  RNA secondary structure sequence
gctgggaaaaagaccaacag

SEQ ID NO: 18337 - DNA, 20 bp, Unknown
  RNA secondary structure sequence
tctcccgtcagaccttcctg

SEQ ID NO: 18338 - DNA, 20 bp, Unknown
  RNA secondary structure sequence
gcggtcgcccccttgggaaa

SEQ ID NO: 18339 - DNA, 20 bp, Unknown
  RNA secondary structure sequence
actcactccatggctgcagc

SEQ ID NO: 18340 - DNA, 20 bp, Unknown
  RNA secondary structure sequence
gcgccccaggccggcaggcg

SEQ ID NO: 18341 - DNA, 20 bp, Unknown
  RNA secondary structure sequence
agccgcgcgagtcgtagtgt

SEQ ID NO: 18342 - DNA, 20 bp, Unknown
  RNA secondary structure sequence
cgagggcagtaggctctcgg

SEQ ID NO: 18343 - DNA, 20 bp, Unknown
  RNA secondary structure sequence
agggctacgatgagctgcag

SEQ ID NO: 18344 - DNA, 20 bp, Unknown
  RNA secondary structure sequence
tgatccgattctttccagcg

SEQ ID NO: 18345 - DNA, 20 bp, Unknown
  RNA secondary structure sequence
tttttaagctcccctgagcc

SEQ ID NO: 18346 - DNA, 20 bp, Unknown
  RNA secondary structure sequence
ggcgtccgccacccgtctca

SEQ ID NO: 18347 - DNA, 20 bp, Unknown
  RNA secondary structure sequence
aggaaggctgtagtgtcggg

SEQ ID NO: 18348 - DNA, 20 bp, Unknown
  RNA secondary structure sequence
cggatcctcgctgctgctgc

SEQ ID NO: 18349 - DNA, 20 bp, Unknown
  RNA secondary structure sequence
ggctcagcctccagcccagg

SEQ ID NO: 18350 - DNA, 20 bp, Unknown
  RNA secondary structure sequence
aggcagaggaggctcagcgc

SEQ ID NO: 18351 - DNA, 20 bp, Unknown
  RNA secondary structure sequence
aaggtttccctgggcgttcc

SEQ ID NO: 18352 - DNA, 20 bp, Unknown
  RNA secondary structure sequence
aacgctacgatgcctgaacc

SEQ ID NO: 18353 - DNA, 20 bp, Unknown
  RNA secondary structure sequence
aaaaggaagcaaatgagctg

SEQ ID NO: 18354 - DNA, 20 bp, Unknown
  RNA secondary structure sequence
gcagccggaagggggaagtg

SEQ ID NO: 18355 - DNA, 20 bp, Unknown
  RNA secondary structure sequence
ccgctggccgcctcctgaca

SEQ ID NO: 18356 - DNA, 20 bp, Unknown
  RNA secondary structure sequence
actgcacggacccagggaac

SEQ ID NO: 18357 - DNA, 20 bp, Unknown
  RNA secondary structure sequence
cagcagggagaggctgagcc

SEQ ID NO: 18358 - DNA, 20 bp, Unknown
  RNA secondary structure sequence
caaaccctcctgcctccacc

SEQ ID NO: 18359 - DNA, 20 bp, Unknown
  RNA secondary structure sequence
gccagcctgaggctgggctg

SEQ ID NO: 18360 - DNA, 20 bp, Unknown
  RNA secondary structure sequence
ggcccactgctcagtggagc

SEQ ID NO: 18361 - DNA, 20 bp, Unknown
  RNA secondary structure sequence
cgcggcagccgaacaaagga

SEQ ID NO: 18362 - DNA, 20 bp, Unknown
  RNA secondary structure sequence
cgcccatctagctaacccga

SEQ ID NO: 18363 - DNA, 20 bp, Unknown
  RNA secondary structure sequence
gacctatagaggtatttcct

SEQ ID NO: 18364 - DNA, 20 bp, Unknown
  RNA secondary structure sequence
cggaggtgggggggggacgg

SEQ ID NO: 18365 - DNA, 20 bp, Unknown
  RNA secondary structure sequence
ccgcggcggagccaggccgg

SEQ ID NO: 18366 - DNA, 20 bp, Unknown
  RNA secondary structure sequence
gagcaggcagctgggggtgg

SEQ ID NO: 18367 - DNA, 20 bp, Unknown
  RNA secondary structure sequence
cgaaacttccctctacccgc

SEQ ID NO: 18368 - DNA, 20 bp, Unknown
  RNA secondary structure sequence
ttttcctgcgcaggagccgc

SEQ ID NO: 18369 - DNA, 20 bp, Unknown
  RNA secondary structure sequence
caagacggggcccgggcttt

SEQ ID NO: 18370 - DNA, 20 bp, Unknown
  RNA secondary structure sequence
tgctgctcagctcctcagct

SEQ ID NO: 18371 - DNA, 20 bp, Unknown
  RNA secondary structure sequence
cggcgcgagaagcggcggcc

SEQ ID NO: 18372 - DNA, 20 bp, Unknown
  RNA secondary structure sequence
ggagctgcggcgctggctac

SEQ ID NO: 18373 - DNA, 20 bp, Unknown
  RNA secondary structure sequence
caggccgggccaggctctct

SEQ ID NO: 18374 - DNA, 20 bp, Unknown
  RNA secondary structure sequence
gggctgtgtggccaaatctg

SEQ ID NO: 18375 - DNA, 20 bp, Unknown
  RNA secondary structure sequence
atatcttcctgcttctagtc

SEQ ID NO: 18376 - DNA, 20 bp, Unknown
  RNA secondary structure sequence
tggagccggccggcgctcac

SEQ ID NO: 18377 - DNA, 20 bp, Unknown
  RNA secondary structure sequence
ttggcgtggtgggcgactct

SEQ ID NO: 18378 - DNA, 20 bp, Unknown
  RNA secondary structure sequence
ctttggtttccgggtcggtt

SEQ ID NO: 18379 - DNA, 20 bp, Unknown
  RNA secondary structure sequence
ggcgcgggcggcgcggacag

SEQ ID NO: 18380 - DNA, 20 bp, Unknown
  RNA secondary structure sequence
gagccgggcggcgcaggcgc

SEQ ID NO: 18381 - DNA, 20 bp, Unknown
  RNA secondary structure sequence
cggcggcagcggaggaggag

SEQ ID NO: 18382 - DNA, 20 bp, Unknown
  RNA secondary structure sequence
tcctccggctttttcctccc

SEQ ID NO: 18383 - DNA, 20 bp, Unknown
  RNA secondary structure sequence
cgtgtcagtggcgctagcgg

SEQ ID NO: 18384 - DNA, 20 bp, Unknown
  RNA secondary structure sequence
ggatgcagaaagcctcagtg

SEQ ID NO: 18385 - DNA, 20 bp, Unknown
  RNA secondary structure sequence
ggcgcgaggcctgtgggccc

SEQ ID NO: 18386 - DNA, 20 bp, Unknown
  RNA secondary structure sequence
agctccaagtcctcacacag

SEQ ID NO: 18387 - DNA, 20 bp, Unknown
  RNA secondary structure sequence
agcagaggactttttagctg

SEQ ID NO: 18388 - DNA, 20 bp, Unknown
  RNA secondary structure sequence
ggcagctgcgggctccgcgc

SEQ ID NO: 18389 - DNA, 20 bp, Unknown
  RNA secondary structure sequence
ggcctatgtcttgactccgt

SEQ ID NO: 18390 - DNA, 20 bp, Unknown
  RNA secondary structure sequence
ttcggggtcaagccccagag

SEQ ID NO: 18391 - DNA, 20 bp, Unknown
  RNA secondary structure sequence
ggcctgctgtaggaaaatgc

SEQ ID NO: 18392 - DNA, 20 bp, Unknown
  RNA secondary structure sequence
ggaggggcaaaagctgaggg

SEQ ID NO: 18393 - DNA, 20 bp, Unknown
  RNA secondary structure sequence
cctcaccgggctgactagcc

SEQ ID NO: 18394 - DNA, 20 bp, Unknown
  RNA secondary structure sequence
ggcgtctcttcttctaactg

SEQ ID NO: 18395 - DNA, 20 bp, Unknown
  RNA secondary structure sequence
tgggagctgtttctcctggg

SEQ ID NO: 18396 - DNA, 20 bp, Unknown
  RNA secondary structure sequence
tagccacaatgcttaactgc

SEQ ID NO: 18397 - DNA, 20 bp, Unknown
  RNA secondary structure sequence
gtcaggctttcttcggtgga

SEQ ID NO: 18398 - DNA, 20 bp, Unknown
  RNA secondary structure sequence
cctgaactgaagagctgtgt

SEQ ID NO: 18399 - DNA, 20 bp, Unknown
  RNA secondary structure sequence
ggttgcccccgcgggcgtca

SEQ ID NO: 18400 - DNA, 20 bp, Unknown
  RNA secondary structure sequence
gcagaagctgtgacacgtgc

SEQ ID NO: 18401 - DNA, 20 bp, Unknown
  RNA secondary structure sequence
aggtccggattgcacgtgga

SEQ ID NO: 18402 - DNA, 20 bp, Unknown
  RNA secondary structure sequence
ccgcctccccgcgagtattt

SEQ ID NO: 18403 - DNA, 20 bp, Unknown
  RNA secondary structure sequence
gcggttgccgtggggaccgg

SEQ ID NO: 18404 - DNA, 20 bp, Unknown
  RNA secondary structure sequence
agggcgcctttcgattgcat

SEQ ID NO: 18405 - DNA, 20 bp, Unknown
  RNA secondary structure sequence
ggcgtggtgcatggctgtaa

SEQ ID NO: 18406 - DNA, 20 bp, Unknown
  RNA secondary structure sequence
aggtctgacaagatgtacca

SEQ ID NO: 18407 - DNA, 20 bp, Unknown
  RNA secondary structure sequence
gagctgggagaaggcagtga

SEQ ID NO: 18408 - DNA, 20 bp, Unknown
  RNA secondary structure sequence
cgcgcattggggacttgact

SEQ ID NO: 18409 - DNA, 20 bp, Unknown
  RNA secondary structure sequence
caggggacccagccaggggg

SEQ ID NO: 18410 - DNA, 20 bp, Unknown
  RNA secondary structure sequence
ccgcgctgcgaggcggaggt

SEQ ID NO: 18411 - DNA, 20 bp, Unknown
  RNA secondary structure sequence
tctgggatgtgcctcaccgg

SEQ ID NO: 18412 - DNA, 20 bp, Unknown
  RNA secondary structure sequence
taccccatgtctcaccacga

SEQ ID NO: 18413 - DNA, 20 bp, Unknown
  RNA secondary structure sequence
aagtgggtacgcaggggcgc

SEQ ID NO: 18414 - DNA, 20 bp, Unknown
  RNA secondary structure sequence
gaagctgctgttagctcgcc

SEQ ID NO: 18415 - DNA, 20 bp, Unknown
  RNA secondary structure sequence
cgggcactccagcgaccgtg

SEQ ID NO: 18416 - DNA, 20 bp, Unknown
  RNA secondary structure sequence
tcagcactgaaaccccgtcc

SEQ ID NO: 18417 - DNA, 20 bp, Unknown
  RNA secondary structure sequence
gggcctccgggacaagttgg

SEQ ID NO: 18418 - DNA, 20 bp, Unknown
  RNA secondary structure sequence
ctcgtgatccgcccgccttg

SEQ ID NO: 18419 - DNA, 20 bp, Unknown
  RNA secondary structure sequence
ggcgggcttcgggagcgccc

SEQ ID NO: 18420 - DNA, 20 bp, Unknown
  RNA secondary structure sequence
ttttcctgttccccctctgc

SEQ ID NO: 18421 - DNA, 20 bp, Unknown
  RNA secondary structure sequence
tgaggcgtagggggtggcgc

SEQ ID NO: 18422 - DNA, 20 bp, Unknown
  RNA secondary structure sequence
gacaaaacctcctccttttc

SEQ ID NO: 18423 - DNA, 20 bp, Unknown
  RNA secondary structure sequence
ttcgttcgagaacaactgtg

SEQ ID NO: 18424 - DNA, 20 bp, Unknown
  RNA secondary structure sequence
tcctccttttccaagcggct

SEQ ID NO: 18425 - DNA, 20 bp, Unknown
  RNA secondary structure sequence
accacacccaagtagctgcc

SEQ ID NO: 18426 - DNA, 20 bp, Unknown
  RNA secondary structure sequence
catagtgaccgtccgctcgc

SEQ ID NO: 18427 - DNA, 20 bp, Unknown
  RNA secondary structure sequence
gctactctgagaagaagaca

SEQ ID NO: 18428 - DNA, 20 bp, Unknown
  RNA secondary structure sequence
tcttgtgggctgaggggcag

SEQ ID NO: 18429 - DNA, 20 bp, Unknown
  RNA secondary structure sequence
cgcagtccctcaagcctgtg

SEQ ID NO: 18430 - DNA, 20 bp, Unknown
  RNA secondary structure sequence
gctgtgctctcactcaatgc

SEQ ID NO: 18431 - DNA, 20 bp, Unknown
  RNA secondary structure sequence
gagaaaggagctcccgggat

SEQ ID NO: 18432 - DNA, 20 bp, Unknown
  RNA secondary structure sequence
ctgacactggccctgaatca

SEQ ID NO: 18433 - DNA, 20 bp, Unknown
  RNA secondary structure sequence
aatcagggctggagggggca

SEQ ID NO: 18434 - DNA, 20 bp, Unknown
  RNA secondary structure sequence
acaactatttttgaggtatc

SEQ ID NO: 18435 - DNA, 20 bp, Unknown
  RNA secondary structure sequence
ttgggaagatggcggctgtg

SEQ ID NO: 18436 - DNA, 20 bp, Unknown
  RNA secondary structure sequence
cgccgcggcgcctgcgcggt

SEQ ID NO: 18437 - DNA, 20 bp, Unknown
  RNA secondary structure sequence
cgggcctggcctcccgataa

SEQ ID NO: 18438 - DNA, 20 bp, Unknown
  RNA secondary structure sequence
gtcccttgcggcggcgggag

SEQ ID NO: 18439 - DNA, 20 bp, Unknown
  RNA secondary structure sequence
gggaagaggctgagcccggc

SEQ ID NO: 18440 - DNA, 20 bp, Unknown
  RNA secondary structure sequence
ccaggcagctggcgctggag

SEQ ID NO: 18441 - DNA, 20 bp, Unknown
  RNA secondary structure sequence
cgcccttccaggagatgggt

SEQ ID NO: 18442 - DNA, 20 bp, Unknown
  RNA secondary structure sequence
cccggcctcagctctccgcc

SEQ ID NO: 18443 - DNA, 20 bp, Unknown
  RNA secondary structure sequence
ggcttttcatggggccgagc

SEQ ID NO: 18444 - DNA, 20 bp, Unknown
  RNA secondary structure sequence
cgggagcgcccttccaggag

SEQ ID NO: 18445 - DNA, 20 bp, Unknown
  RNA secondary structure sequence
aagggaagccctcgagggcc

SEQ ID NO: 18446 - DNA, 20 bp, Unknown
  RNA secondary structure sequence
tcccggctaccccccggacg

SEQ ID NO: 18447 - DNA, 20 bp, Unknown
  RNA secondary structure sequence
tgctctctctcgctgggtcg

SEQ ID NO: 18448 - DNA, 20 bp, Unknown
  RNA secondary structure sequence
acagccctgctctgggacac

SEQ ID NO: 18449 - DNA, 20 bp, Unknown
  RNA secondary structure sequence
tcctgagtcagaccataatc

SEQ ID NO: 18450 - DNA, 20 bp, Unknown
  RNA secondary structure sequence
ctaccctcacgtgtctggtt

SEQ ID NO: 18451 - DNA, 20 bp, Unknown
  RNA secondary structure sequence
ccgtcccactctgccctgtt

SEQ ID NO: 18452 - DNA, 20 bp, Unknown
  RNA secondary structure sequence
cgcttgccgcgtcctcccat

SEQ ID NO: 18453 - DNA, 20 bp, Unknown
  RNA secondary structure sequence
agtgtctgggcgggaagccg

SEQ ID NO: 18454 - DNA, 20 bp, Unknown
  RNA secondary structure sequence
ggcctcccgcagggcccact

SEQ ID NO: 18455 - DNA, 20 bp, Unknown
  RNA secondary structure sequence
agagcggtgcccgcgtcaga

SEQ ID NO: 18456 - DNA, 20 bp, Unknown
  RNA secondary structure sequence
caaagctcacggaagacaaa

SEQ ID NO: 18457 - DNA, 20 bp, Unknown
  RNA secondary structure sequence
cgatagctgcttcgggattg

SEQ ID NO: 18458 - DNA, 20 bp, Unknown
  RNA secondary structure sequence
ccaggaactgaccctgctct

SEQ ID NO: 18459 - DNA, 20 bp, Unknown
  RNA secondary structure sequence
cctttcgtttttttaaagaa

SEQ ID NO: 18460 - DNA, 20 bp, Unknown
  RNA secondary structure sequence
catcggcatgccgcagggaa

SEQ ID NO: 18461 - DNA, 20 bp, Unknown
  RNA secondary structure sequence
ggcgactacggctggtgtgg

SEQ ID NO: 18462 - DNA, 20 bp, Unknown
  RNA secondary structure sequence
gacgctgccggcggagacgg

SEQ ID NO: 18463 - DNA, 20 bp, Unknown
  RNA secondary structure sequence
cagcttcagatcactgtatc

SEQ ID NO: 18464 - DNA, 20 bp, Unknown
  RNA secondary structure sequence
ttcctgccggggcggcccca

SEQ ID NO: 18465 - DNA, 20 bp, Unknown
  RNA secondary structure sequence
actgggatacccttagactg

SEQ ID NO: 18466 - DNA, 20 bp, Unknown
  RNA secondary structure sequence
caggacgcggggtgggggac

SEQ ID NO: 18467 - DNA, 20 bp, Unknown
  RNA secondary structure sequence
cgcggttttcttaactttag

SEQ ID NO: 18468 - DNA, 20 bp, Unknown
  RNA secondary structure sequence
atggagaagccgcggcggag

SEQ ID NO: 18469 - DNA, 20 bp, Unknown
  RNA secondary structure sequence
tctctgcagcccagcaccag

SEQ ID NO: 18470 - DNA, 20 bp, Unknown
  RNA secondary structure sequence
ctggtatccctaagactggg

SEQ ID NO: 18471 - DNA, 20 bp, Unknown
  RNA secondary structure sequence
gagacaccccgtttcgtagt

SEQ ID NO: 18472 - DNA, 20 bp, Unknown
  RNA secondary structure sequence
cgcactgagcctaagcagcc

SEQ ID NO: 18473 - DNA, 20 bp, Unknown
  RNA secondary structure sequence
gcgcggctgaggcgcggcgg

SEQ ID NO: 18474 - DNA, 20 bp, Unknown
  RNA secondary structure sequence
cccaagacatctctgcacag

SEQ ID NO: 18475 - DNA, 20 bp, Unknown
  RNA secondary structure sequence
gccgcccggtgcactgtgga

SEQ ID NO: 18476 - DNA, 20 bp, Unknown
  RNA secondary structure sequence
ctgtatgatccaaggtaccc

SEQ ID NO: 18477 - DNA, 20 bp, Unknown
  RNA secondary structure sequence
cggcggcgggaacccggata

SEQ ID NO: 18478 - DNA, 20 bp, Unknown
  RNA secondary structure sequence
ggaccgcgtcctgcgccgga

SEQ ID NO: 18479 - DNA, 20 bp, Unknown
  RNA secondary structure sequence
gcctcattccttagctgggg

SEQ ID NO: 18480 - DNA, 20 bp, Unknown
  RNA secondary structure sequence
tgctgctgaggcgtgagaat

SEQ ID NO: 18481 - DNA, 20 bp, Unknown
  RNA secondary structure sequence
gggggctggggcatggtcta

SEQ ID NO: 18482 - DNA, 20 bp, Unknown
  RNA secondary structure sequence
gtgtacgcccgcagagccgc

SEQ ID NO: 18483 - DNA, 20 bp, Unknown
  RNA secondary structure sequence
gatcaccttgggatgatggt

SEQ ID NO: 18484 - DNA, 20 bp, Unknown
  RNA secondary structure sequence
gggtgcagtgagacaccagg

SEQ ID NO: 18485 - DNA, 20 bp, Unknown
  RNA secondary structure sequence
cggactgggcccagcttgtc

SEQ ID NO: 18486 - DNA, 20 bp, Unknown
  RNA secondary structure sequence
accctgtgatctgcaagtcc

SEQ ID NO: 18487 - DNA, 20 bp, Unknown
  RNA secondary structure sequence
ttggagctctgcgtctcgtc

SEQ ID NO: 18488 - DNA, 20 bp, Unknown
  RNA secondary structure sequence
cttttccgcgttctccaact

SEQ ID NO: 18489 - DNA, 20 bp, Unknown
  RNA secondary structure sequence
ggcggctcctccctccgcag

SEQ ID NO: 18490 - DNA, 20 bp, Unknown
  RNA secondary structure sequence
gctctgtgacctgcgggtat

SEQ ID NO: 18491 - DNA, 20 bp, Unknown
  RNA secondary structure sequence
aatgcctctctaaaacatga

SEQ ID NO: 18492 - DNA, 20 bp, Unknown
  RNA secondary structure sequence
gaccgcgggcgagtgcagcc

SEQ ID NO: 18493 - DNA, 20 bp, Unknown
  RNA secondary structure sequence
catctgcctctaggtcccat

SEQ ID NO: 18494 - DNA, 20 bp, Unknown
  RNA secondary structure sequence
cgcgcgcctacactcccgtg

SEQ ID NO: 18495 - DNA, 20 bp, Unknown
  RNA secondary structure sequence
gtcgtcgcagagcacagcct

SEQ ID NO: 18496 - DNA, 20 bp, Unknown
  RNA secondary structure sequence
cttgcttggcccgtccggcg

SEQ ID NO: 18497 - DNA, 20 bp, Unknown
  RNA secondary structure sequence
gccaagagcactgcatgagc

SEQ ID NO: 18498 - DNA, 20 bp, Unknown
  RNA secondary structure sequence
gcgagacttcctgctcatct

SEQ ID NO: 18499 - DNA, 20 bp, Unknown
  RNA secondary structure sequence
cgagacggagggccagagag

SEQ ID NO: 18500 - DNA, 20 bp, Unknown
  RNA secondary structure sequence
agccctccctagcatcacca

SEQ ID NO: 18501 - DNA, 20 bp, Unknown
  RNA secondary structure sequence
gcctcgggaggtggtggagt

SEQ ID NO: 18502 - DNA, 20 bp, Unknown
  RNA secondary structure sequence
cggcctccgtcacagccacc

SEQ ID NO: 18503 - DNA, 20 bp, Unknown
  RNA secondary structure sequence
tccttagccaaatctactga

SEQ ID NO: 18504 - DNA, 20 bp, Unknown
  RNA secondary structure sequence
tgtcgtccgctctctctgcc

SEQ ID NO: 18505 - DNA, 20 bp, Unknown
  RNA secondary structure sequence
accgtgttgcattcatcttt

SEQ ID NO: 18506 - DNA, 20 bp, Unknown
  RNA secondary structure sequence
agctgccgggacggtcccca

SEQ ID NO: 18507 - DNA, 20 bp, Unknown
  RNA secondary structure sequence
gtggcagcggccgtggcagg

SEQ ID NO: 18508 - DNA, 20 bp, Unknown
  RNA secondary structure sequence
ccggggcagaagtgctggtc

SEQ ID NO: 18509 - DNA, 20 bp, Unknown
  RNA secondary structure sequence
tcaccgcctgccgccgcgcc

SEQ ID NO: 18510 - DNA, 20 bp, Unknown
  RNA secondary structure sequence
aacctgttccaccttctcca

SEQ ID NO: 18511 - DNA, 20 bp, Unknown
  RNA secondary structure sequence
cgagcggcgctccaaaaccc

SEQ ID NO: 18512 - DNA, 20 bp, Unknown
  RNA secondary structure sequence
cttccccaaatcccgtaatc

SEQ ID NO: 18513 - DNA, 20 bp, Unknown
  RNA secondary structure sequence
gggatgccgcgcgccgcgcg

SEQ ID NO: 18514 - DNA, 20 bp, Unknown
  RNA secondary structure sequence
ggcggagaagactcgaacgg

SEQ ID NO: 18515 - DNA, 20 bp, Unknown
  RNA secondary structure sequence
gcctcccctcggaactcggg

SEQ ID NO: 18516 - DNA, 20 bp, Unknown
  RNA secondary structure sequence
gctgactggcgggtggggtt

SEQ ID NO: 18517 - DNA, 20 bp, Unknown
  RNA secondary structure sequence
gagttgctcagtggctctgc

SEQ ID NO: 18518 - DNA, 20 bp, Unknown
  RNA secondary structure sequence
ccggcggtggacccacgagc

SEQ ID NO: 18519 - DNA, 20 bp, Unknown
  RNA secondary structure sequence
gaacatggcggcccccgagt

SEQ ID NO: 18520 - DNA, 20 bp, Unknown
  RNA secondary structure sequence
gagtggaaagctgctgctga

SEQ ID NO: 18521 - DNA, 20 bp, Unknown
  RNA secondary structure sequence
tgcaggaggtggcactcctg

SEQ ID NO: 18522 - DNA, 20 bp, Unknown
  RNA secondary structure sequence
cccggtaaaggcctccgtgt

SEQ ID NO: 18523 - DNA, 20 bp, Unknown
  RNA secondary structure sequence
ggagcgccccgccccctccc

SEQ ID NO: 18524 - DNA, 20 bp, Unknown
  RNA secondary structure sequence
gtctccgccttctgcatcgc

SEQ ID NO: 18525 - DNA, 20 bp, Unknown
  RNA secondary structure sequence
aggagaatgaaaggttgcag

SEQ ID NO: 18526 - DNA, 20 bp, Unknown
  RNA secondary structure sequence
tgaagctagaatctcagaag

SEQ ID NO: 18527 - DNA, 20 bp, Unknown
  RNA secondary structure sequence
ttcagtatttgttattgtga

SEQ ID NO: 18528 - DNA, 20 bp, Unknown
  RNA secondary structure sequence
cgcggggtccgctatggcgg

SEQ ID NO: 18529 - DNA, 20 bp, Unknown
  RNA secondary structure sequence
ggaggaggtactcgccttac

SEQ ID NO: 18530 - DNA, 20 bp, Unknown
  RNA secondary structure sequence
actcttcagtctttgcaggc

SEQ ID NO: 18531 - DNA, 20 bp, Unknown
  RNA secondary structure sequence
gtcatcaggcaggtactaga

SEQ ID NO: 18532 - DNA, 20 bp, Unknown
  RNA secondary structure sequence
aagggctcgagacgcagccg

SEQ ID NO: 18533 - DNA, 20 bp, Unknown
  RNA secondary structure sequence
acaaatttttatgtggaggc

SEQ ID NO: 18534 - DNA, 20 bp, Unknown
  RNA secondary structure sequence
ctgcaacgtgtctctggggc

SEQ ID NO: 18535 - DNA, 20 bp, Unknown
  RNA secondary structure sequence
gcgcacgcatcctgcccgcg

SEQ ID NO: 18536 - DNA, 20 bp, Unknown
  RNA secondary structure sequence
cgcgaagagccctctgtacc

SEQ ID NO: 18537 - DNA, 20 bp, Unknown
  RNA secondary structure sequence
gcgcggcggtggaaggtgtc

SEQ ID NO: 18538 - DNA, 20 bp, Unknown
  RNA secondary structure sequence
ggctgcacgcggtgaagaaa

SEQ ID NO: 18539 - DNA, 20 bp, Unknown
  RNA secondary structure sequence
agccggggagccgccgccgc

SEQ ID NO: 18540 - DNA, 20 bp, Unknown
  RNA secondary structure sequence
accgttcttattgctggcgg

SEQ ID NO: 18541 - DNA, 20 bp, Unknown
  RNA secondary structure sequence
aggtcccggcaaccgcaggc

SEQ ID NO: 18542 - DNA, 20 bp, Unknown
  RNA secondary structure sequence
gatggcggcttcctagtgag

SEQ ID NO: 18543 - DNA, 20 bp, Unknown
  RNA secondary structure sequence
ggcctcctgacctttcacac

SEQ ID NO: 18544 - DNA, 20 bp, Unknown
  RNA secondary structure sequence
gtggggcggtggcgtcccac

SEQ ID NO: 18545 - DNA, 20 bp, Unknown
  RNA secondary structure sequence
gagggagcccagtggaggcg

SEQ ID NO: 18546 - DNA, 20 bp, Unknown
  RNA secondary structure sequence
ttttgtcaaagaggcctcct

SEQ ID NO: 18547 - DNA, 20 bp, Unknown
  RNA secondary structure sequence
tcacagccagtgcaccggag

SEQ ID NO: 18548 - DNA, 20 bp, Unknown
  RNA secondary structure sequence
gagttgtaagacgttcatcg

SEQ ID NO: 18549 - DNA, 20 bp, Unknown
  RNA secondary structure sequence
ccggttgtcctcttcgctgc

SEQ ID NO: 18550 - DNA, 20 bp, Unknown
  RNA secondary structure sequence
ttacgcgggccagttgttgc

SEQ ID NO: 18551 - DNA, 20 bp, Unknown
  RNA secondary structure sequence
cagccggggactctgcgcct

SEQ ID NO: 18552 - DNA, 20 bp, Unknown
  RNA secondary structure sequence
gggagccgcggacaagccca

SEQ ID NO: 18553 - DNA, 20 bp, Unknown
  RNA secondary structure sequence
ggcccccagcgtgttgaccg

SEQ ID NO: 18554 - DNA, 20 bp, Unknown
  RNA secondary structure sequence
agcagcggcggacgctctgc

SEQ ID NO: 18555 - DNA, 20 bp, Unknown
  RNA secondary structure sequence
gttgctctgcgctctgcggc

SEQ ID NO: 18556 - DNA, 20 bp, Unknown
  RNA secondary structure sequence
tttccggataacgactacag

SEQ ID NO: 18557 - DNA, 20 bp, Unknown
  RNA secondary structure sequence
ttttccatttacctccgctg

SEQ ID NO: 18558 - DNA, 20 bp, Unknown
  RNA secondary structure sequence
ggagacgtgggccctcggaa

SEQ ID NO: 18559 - DNA, 20 bp, Unknown
  RNA secondary structure sequence
agctctgtgtgatttctgga

SEQ ID NO: 18560 - DNA, 20 bp, Unknown
  RNA secondary structure sequence
cagaaccagcaaaaccagaa

SEQ ID NO: 18561 - DNA, 20 bp, Unknown
  RNA secondary structure sequence
gggaggcctggctgtgtgga

SEQ ID NO: 18562 - DNA, 20 bp, Unknown
  RNA secondary structure sequence
cccagacagagtgtccccac

SEQ ID NO: 18563 - DNA, 20 bp, Unknown
  RNA secondary structure sequence
agcagcaggcgagcctcggc

SEQ ID NO: 18564 - DNA, 20 bp, Unknown
  RNA secondary structure sequence
ttccggggagaagcctttcc

SEQ ID NO: 18565 - DNA, 20 bp, Unknown
  RNA secondary structure sequence
aaagataggaactgacagga

SEQ ID NO: 18566 - DNA, 20 bp, Unknown
  RNA secondary structure sequence
tccgctgggctgcagggact

SEQ ID NO: 18567 - DNA, 20 bp, Unknown
  RNA secondary structure sequence
agtgcaatggcgctatctcg

SEQ ID NO: 18568 - DNA, 20 bp, Unknown
  RNA secondary structure sequence
gtagcggcggcggctcgggc

SEQ ID NO: 18569 - DNA, 20 bp, Unknown
  RNA secondary structure sequence
gaccccaccccctggctacc

SEQ ID NO: 18570 - DNA, 20 bp, Unknown
  RNA secondary structure sequence
gcgcagctctggtacaccgg

SEQ ID NO: 18571 - DNA, 20 bp, Unknown
  RNA secondary structure sequence
tgcgcagtggcgtccgctgt

SEQ ID NO: 18572 - DNA, 20 bp, Unknown
  RNA secondary structure sequence
tccggcggagcgcgcctccc

SEQ ID NO: 18573 - DNA, 20 bp, Unknown
  RNA secondary structure sequence
cttccgggcaaacgaccatc

SEQ ID NO: 18574 - DNA, 20 bp, Unknown
  RNA secondary structure sequence
aagagcggcgcgacgtgagc

SEQ ID NO: 18575 - DNA, 20 bp, Unknown
  RNA secondary structure sequence
ctagcactagaaggtgaggc

SEQ ID NO: 18576 - DNA, 20 bp, Unknown
  RNA secondary structure sequence
ccgcggacgtccttgtgggc

SEQ ID NO: 18577 - DNA, 20 bp, Unknown
  RNA secondary structure sequence
tcctcccgccggcgctgggc

SEQ ID NO: 18578 - DNA, 20 bp, Unknown
  RNA secondary structure sequence
gcggtggggggaaagcggcc

SEQ ID NO: 18579 - DNA, 20 bp, Unknown
  RNA secondary structure sequence
tctggctataaaaatgctat

SEQ ID NO: 18580 - DNA, 20 bp, Unknown
  RNA secondary structure sequence
ccgccccgcccgcggctgct

SEQ ID NO: 18581 - DNA, 20 bp, Unknown
  RNA secondary structure sequence
acgtagctgcccttcagcca

SEQ ID NO: 18582 - DNA, 20 bp, Unknown
  RNA secondary structure sequence
tttttgcatttttcctccca

SEQ ID NO: 18583 - DNA, 20 bp, Unknown
  RNA secondary structure sequence
aactgcccaggagtgagtag

SEQ ID NO: 18584 - DNA, 20 bp, Unknown
  RNA secondary structure sequence
cttggtggttttgctgcagc

SEQ ID NO: 18585 - DNA, 20 bp, Unknown
  RNA secondary structure sequence
ctggccttccatctctctca

SEQ ID NO: 18586 - DNA, 20 bp, Unknown
  RNA secondary structure sequence
caccctcactggctgtcgct

SEQ ID NO: 18587 - DNA, 20 bp, Unknown
  RNA secondary structure sequence
gccttccatctctctcagac

SEQ ID NO: 18588 - DNA, 20 bp, Unknown
  RNA secondary structure sequence
aatcagactccaagcagcga

SEQ ID NO: 18589 - DNA, 20 bp, Unknown
  RNA secondary structure sequence
tctcagacaccaagctgcag

SEQ ID NO: 18590 - DNA, 20 bp, Unknown
  RNA secondary structure sequence
taacactgccccaagtgaaa

SEQ ID NO: 18591 - DNA, 20 bp, Unknown
  RNA secondary structure sequence
taattaagcaagagaaactg

SEQ ID NO: 18592 - DNA, 20 bp, Unknown
  RNA secondary structure sequence
tagagacaaaatatcagtgt

SEQ ID NO: 18593 - DNA, 20 bp, Unknown
  RNA secondary structure sequence
tccttgaccacaacaaagat

SEQ ID NO: 18594 - DNA, 20 bp, Unknown
  RNA secondary structure sequence
gattcttctgcctcagcctc

SEQ ID NO: 18595 - DNA, 20 bp, Unknown
  RNA secondary structure sequence
ccatcattctccacccagct

SEQ ID NO: 18596 - DNA, 20 bp, Unknown
  RNA secondary structure sequence
ccagcttgcctcctcttgag

SEQ ID NO: 18597 - DNA, 20 bp, Unknown
  RNA secondary structure sequence
tgcgcgctgggcggaaagga

SEQ ID NO: 18598 - DNA, 20 bp, Unknown
  RNA secondary structure sequence
gttaatggcttttctgcacg

SEQ ID NO: 18599 - DNA, 20 bp, Unknown
  RNA secondary structure sequence
taccaaatcactggacctta

SEQ ID NO: 18600 - DNA, 20 bp, Unknown
  RNA secondary structure sequence
cctgtcgcagccgcgccgcc

SEQ ID NO: 18601 - DNA, 20 bp, Unknown
  RNA secondary structure sequence
attcccgaagggcaagaagt

SEQ ID NO: 18602 - DNA, 20 bp, Unknown
  RNA secondary structure sequence
ccaggacctgcaggaaggga

SEQ ID NO: 18603 - DNA, 20 bp, Unknown
  RNA secondary structure sequence
tcccccactggaaaggattc

SEQ ID NO: 18604 - DNA, 20 bp, Unknown
  RNA secondary structure sequence
ggcagcatcactgtgcctgt

SEQ ID NO: 18605 - DNA, 20 bp, Unknown
  RNA secondary structure sequence
gggggagaccagcgcaggtc

SEQ ID NO: 18606 - DNA, 20 bp, Unknown
  RNA secondary structure sequence
ccttgggttcgggtgaaagc

SEQ ID NO: 18607 - DNA, 20 bp, Unknown
  RNA secondary structure sequence
tcaggctccataatgggaga

SEQ ID NO: 18608 - DNA, 20 bp, Unknown
  RNA secondary structure sequence
agcaacaaaactgacggagg

SEQ ID NO: 18609 - DNA, 20 bp, Unknown
  RNA secondary structure sequence
gctacagttaattaatcctt

SEQ ID NO: 18610 - DNA, 20 bp, Unknown
  RNA secondary structure sequence
ccatctcacctctgtcggat

SEQ ID NO: 18611 - DNA, 20 bp, Unknown
  RNA secondary structure sequence
aggtcacagggcaccgctgg

SEQ ID NO: 18612 - DNA, 20 bp, Unknown
  RNA secondary structure sequence
ggtcgcgcggctcgcgcagg

SEQ ID NO: 18613 - DNA, 20 bp, Unknown
  RNA secondary structure sequence
tccccctctcctccatcccc

SEQ ID NO: 18614 - DNA, 20 bp, Unknown
  RNA secondary structure sequence
cttccccctctctcctggga

SEQ ID NO: 18615 - DNA, 20 bp, Unknown
  RNA secondary structure sequence
gcccggttggccaccccgtt

SEQ ID NO: 18616 - DNA, 20 bp, Unknown
  RNA secondary structure sequence
ctgagcctgaactaggagca

SEQ ID NO: 18617 - DNA, 20 bp, Unknown
  RNA secondary structure sequence
aggttcttcttgaggaaact

SEQ ID NO: 18618 - DNA, 20 bp, Unknown
  RNA secondary structure sequence
gggtttgaatgtgccccggc

SEQ ID NO: 18619 - DNA, 20 bp, Unknown
  RNA secondary structure sequence
gcctgaagaccaaggagtgg

SEQ ID NO: 18620 - DNA, 20 bp, Unknown
  RNA secondary structure sequence
gtacatcccctcctccccca

SEQ ID NO: 18621 - DNA, 20 bp, Unknown
  RNA secondary structure sequence
aacggagaaaagaagccgtg

SEQ ID NO: 18622 - DNA, 20 bp, Unknown
  RNA secondary structure sequence
gcgtcccgccagaacgatcg

SEQ ID NO: 18623 - DNA, 20 bp, Unknown
  RNA secondary structure sequence
cagcgtcctaggactcacct

SEQ ID NO: 18624 - DNA, 20 bp, Unknown
  RNA secondary structure sequence
cgcagcgatcgcgagcgtgt

SEQ ID NO: 18625 - DNA, 20 bp, Unknown
  RNA secondary structure sequence
cgtactcgtgcgcctcgctt

SEQ ID NO: 18626 - DNA, 20 bp, Unknown
  RNA secondary structure sequence
cgccccatcctgtctgtccg

SEQ ID NO: 18627 - DNA, 20 bp, Unknown
  RNA secondary structure sequence
ttcctttagcccgctggcgc

SEQ ID NO: 18628 - DNA, 20 bp, Unknown
  RNA secondary structure sequence
gtgagagggaggctccccat

SEQ ID NO: 18629 - DNA, 20 bp, Unknown
  RNA secondary structure sequence
tcaagctccggacagggaag

SEQ ID NO: 18630 - DNA, 20 bp, Unknown
  RNA secondary structure sequence
ccaaagctgaccaagaagaa

SEQ ID NO: 18631 - DNA, 20 bp, Unknown
  RNA secondary structure sequence
gcctgggtgcagcagtgtgc

SEQ ID NO: 18632 - DNA, 20 bp, Unknown
  RNA secondary structure sequence
tcgtggcgtgtgcggtttcg

SEQ ID NO: 18633 - DNA, 20 bp, Unknown
  RNA secondary structure sequence
cagcacctcctcgccagcag

SEQ ID NO: 18634 - DNA, 20 bp, Unknown
  RNA secondary structure sequence
gccagttcaaagccctgctg

SEQ ID NO: 18635 - DNA, 20 bp, Unknown
  RNA secondary structure sequence
tggcgcttgggtactggctg

SEQ ID NO: 18636 - DNA, 20 bp, Unknown
  RNA secondary structure sequence
catcttggctcactgcagtg

SEQ ID NO: 18637 - DNA, 20 bp, Unknown
  RNA secondary structure sequence
tgtgctgagcggcgggactg

SEQ ID NO: 18638 - DNA, 20 bp, Unknown
  RNA secondary structure sequence
agggggagctggaggctgga

SEQ ID NO: 18639 - DNA, 20 bp, Unknown
  RNA secondary structure sequence
ttctcgtgagcttaggccgc

SEQ ID NO: 18640 - DNA, 20 bp, Unknown
  RNA secondary structure sequence
acaccatggtcaactcctgt

SEQ ID NO: 18641 - DNA, 20 bp, Unknown
  RNA secondary structure sequence
acttttaagtttttccgctt

SEQ ID NO: 18642 - DNA, 20 bp, Unknown
  RNA secondary structure sequence
aggaccacgcaggaggtggt

SEQ ID NO: 18643 - DNA, 20 bp, Unknown
  RNA secondary structure sequence
ccccgcctccacgtgagagc

SEQ ID NO: 18644 - DNA, 20 bp, Unknown
  RNA secondary structure sequence
aggcggggctgctaggcctc

SEQ ID NO: 18645 - DNA, 20 bp, Unknown
  RNA secondary structure sequence
gaaaactacccctaaaagcc

SEQ ID NO: 18646 - DNA, 20 bp, Unknown
  RNA secondary structure sequence
gggcgtggtgtcctggtgct

SEQ ID NO: 18647 - DNA, 20 bp, Unknown
  RNA secondary structure sequence
cccttcggacctcgtctccc

SEQ ID NO: 18648 - DNA, 20 bp, Unknown
  RNA secondary structure sequence
cagtagtaatttgagcctct

SEQ ID NO: 18649 - DNA, 20 bp, Unknown
  RNA secondary structure sequence
ccagctgcagagagcttcag

SEQ ID NO: 18650 - DNA, 20 bp, Unknown
  RNA secondary structure sequence
ttgcaaggaagggcgagatt

SEQ ID NO: 18651 - DNA, 20 bp, Unknown
  RNA secondary structure sequence
cgtggtggtgcaggcgagac

SEQ ID NO: 18652 - DNA, 20 bp, Unknown
  RNA secondary structure sequence
tcaagtgttgcggagatagg

SEQ ID NO: 18653 - DNA, 20 bp, Unknown
  RNA secondary structure sequence
aagatggcggctgctgtagg

SEQ ID NO: 18654 - DNA, 20 bp, Unknown
  RNA secondary structure sequence
acctcgcacagcctctccca

SEQ ID NO: 18655 - DNA, 20 bp, Unknown
  RNA secondary structure sequence
tgagcttcagggaaaagaag

SEQ ID NO: 18656 - DNA, 20 bp, Unknown
  RNA secondary structure sequence
ggtgacgctgctgctggggc

SEQ ID NO: 18657 - DNA, 20 bp, Unknown
  RNA secondary structure sequence
cagctaacctctaatgggag

SEQ ID NO: 18658 - DNA, 20 bp, Unknown
  RNA secondary structure sequence
cagccgctacttaagaggct

SEQ ID NO: 18659 - DNA, 20 bp, Unknown
  RNA secondary structure sequence
tgcaccctcgcacccacacc

SEQ ID NO: 18660 - DNA, 20 bp, Unknown
  RNA secondary structure sequence
cccgcggtcctccgtcggtt

SEQ ID NO: 18661 - DNA, 20 bp, Unknown
  RNA secondary structure sequence
accgacaaccaagaccccgc

SEQ ID NO: 18662 - DNA, 20 bp, Unknown
  RNA secondary structure sequence
ccagaatggctactctgatc

SEQ ID NO: 18663 - DNA, 20 bp, Unknown
  RNA secondary structure sequence
agaggtctgtacctcgaggg

SEQ ID NO: 18664 - DNA, 20 bp, Unknown
  RNA secondary structure sequence
cagtcgccccgacgctagtg

SEQ ID NO: 18665 - DNA, 20 bp, Unknown
  RNA secondary structure sequence
gtcctttgcatctgcacgtg

SEQ ID NO: 18666 - DNA, 20 bp, Unknown
  RNA secondary structure sequence
caccctctcccctcgtccac

SEQ ID NO: 18667 - DNA, 20 bp, Unknown
  RNA secondary structure sequence
tggacaaaatggcgaagatc

SEQ ID NO: 18668 - DNA, 20 bp, Unknown
  RNA secondary structure sequence
ctttatctcctgactcacgg

SEQ ID NO: 18669 - DNA, 20 bp, Unknown
  RNA secondary structure sequence
ggggctgcttagatgcgcca

SEQ ID NO: 18670 - DNA, 20 bp, Unknown
  RNA secondary structure sequence
gagcgccggagcggagggag

SEQ ID NO: 18671 - DNA, 20 bp, Unknown
  RNA secondary structure sequence
ccatggccgcctctcccgga

SEQ ID NO: 18672 - DNA, 20 bp, Unknown
  RNA secondary structure sequence
gataatcggcgcccggggcc

SEQ ID NO: 18673 - DNA, 20 bp, Unknown
  RNA secondary structure sequence
actgtgcacgagcgaagggt

SEQ ID NO: 18674 - DNA, 20 bp, Unknown
  RNA secondary structure sequence
cggtagtcgattggtcaagt

SEQ ID NO: 18675 - DNA, 20 bp, Unknown
  RNA secondary structure sequence
tcctgctcggcggagtggtg

SEQ ID NO: 18676 - DNA, 20 bp, Unknown
  RNA secondary structure sequence
actgtcacatggtgcgcgct

SEQ ID NO: 18677 - DNA, 20 bp, Unknown
  RNA secondary structure sequence
tccgtccgctcgccgcaccg

SEQ ID NO: 18678 - DNA, 20 bp, Unknown
  RNA secondary structure sequence
cgggtttgatatttgacaaa

SEQ ID NO: 18679 - DNA, 20 bp, Unknown
  RNA secondary structure sequence
cctctacccacccgccgcac

SEQ ID NO: 18680 - DNA, 20 bp, Unknown
  RNA secondary structure sequence
ggcggcgaggagagcggtgc

SEQ ID NO: 18681 - DNA, 20 bp, Unknown
  RNA secondary structure sequence
ggactcgagtctcaaccggg

SEQ ID NO: 18682 - DNA, 20 bp, Unknown
  RNA secondary structure sequence
gttggtcctggagcggcgca

SEQ ID NO: 18683 - DNA, 20 bp, Unknown
  RNA secondary structure sequence
cgagcagcagagtccgcacg

SEQ ID NO: 18684 - DNA, 20 bp, Unknown
  RNA secondary structure sequence
cgtgcacattgctttgcttg

SEQ ID NO: 18685 - DNA, 20 bp, Unknown
  RNA secondary structure sequence
cggtagcgggagcggagagc

SEQ ID NO: 18686 - DNA, 20 bp, Unknown
  RNA secondary structure sequence
ccctcggagtcaccgtggcc

SEQ ID NO: 18687 - DNA, 20 bp, Unknown
  RNA secondary structure sequence
gcgcggcatagcccggctcg

SEQ ID NO: 18688 - DNA, 20 bp, Unknown
  RNA secondary structure sequence
ttctttcggttctacctggg

SEQ ID NO: 18689 - DNA, 20 bp, Unknown
  RNA secondary structure sequence
cggacgcagtctggccgcca

SEQ ID NO: 18690 - DNA, 20 bp, Unknown
  RNA secondary structure sequence
ggctctcggctgcagcgctg

SEQ ID NO: 18691 - DNA, 20 bp, Unknown
  RNA secondary structure sequence
cggcgcaggggcggagcgaa

SEQ ID NO: 18692 - DNA, 20 bp, Unknown
  RNA secondary structure sequence
aacaaaaagcaacacccccc

SEQ ID NO: 18693 - DNA, 20 bp, Unknown
  RNA secondary structure sequence
cccatcacttaataaatagc

SEQ ID NO: 18694 - DNA, 20 bp, Unknown
  RNA secondary structure sequence
ttcactgccataaatgtggg

SEQ ID NO: 18695 - DNA, 20 bp, Unknown
  RNA secondary structure sequence
cagccattccgaaggtcaag

SEQ ID NO: 18696 - DNA, 20 bp, Unknown
  RNA secondary structure sequence
ggatgatccatcggtccacg

SEQ ID NO: 18697 - DNA, 20 bp, Unknown
  RNA secondary structure sequence
caccaaagattgagacggac

SEQ ID NO: 18698 - DNA, 20 bp, Unknown
  RNA secondary structure sequence
tgaaagaagagatggagaaa

SEQ ID NO: 18699 - DNA, 20 bp, Unknown
  RNA secondary structure sequence
ggcggtgccccataggatgt

SEQ ID NO: 18700 - DNA, 20 bp, Unknown
  RNA secondary structure sequence
cgaaacacagagtagtgtcc

SEQ ID NO: 18701 - DNA, 20 bp, Unknown
  RNA secondary structure sequence
caaaaacaagtcccatgtcc

SEQ ID NO: 18702 - DNA, 20 bp, Unknown
  RNA secondary structure sequence
agtagactccttcgaacgta

SEQ ID NO: 18703 - DNA, 20 bp, Unknown
  RNA secondary structure sequence
ctaaagacattgtcaccgag

SEQ ID NO: 18704 - DNA, 20 bp, Unknown
  RNA secondary structure sequence
gcttaagaatttaagctctg

SEQ ID NO: 18705 - DNA, 20 bp, Unknown
  RNA secondary structure sequence
tgtgtgtgtgtgtgtgtgtg

SEQ ID NO: 18706 - DNA, 20 bp, Unknown
  RNA secondary structure sequence
cccatcctctctctgtgccc

SEQ ID NO: 18707 - DNA, 20 bp, Unknown
  RNA secondary structure sequence
caagatggctattggtctgc

SEQ ID NO: 18708 - DNA, 20 bp, Unknown
  RNA secondary structure sequence
actcttaagtgcataatgat

SEQ ID NO: 18709 - DNA, 20 bp, Unknown
  RNA secondary structure sequence
ggtgctcacagaaccctttt

SEQ ID NO: 18710 - DNA, 20 bp, Unknown
  RNA secondary structure sequence
aactacccaactatgttgtg

SEQ ID NO: 18711 - DNA, 20 bp, Unknown
  RNA secondary structure sequence
tgaaaagctgtgtcgtgttc

SEQ ID NO: 18712 - DNA, 20 bp, Unknown
  RNA secondary structure sequence
tgtgatccctacctgctccc

SEQ ID NO: 18713 - DNA, 20 bp, Unknown
  RNA secondary structure sequence
cctggactaccagcggatgt

SEQ ID NO: 18714 - DNA, 20 bp, Unknown
  RNA secondary structure sequence
gatcctggattacaaggatt

SEQ ID NO: 18715 - DNA, 20 bp, Unknown
  RNA secondary structure sequence
agggtaccaggatgttcggg

SEQ ID NO: 18716 - DNA, 20 bp, Unknown
  RNA secondary structure sequence
ccaggcaccagaccccagcg

SEQ ID NO: 18717 - DNA, 20 bp, Unknown
  RNA secondary structure sequence
atggcgtagaaatttctatg

SEQ ID NO: 18718 - DNA, 20 bp, Unknown
  RNA secondary structure sequence
tttgtcctgctgtgttgcag

SEQ ID NO: 18719 - DNA, 20 bp, Unknown
  RNA secondary structure sequence
caagtagaatagtttctgag

SEQ ID NO: 18720 - DNA, 20 bp, Unknown
  RNA secondary structure sequence
gtgtgtgtgtgtgtgtgtgt

SEQ ID NO: 18721 - DNA, 20 bp, Unknown
  RNA secondary structure sequence
cctcttccttggtctacata

SEQ ID NO: 18722 - DNA, 20 bp, Unknown
  RNA secondary structure sequence
atgtccatcctggtcacagc

SEQ ID NO: 18723 - DNA, 20 bp, Unknown
  RNA secondary structure sequence
tgggaacatttgacttcctt

SEQ ID NO: 18724 - DNA, 20 bp, Unknown
  RNA secondary structure sequence
gcacagctagctatgcatct

SEQ ID NO: 18725 - DNA, 20 bp, Unknown
  RNA secondary structure sequence
agacaggtgaccgctccagg

SEQ ID NO: 18726 - DNA, 20 bp, Unknown
  RNA secondary structure sequence
ctgtacttcctatgccagcc

SEQ ID NO: 18727 - DNA, 20 bp, Unknown
  RNA secondary structure sequence
tctggtgggcgggcgggagc

SEQ ID NO: 18728 - DNA, 20 bp, Unknown
  RNA secondary structure sequence
gtggattgacaccacggctt

SEQ ID NO: 18729 - DNA, 20 bp, Unknown
  RNA secondary structure sequence
tgcagacaccatcaaggacc

SEQ ID NO: 18730 - DNA, 20 bp, Unknown
  RNA secondary structure sequence
gcgcgagggggaccagctga

SEQ ID NO: 18731 - DNA, 20 bp, Unknown
  RNA secondary structure sequence
gtgtccgggatgtgtggcca

SEQ ID NO: 18732 - DNA, 20 bp, Unknown
  RNA secondary structure sequence
ttacccatgactcagcctgg

SEQ ID NO: 18733 - DNA, 20 bp, Unknown
  RNA secondary structure sequence
gtagctgaggactggtctga

SEQ ID NO: 18734 - DNA, 20 bp, Unknown
  RNA secondary structure sequence
tacacagctatggaataccg

SEQ ID NO: 18735 - DNA, 20 bp, Unknown
  RNA secondary structure sequence
tttctggatgtattgattca

SEQ ID NO: 18736 - DNA, 20 bp, Unknown
  RNA secondary structure sequence
tatattcccccaaaagccaa

SEQ ID NO: 18737 - DNA, 20 bp, Unknown
  RNA secondary structure sequence
agcgcttagatatggtgccg

SEQ ID NO: 18738 - DNA, 20 bp, Unknown
  RNA secondary structure sequence
ctggtgcctctcggctgccc

SEQ ID NO: 18739 - DNA, 20 bp, Unknown
  RNA secondary structure sequence
agaccatggatcacaaccgg

SEQ ID NO: 18740 - DNA, 20 bp, Unknown
  RNA secondary structure sequence
ggcgaagggtatgtggcgag

SEQ ID NO: 18741 - DNA, 20 bp, Unknown
  RNA secondary structure sequence
gatcattcccttttagaagg

SEQ ID NO: 18742 - DNA, 20 bp, Unknown
  RNA secondary structure sequence
gtgcagtattgcattcatta

SEQ ID NO: 18743 - DNA, 20 bp, Unknown
  RNA secondary structure sequence
tcctcctgcctcagcctccc

SEQ ID NO: 18744 - DNA, 20 bp, Unknown
  RNA secondary structure sequence
atatgagccactggcctggc

SEQ ID NO: 18745 - DNA, 20 bp, Unknown
  RNA secondary structure sequence
agccttgaatggcccttgtc

SEQ ID NO: 18746 - DNA, 20 bp, Unknown
  RNA secondary structure sequence
ctcgagccactcccaggacg

SEQ ID NO: 18747 - DNA, 20 bp, Unknown
  RNA secondary structure sequence
agtggcgcggaccttcattt

SEQ ID NO: 18748 - DNA, 20 bp, Unknown
  RNA secondary structure sequence
cctgaccagccatgggggct

SEQ ID NO: 18749 - DNA, 20 bp, Unknown
  RNA secondary structure sequence
tcttggtccatgtgaccgac

SEQ ID NO: 18750 - DNA, 20 bp, Unknown
  RNA secondary structure sequence
ataccttttggggagttgtg

SEQ ID NO: 18751 - DNA, 20 bp, Unknown
  RNA secondary structure sequence
taccctaaactgcctttttt

SEQ ID NO: 18752 - DNA, 20 bp, Unknown
  RNA secondary structure sequence
gtttgggaactggcattact

SEQ ID NO: 18753 - DNA, 20 bp, Unknown
  RNA secondary structure sequence
ggactcagcattgcaaccat

SEQ ID NO: 18754 - DNA, 20 bp, Unknown
  RNA secondary structure sequence
ttctgtccagatgttgaatt

SEQ ID NO: 18755 - DNA, 20 bp, Unknown
  RNA secondary structure sequence
aagaaggggaaagaccaatc

SEQ ID NO: 18756 - DNA, 20 bp, Unknown
  RNA secondary structure sequence
cctacatatgagacaacata

SEQ ID NO: 18757 - DNA, 20 bp, Unknown
  RNA secondary structure sequence
tttggaaaacatatgtgatg

SEQ ID NO: 18758 - DNA, 20 bp, Unknown
  RNA secondary structure sequence
aaaagctattagaagtaaag

SEQ ID NO: 18759 - DNA, 20 bp, Unknown
  RNA secondary structure sequence
ctcttcggtgctaggaaaga

SEQ ID NO: 18760 - DNA, 20 bp, Unknown
  RNA secondary structure sequence
tatacccagccatgaaacaa

SEQ ID NO: 18761 - DNA, 20 bp, Unknown
  RNA secondary structure sequence
tttcaatgtatgtttccatt

SEQ ID NO: 18762 - DNA, 20 bp, Unknown
  RNA secondary structure sequence
agccttttcctaatgcagct

SEQ ID NO: 18763 - DNA, 20 bp, Unknown
  RNA secondary structure sequence
acgggaggccttcacatatt

SEQ ID NO: 18764 - DNA, 20 bp, Unknown
  RNA secondary structure sequence
cctgtctacctttcatgacc

SEQ ID NO: 18765 - DNA, 20 bp, Unknown
  RNA secondary structure sequence
accccaaatttggacttttg

SEQ ID NO: 18766 - DNA, 20 bp, Unknown
  RNA secondary structure sequence
ggaccaccaagaaggcccgg

SEQ ID NO: 18767 - DNA, 20 bp, Unknown
  RNA secondary structure sequence
gaaatcaatggctatacatt

SEQ ID NO: 18768 - DNA, 20 bp, Unknown
  RNA secondary structure sequence
gccaatcagccacccccttt

SEQ ID NO: 18769 - DNA, 20 bp, Unknown
  RNA secondary structure sequence
gaacatggatgttgatatat

SEQ ID NO: 18770 - DNA, 20 bp, Unknown
  RNA secondary structure sequence
ggtgaggtagagctgcaatg

SEQ ID NO: 18771 - DNA, 20 bp, Unknown
  RNA secondary structure sequence
atgagtaaagaaagagatgt

SEQ ID NO: 18772 - DNA, 20 bp, Unknown
  RNA secondary structure sequence
tccattaactttggaccatg

SEQ ID NO: 18773 - DNA, 20 bp, Unknown
  RNA secondary structure sequence
atttccttctgtgggcattg

SEQ ID NO: 18774 - DNA, 20 bp, Unknown
  RNA secondary structure sequence
ctttccctgcccggtcccga

SEQ ID NO: 18775 - DNA, 20 bp, Unknown
  RNA secondary structure sequence
acagttcagaaaagaaaatc

SEQ ID NO: 18776 - DNA, 20 bp, Unknown
  RNA secondary structure sequence
tgtgatgttcaatgtaaagc

SEQ ID NO: 18777 - DNA, 20 bp, Unknown
  RNA secondary structure sequence
gtagaagcagaaaattctaa

SEQ ID NO: 18778 - DNA, 20 bp, Unknown
  RNA secondary structure sequence
tttgaagaaatcaagttcag

SEQ ID NO: 18779 - DNA, 20 bp, Unknown
  RNA secondary structure sequence
actgacttggactttcctga

SEQ ID NO: 18780 - DNA, 20 bp, Unknown
  RNA secondary structure sequence
caaggaaaaagtaaaagaag

SEQ ID NO: 18781 - DNA, 20 bp, Unknown
  RNA secondary structure sequence
gccgtgagtcctcggtgctc

SEQ ID NO: 18782 - DNA, 20 bp, Unknown
  RNA secondary structure sequence
gtattagcagagccacaggc

SEQ ID NO: 18783 - DNA, 20 bp, Unknown
  RNA secondary structure sequence
ccccctcctcactggccctt

SEQ ID NO: 18784 - DNA, 20 bp, Unknown
  RNA secondary structure sequence
acctctagaatcccagcagc

SEQ ID NO: 18785 - DNA, 20 bp, Unknown
  RNA secondary structure sequence
tcaccacgtgcagtatctca

SEQ ID NO: 18786 - DNA, 20 bp, Unknown
  RNA secondary structure sequence
ggttaggactctccactcaa

SEQ ID NO: 18787 - DNA, 20 bp, Unknown
  RNA secondary structure sequence
gctgcaaagtgccgaaacaa

SEQ ID NO: 18788 - DNA, 20 bp, Unknown
  RNA secondary structure sequence
tttctctgaagaagagggtc

SEQ ID NO: 18789 - DNA, 20 bp, Unknown
  RNA secondary structure sequence
ttgcttgtcccccaggagtc

SEQ ID NO: 18790 - DNA, 20 bp, Unknown
  RNA secondary structure sequence
gcctgcagtgattcagcagg

SEQ ID NO: 18791 - DNA, 20 bp, Unknown
  RNA secondary structure sequence
gcttgtcagcaagaggagga

SEQ ID NO: 18792 - DNA, 20 bp, Unknown
  RNA secondary structure sequence
ctaggctggaagagccaaag

SEQ ID NO: 18793 - DNA, 20 bp, Unknown
  RNA secondary structure sequence
tccctaatcacgtggtgaat

SEQ ID NO: 18794 - DNA, 20 bp, Unknown
  RNA secondary structure sequence
tttttgaagccatccgcaga

SEQ ID NO: 18795 - DNA, 20 bp, Unknown
  RNA secondary structure sequence
atccacctctcctttttgcc

SEQ ID NO: 18796 - DNA, 20 bp, Unknown
  RNA secondary structure sequence
cattcttctgctgggtgcca

SEQ ID NO: 18797 - DNA, 20 bp, Unknown
  RNA secondary structure sequence
gagctaggggtgcctgtaag

SEQ ID NO: 18798 - DNA, 20 bp, Unknown
  RNA secondary structure sequence
tttaaagagacatcatcctg

SEQ ID NO: 18799 - DNA, 20 bp, Unknown
  RNA secondary structure sequence
ttcccacccctaataacatt

SEQ ID NO: 18800 - DNA, 20 bp, Unknown
  RNA secondary structure sequence
aacactattgtgctgtttgc

SEQ ID NO: 18801 - DNA, 20 bp, Unknown
  RNA secondary structure sequence
ttttgctcaggttgtaccca

SEQ ID NO: 18802 - DNA, 20 bp, Unknown
  RNA secondary structure sequence
gaccctgaaggatgaatatg

SEQ ID NO: 18803 - DNA, 20 bp, Unknown
  RNA secondary structure sequence
ggacaatgtggatactcatc

SEQ ID NO: 18804 - DNA, 20 bp, Unknown
  RNA secondary structure sequence
gctgtctgctaagttcctgc

SEQ ID NO: 18805 - DNA, 20 bp, Unknown
  RNA secondary structure sequence
gtcgccctctggctcgcacg

SEQ ID NO: 18806 - DNA, 20 bp, Unknown
  RNA secondary structure sequence
catacctcacttgggggagc

SEQ ID NO: 18807 - DNA, 20 bp, Unknown
  RNA secondary structure sequence
ttaagcattggattaacgga

SEQ ID NO: 18808 - DNA, 20 bp, Unknown
  RNA secondary structure sequence
ctgcagaaagagcttgcaga

SEQ ID NO: 18809 - DNA, 20 bp, Unknown
  RNA secondary structure sequence
tctatcactaatatctttgg

SEQ ID NO: 18810 - DNA, 20 bp, Unknown
  RNA secondary structure sequence
ttactggccactggaggcat

SEQ ID NO: 18811 - DNA, 20 bp, Unknown
  RNA secondary structure sequence
tgggctcctgcagccctgtc

SEQ ID NO: 18812 - DNA, 20 bp, Unknown
  RNA secondary structure sequence
cttagcagaggctcaggttc

SEQ ID NO: 18813 - DNA, 20 bp, Unknown
  RNA secondary structure sequence
gctctctttcccccacaaaa

SEQ ID NO: 18814 - DNA, 20 bp, Unknown
  RNA secondary structure sequence
gtgaagaggcgacccagagt

SEQ ID NO: 18815 - DNA, 20 bp, Unknown
  RNA secondary structure sequence
ttacctcccagcagggcagc

SEQ ID NO: 18816 - DNA, 20 bp, Unknown
  RNA secondary structure sequence
agctctaatttgccttgggc

SEQ ID NO: 18817 - DNA, 20 bp, Unknown
  RNA secondary structure sequence
ataagtagaccacttatccc

SEQ ID NO: 18818 - DNA, 20 bp, Unknown
  RNA secondary structure sequence
tacgcccctgcactccagcc

SEQ ID NO: 18819 - DNA, 20 bp, Unknown
  RNA secondary structure sequence
tgcgctataactctacctaa

SEQ ID NO: 18820 - DNA, 20 bp, Unknown
  RNA secondary structure sequence
ctctagctcccacttcctct

SEQ ID NO: 18821 - DNA, 20 bp, Unknown
  RNA secondary structure sequence
atttgttggctgtctgctgt

SEQ ID NO: 18822 - DNA, 20 bp, Unknown
  RNA secondary structure sequence
tcctaatttttactccctct

SEQ ID NO: 18823 - DNA, 20 bp, Unknown
  RNA secondary structure sequence
gcggggcctgcgctcagccc

SEQ ID NO: 18824 - DNA, 20 bp, Unknown
  RNA secondary structure sequence
gctgggtaggtgcacttggt

SEQ ID NO: 18825 - DNA, 20 bp, Unknown
  RNA secondary structure sequence
tcagagtgagcccggatggg

SEQ ID NO: 18826 - DNA, 20 bp, Unknown
  RNA secondary structure sequence
gtagctttattcagaatctg

SEQ ID NO: 18827 - DNA, 20 bp, Unknown
  RNA secondary structure sequence
tcgaggactaacccctacag

SEQ ID NO: 18828 - DNA, 20 bp, Unknown
  RNA secondary structure sequence
tgggaaccaaaggatgatgc

SEQ ID NO: 18829 - DNA, 20 bp, Unknown
  RNA secondary structure sequence
tgttgaacacttgaagccat

SEQ ID NO: 18830 - DNA, 20 bp, Unknown
  RNA secondary structure sequence
gcctgcaccccggagcggat

SEQ ID NO: 18831 - DNA, 20 bp, Unknown
  RNA secondary structure sequence
cagtgaatgtgtctggacct

SEQ ID NO: 18832 - DNA, 20 bp, Unknown
  RNA secondary structure sequence
agctgcagggtggattgtta

SEQ ID NO: 18833 - DNA, 20 bp, Unknown
  RNA secondary structure sequence
cagaatgcttcaagtgtttg

SEQ ID NO: 18834 - DNA, 20 bp, Unknown
  RNA secondary structure sequence
atccagtaataaaatggaag

SEQ ID NO: 18835 - DNA, 20 bp, Unknown
  RNA secondary structure sequence
cctgcactctcagaaatcag

SEQ ID NO: 18836 - DNA, 20 bp, Unknown
  RNA secondary structure sequence
gactatgaaaatccagatga

SEQ ID NO: 18837 - DNA, 20 bp, Unknown
  RNA secondary structure sequence
tccccacccttcagcaagac

SEQ ID NO: 18838 - DNA, 20 bp, Unknown
  RNA secondary structure sequence
gaaaactatattcatcccac

SEQ ID NO: 18839 - DNA, 20 bp, Unknown
  RNA secondary structure sequence
ttgccacgggccgggaaaaa

SEQ ID NO: 18840 - DNA, 20 bp, Unknown
  RNA secondary structure sequence
tggttggtgttggccgagcc

SEQ ID NO: 18841 - DNA, 20 bp, Unknown
  RNA secondary structure sequence
tgatggaggaattcgctttc

SEQ ID NO: 18842 - DNA, 20 bp, Unknown
  RNA secondary structure sequence
gagaagggagctcgggagca

SEQ ID NO: 18843 - DNA, 20 bp, Unknown
  RNA secondary structure sequence
gtcattggcggccgctcagg

SEQ ID NO: 18844 - DNA, 20 bp, Unknown
  RNA secondary structure sequence
aaaaggacctggtctaaaac

SEQ ID NO: 18845 - DNA, 20 bp, Unknown
  RNA secondary structure sequence
agcgaattgcatcgtcctcg

SEQ ID NO: 18846 - DNA, 20 bp, Unknown
  RNA secondary structure sequence
tggctggaatgtcatggact

SEQ ID NO: 18847 - DNA, 20 bp, Unknown
  RNA secondary structure sequence
tgggaccaaatgtcagccct

SEQ ID NO: 18848 - DNA, 20 bp, Unknown
  RNA secondary structure sequence
ccccctcatcatcatcggct

SEQ ID NO: 18849 - DNA, 20 bp, Unknown
  RNA secondary structure sequence
ggaggtggcagaagtgagtc

SEQ ID NO: 18850 - DNA, 20 bp, Unknown
  RNA secondary structure sequence
gggcgaggccgagcgaggca

SEQ ID NO: 18851 - DNA, 20 bp, Unknown
  RNA secondary structure sequence
ccagagcccagccaagatgg

SEQ ID NO: 18852 - DNA, 20 bp, Unknown
  RNA secondary structure sequence
cgaccgtggggaagacggcc

SEQ ID NO: 18853 - DNA, 20 bp, Unknown
  RNA secondary structure sequence
tgtgcagcccaacgcacctc

SEQ ID NO: 18854 - DNA, 20 bp, Unknown
  RNA secondary structure sequence
ccccttcttctttgtcaata

SEQ ID NO: 18855 - DNA, 20 bp, Unknown
  RNA secondary structure sequence
gtaccgcatgtggcagttcg

SEQ ID NO: 18856 - DNA, 20 bp, Unknown
  RNA secondary structure sequence
gctgaaagtcatggcttttg

SEQ ID NO: 18857 - DNA, 20 bp, Unknown
  RNA secondary structure sequence
agatgagttccaaatcactg

SEQ ID NO: 18858 - DNA, 20 bp, Unknown
  RNA secondary structure sequence
gatgatcatggagtactacc

SEQ ID NO: 18859 - DNA, 20 bp, Unknown
  RNA secondary structure sequence
ctccgacagcgagcactacc

SEQ ID NO: 18860 - DNA, 20 bp, Unknown
  RNA secondary structure sequence
cagcgagggccgagagcaca

SEQ ID NO: 18861 - DNA, 20 bp, Unknown
  RNA secondary structure sequence
caggatggagaggcgggtcc

SEQ ID NO: 18862 - DNA, 20 bp, Unknown
  RNA secondary structure sequence
acaccagctcctgtgctgcg

SEQ ID NO: 18863 - DNA, 20 bp, Unknown
  RNA secondary structure sequence
cgccacctggatgctggagg

SEQ ID NO: 18864 - DNA, 20 bp, Unknown
  RNA secondary structure sequence
cgtggacatctgagggcgcc

SEQ ID NO: 18865 - DNA, 20 bp, Unknown
  RNA secondary structure sequence
ccgaggggaaggggcggtgc

SEQ ID NO: 18866 - DNA, 20 bp, Unknown
  RNA secondary structure sequence
tggggcaagggcacaagtcc

SEQ ID NO: 18867 - DNA, 20 bp, Unknown
  RNA secondary structure sequence
aaagggaccgcttggagcag

SEQ ID NO: 18868 - DNA, 20 bp, Unknown
  RNA secondary structure sequence
acagcgacaaagtgaaagcc

SEQ ID NO: 18869 - DNA, 20 bp, Unknown
  RNA secondary structure sequence
tggcgcgggagtacggatcc

SEQ ID NO: 18870 - DNA, 20 bp, Unknown
  RNA secondary structure sequence
attcggaaatcgatcagatc

SEQ ID NO: 18871 - DNA, 20 bp, Unknown
  RNA secondary structure sequence
tcatgaacaagttcctgacc

SEQ ID NO: 18872 - DNA, 20 bp, Unknown
  RNA secondary structure sequence
tggtcccctctcctctccgc

SEQ ID NO: 18873 - DNA, 20 bp, Unknown
  RNA secondary structure sequence
cgggctgcgtaggggcgctt

SEQ ID NO: 18874 - DNA, 20 bp, Unknown
  RNA secondary structure sequence
caatgcgcaggaataaggaa

SEQ ID NO: 18875 - DNA, 20 bp, Unknown
  RNA secondary structure sequence
cgctaagctccagtcggcgc

SEQ ID NO: 18876 - DNA, 20 bp, Unknown
  RNA secondary structure sequence
actctggagctcccattctt

SEQ ID NO: 18877 - DNA, 20 bp, Unknown
  RNA secondary structure sequence
cttccctgtctgatccttag

SEQ ID NO: 18878 - DNA, 20 bp, Unknown
  RNA secondary structure sequence
tggcatggcaatggttagag

SEQ ID NO: 18879 - DNA, 20 bp, Unknown
  RNA secondary structure sequence
aaggagccaggagttaatac

SEQ ID NO: 18880 - DNA, 20 bp, Unknown
  RNA secondary structure sequence
tcacctggaaggggagttac

SEQ ID NO: 18881 - DNA, 20 bp, Unknown
  RNA secondary structure sequence
gcagaaagctgaggaggctg

SEQ ID NO: 18882 - DNA, 20 bp, Unknown
  RNA secondary structure sequence
ggtcaccaaggggcagctgg

SEQ ID NO: 18883 - DNA, 20 bp, Unknown
  RNA secondary structure sequence
tcatcaagacctgtggaaga

SEQ ID NO: 18884 - DNA, 20 bp, Unknown
  RNA secondary structure sequence
tttggccctcctgacccaga

SEQ ID NO: 18885 - DNA, 20 bp, Unknown
  RNA secondary structure sequence
ggagctagagaagtgtaggt

SEQ ID NO: 18886 - DNA, 20 bp, Unknown
  RNA secondary structure sequence
gaggagagaccaggagctga

SEQ ID NO: 18887 - DNA, 20 bp, Unknown
  RNA secondary structure sequence
cctcctcctgtcccagcgag

SEQ ID NO: 18888 - DNA, 20 bp, Unknown
  RNA secondary structure sequence
ggcccagggacaggaggaga

SEQ ID NO: 18889 - DNA, 20 bp, Unknown
  RNA secondary structure sequence
ggaggtgctgggagacctaa

SEQ ID NO: 18890 - DNA, 20 bp, Unknown
  RNA secondary structure sequence
ggcactctccctagcgcaga

SEQ ID NO: 18891 - DNA, 20 bp, Unknown
  RNA secondary structure sequence
cacagcagaactggggtcca

SEQ ID NO: 18892 - DNA, 20 bp, Unknown
  RNA secondary structure sequence
ggcagagacccgcaggctgg

SEQ ID NO: 18893 - DNA, 20 bp, Unknown
  RNA secondary structure sequence
gtttgccaaaggaaaagcct

SEQ ID NO: 18894 - DNA, 20 bp, Unknown
  RNA secondary structure sequence
tagagagagcgcgctctgct

SEQ ID NO: 18895 - DNA, 20 bp, Unknown
  RNA secondary structure sequence
tttatttatttttcgttttt

SEQ ID NO: 18896 - DNA, 20 bp, Unknown
  RNA secondary structure sequence
cagcagctctgaatcttctg

SEQ ID NO: 18897 - DNA, 20 bp, Unknown
  RNA secondary structure sequence
tcggaagccggcaccctcaa

SEQ ID NO: 18898 - DNA, 20 bp, Unknown
  RNA secondary structure sequence
tgatttcaagtccaaccata

SEQ ID NO: 18899 - DNA, 20 bp, Unknown
  RNA secondary structure sequence
gctagagcctttccttctcc

SEQ ID NO: 18900 - DNA, 20 bp, Unknown
  RNA secondary structure sequence
ctctgcttctgagagtgaaa

SEQ ID NO: 18901 - DNA, 20 bp, Unknown
  RNA secondary structure sequence
agcacgtgatgctgagctgg

SEQ ID NO: 18902 - DNA, 20 bp, Unknown
  RNA secondary structure sequence
gatttatgaacatggctatg

SEQ ID NO: 18903 - DNA, 20 bp, Unknown
  RNA secondary structure sequence
tattacagcaggaagtgaac

SEQ ID NO: 18904 - DNA, 20 bp, Unknown
  RNA secondary structure sequence
agaagaggagcaaaagaaga

SEQ ID NO: 18905 - DNA, 20 bp, Unknown
  RNA secondary structure sequence
gcgacatatggatgcccacc

SEQ ID NO: 18906 - DNA, 20 bp, Unknown
  RNA secondary structure sequence
ccaccagcaggatttccgac

SEQ ID NO: 18907 - DNA, 20 bp, Unknown
  RNA secondary structure sequence
tttgacgggcacttggagga

SEQ ID NO: 18908 - DNA, 20 bp, Unknown
  RNA secondary structure sequence
ggacctggtgaacagtgtgt

SEQ ID NO: 18909 - DNA, 20 bp, Unknown
  RNA secondary structure sequence
atgtgaaacctgtgggtggg

SEQ ID NO: 18910 - DNA, 20 bp, Unknown
  RNA secondary structure sequence
tggctgactgagtactgtga

SEQ ID NO: 18911 - DNA, 20 bp, Unknown
  RNA secondary structure sequence
ggagaaggggatgcagaggc

SEQ ID NO: 18912 - DNA, 20 bp, Unknown
  RNA secondary structure sequence
ctatggccttagaaaagggc

SEQ ID NO: 18913 - DNA, 20 bp, Unknown
  RNA secondary structure sequence
tgcaggcgcagccgcggcga

SEQ ID NO: 18914 - DNA, 20 bp, Unknown
  RNA secondary structure sequence
ggcagccatgtccatgggcc

SEQ ID NO: 18915 - DNA, 20 bp, Unknown
  RNA secondary structure sequence
gagcaccggccagatgcagt

SEQ ID NO: 18916 - DNA, 20 bp, Unknown
  RNA secondary structure sequence
caagatcaccatcgtggcag

SEQ ID NO: 18917 - DNA, 20 bp, Unknown
  RNA secondary structure sequence
gcagctgctggggggcgcgc

SEQ ID NO: 18918 - DNA, 20 bp, Unknown
  RNA secondary structure sequence
ggggcccagggaccaacctg

SEQ ID NO: 18919 - DNA, 20 bp, Unknown
  RNA secondary structure sequence
aaaaatggaaattttcaaga

SEQ ID NO: 18920 - DNA, 20 bp, Unknown
  RNA secondary structure sequence
ggctggctaccaagagttta

SEQ ID NO: 18921 - DNA, 20 bp, Unknown
  RNA secondary structure sequence
ttttgatcgcgggaggaccg

SEQ ID NO: 18922 - DNA, 20 bp, Unknown
  RNA secondary structure sequence
ggcagaatcagcctgttttg

SEQ ID NO: 18923 - DNA, 20 bp, Unknown
  RNA secondary structure sequence
agttccacccagaggtcacc

SEQ ID NO: 18924 - DNA, 20 bp, Unknown
  RNA secondary structure sequence
tgttttcagataaactaaat

SEQ ID NO: 18925 - DNA, 20 bp, Unknown
  RNA secondary structure sequence
ttgtggctcctgcccagaca

SEQ ID NO: 18926 - DNA, 20 bp, Unknown
  RNA secondary structure sequence
caaactatctctatgttacc

SEQ ID NO: 18927 - DNA, 20 bp, Unknown
  RNA secondary structure sequence
ggccttcctatgttttgagt

SEQ ID NO: 18928 - DNA, 20 bp, Unknown
  RNA secondary structure sequence
tgcagaaatctcgcaaggtg

SEQ ID NO: 18929 - DNA, 20 bp, Unknown
  RNA secondary structure sequence
ttctttttgagatggagtca

SEQ ID NO: 18930 - DNA, 20 bp, Unknown
  RNA secondary structure sequence
atttgattggtgtgctgtct

SEQ ID NO: 18931 - DNA, 20 bp, Unknown
  RNA secondary structure sequence
gctgacaaaatttgttgaag

SEQ ID NO: 18932 - DNA, 20 bp, Unknown
  RNA secondary structure sequence
gaaggatgctacccggaaga

SEQ ID NO: 18933 - DNA, 20 bp, Unknown
  RNA secondary structure sequence
gctcaacgccaacaatgtcc

SEQ ID NO: 18934 - DNA, 20 bp, Unknown
  RNA secondary structure sequence
agctgttgatagtggaatcc

SEQ ID NO: 18935 - DNA, 20 bp, Unknown
  RNA secondary structure sequence
aagttgagaaatgtgacaga

SEQ ID NO: 18936 - DNA, 20 bp, Unknown
  RNA secondary structure sequence
aagtaaggttcattccctta

SEQ ID NO: 18937 - DNA, 20 bp, Unknown
  RNA secondary structure sequence
actagcgcaggagaaggcta

SEQ ID NO: 18938 - DNA, 20 bp, Unknown
  RNA secondary structure sequence
accacagagattaacttcaa

SEQ ID NO: 18939 - DNA, 20 bp, Unknown
  RNA secondary structure sequence
gaactgatcctgaccatgac

SEQ ID NO: 18940 - DNA, 20 bp, Unknown
  RNA secondary structure sequence
cagtcacttctgggggtcac

SEQ ID NO: 18941 - DNA, 20 bp, Unknown
  RNA secondary structure sequence
gttccgtacagggtataaaa

SEQ ID NO: 18942 - DNA, 20 bp, Unknown
  RNA secondary structure sequence
gaccaacgatggggaactga

SEQ ID NO: 18943 - DNA, 20 bp, Unknown
  RNA secondary structure sequence
gctccccttaccccagtcac

SEQ ID NO: 18944 - DNA, 20 bp, Unknown
  RNA secondary structure sequence
ggcggctcgagctcctggaa

SEQ ID NO: 18945 - DNA, 20 bp, Unknown
  RNA secondary structure sequence
tctccggtcccctcctcgga

SEQ ID NO: 18946 - DNA, 20 bp, Unknown
  RNA secondary structure sequence
tttctatacagcagcaacaa

SEQ ID NO: 18947 - DNA, 20 bp, Unknown
  RNA secondary structure sequence
tcatcatctagccaggcatg

SEQ ID NO: 18948 - DNA, 20 bp, Unknown
  RNA secondary structure sequence
tggaagttgctctcaaggga

SEQ ID NO: 18949 - DNA, 20 bp, Unknown
  RNA secondary structure sequence
cctcctcacaaggtttcctg

SEQ ID NO: 18950 - DNA, 20 bp, Unknown
  RNA secondary structure sequence
ggcaagtggcatctgaattt

SEQ ID NO: 18951 - DNA, 20 bp, Unknown
  RNA secondary structure sequence
gcgcgccacaatgagctccc

SEQ ID NO: 18952 - DNA, 20 bp, Unknown
  RNA secondary structure sequence
catggaggaccaggacggcc

SEQ ID NO: 18953 - DNA, 20 bp, Unknown
  RNA secondary structure sequence
tattgttcaaacaacttcat

SEQ ID NO: 18954 - DNA, 20 bp, Unknown
  RNA secondary structure sequence
gaacgtcatgatgatccagt

SEQ ID NO: 18955 - DNA, 20 bp, Unknown
  RNA secondary structure sequence
cgcggagctggccgctggat

SEQ ID NO: 18956 - DNA, 20 bp, Unknown
  RNA secondary structure sequence
tccttacttagcaagactat

SEQ ID NO: 18957 - DNA, 20 bp, Unknown
  RNA secondary structure sequence
ggtgtagaggcccctgccag

SEQ ID NO: 18958 - DNA, 20 bp, Unknown
  RNA secondary structure sequence
gaagctggcaccacagttcc

SEQ ID NO: 18959 - DNA, 20 bp, Unknown
  RNA secondary structure sequence
gcctgggttggcacctactt

SEQ ID NO: 18960 - DNA, 20 bp, Unknown
  RNA secondary structure sequence
gaggatcccaatgcgcctcc

SEQ ID NO: 18961 - DNA, 20 bp, Unknown
  RNA secondary structure sequence
tggtgttgtctgtggagacc

SEQ ID NO: 18962 - DNA, 20 bp, Unknown
  RNA secondary structure sequence
ccagggtgtttcaaacttag

SEQ ID NO: 18963 - DNA, 20 bp, Unknown
  RNA secondary structure sequence
aggggctggaagctggaggg

SEQ ID NO: 18964 - DNA, 20 bp, Unknown
  RNA secondary structure sequence
actgctctccagagggcatt

SEQ ID NO: 18965 - DNA, 20 bp, Unknown
  RNA secondary structure sequence
ttcgcgccgaatccccgggg

SEQ ID NO: 18966 - DNA, 20 bp, Unknown
  RNA secondary structure sequence
ctgctgctgcccctctgggg

SEQ ID NO: 18967 - DNA, 20 bp, Unknown
  RNA secondary structure sequence
attcctgatggcacggctgt

SEQ ID NO: 18968 - DNA, 20 bp, Unknown
  RNA secondary structure sequence
gctgcggatgaacctgtgac

SEQ ID NO: 18969 - DNA, 20 bp, Unknown
  RNA secondary structure sequence
atcgccaataagaagccccc

SEQ ID NO: 18970 - DNA, 20 bp, Unknown
  RNA secondary structure sequence
ccagtcagggatcctgttcc

SEQ ID NO: 18971 - DNA, 20 bp, Unknown
  RNA secondary structure sequence
gcagttgctacccctcccac

SEQ ID NO: 18972 - DNA, 20 bp, Unknown
  RNA secondary structure sequence
actgacaagctgaagctgac

SEQ ID NO: 18973 - DNA, 20 bp, Unknown
  RNA secondary structure sequence
atcactgtgacgggctctgg

SEQ ID NO: 18974 - DNA, 20 bp, Unknown
  RNA secondary structure sequence
gaggagaaggctcccctacc

SEQ ID NO: 18975 - DNA, 20 bp, Unknown
  RNA secondary structure sequence
cgtcccaagaacatgacccc

SEQ ID NO: 18976 - DNA, 20 bp, Unknown
  RNA secondary structure sequence
agtggaggtggagggagcga

SEQ ID NO: 18977 - DNA, 20 bp, Unknown
  RNA secondary structure sequence
cccacgaccaaggggtcttc

SEQ ID NO: 18978 - DNA, 20 bp, Unknown
  RNA secondary structure sequence
tacagcagtttgtacgagct

SEQ ID NO: 18979 - DNA, 20 bp, Unknown
  RNA secondary structure sequence
tccccagggggtactctgga

SEQ ID NO: 18980 - DNA, 20 bp, Unknown
  RNA secondary structure sequence
tcccttggggtgccgagtgg

SEQ ID NO: 18981 - DNA, 20 bp, Unknown
  RNA secondary structure sequence
gaggaagatcatggactgtc

SEQ ID NO: 18982 - DNA, 20 bp, Unknown
  RNA secondary structure sequence
ggactgtggttggatttatg

SEQ ID NO: 18983 - DNA, 20 bp, Unknown
  RNA secondary structure sequence
aagatatttgaatgaaatag

SEQ ID NO: 18984 - DNA, 20 bp, Unknown
  RNA secondary structure sequence
acctgcgtcaggtggcagtt

SEQ ID NO: 18985 - DNA, 20 bp, Unknown
  RNA secondary structure sequence
ttctggtcttaagtataatg

SEQ ID NO: 18986 - DNA, 20 bp, Unknown
  RNA secondary structure sequence
ccagaaagtccatatgctgt

SEQ ID NO: 18987 - DNA, 20 bp, Unknown
  RNA secondary structure sequence
cctagccattgctgatgttt

SEQ ID NO: 18988 - DNA, 20 bp, Unknown
  RNA secondary structure sequence
tgtccagtggctgaagcccc

SEQ ID NO: 18989 - DNA, 20 bp, Unknown
  RNA secondary structure sequence
agaccctaaagggattgttc

SEQ ID NO: 18990 - DNA, 20 bp, Unknown
  RNA secondary structure sequence
agaagacatttgggaataca

SEQ ID NO: 18991 - DNA, 20 bp, Unknown
  RNA secondary structure sequence
ggctggtgatcatcctttta

SEQ ID NO: 18992 - DNA, 20 bp, Unknown
  RNA secondary structure sequence
caagcttcatgtgcaagaac

SEQ ID NO: 18993 - DNA, 20 bp, Unknown
  RNA secondary structure sequence
tccctgggacccttaatttc

SEQ ID NO: 18994 - DNA, 20 bp, Unknown
  RNA secondary structure sequence
tccagactataaaagcggct

SEQ ID NO: 18995 - DNA, 20 bp, Unknown
  RNA secondary structure sequence
cttgatgagctgcctaaatt

SEQ ID NO: 18996 - DNA, 20 bp, Unknown
  RNA secondary structure sequence
agaggcgatgggcctatttg

SEQ ID NO: 18997 - DNA, 20 bp, Unknown
  RNA secondary structure sequence
attgcaacacctggaagact

SEQ ID NO: 18998 - DNA, 20 bp, Unknown
  RNA secondary structure sequence
gcgacttggccaaaagaagt

SEQ ID NO: 18999 - DNA, 20 bp, Unknown
  RNA secondary structure sequence
agtgagaaggagaataaaac

SEQ ID NO: 19000 - DNA, 20 bp, Unknown
  RNA secondary structure sequence
attgctacagatgtggcctc

SEQ ID NO: 19001 - DNA, 20 bp, Unknown
  RNA secondary structure sequence
taaattctgattattaaact

SEQ ID NO: 19002 - DNA, 20 bp, Unknown
  RNA secondary structure sequence
gagccagcacgatggtccta

SEQ ID NO: 19003 - DNA, 20 bp, Unknown
  RNA secondary structure sequence
agcactctgccgctcaagag

SEQ ID NO: 19004 - DNA, 20 bp, Unknown
  RNA secondary structure sequence
ctgcagtaccccactctacg

SEQ ID NO: 19005 - DNA, 20 bp, Unknown
  RNA secondary structure sequence
cgtgttcaacttccccgtct

SEQ ID NO: 19006 - DNA, 20 bp, Unknown
  RNA secondary structure sequence
tggtacattgcttggctggc

SEQ ID NO: 19007 - DNA, 20 bp, Unknown
  RNA secondary structure sequence
tacagcctacccatgcaggg

SEQ ID NO: 19008 - DNA, 20 bp, Unknown
  RNA secondary structure sequence
tttcctcatgattttttctc

SEQ ID NO: 19009 - DNA, 20 bp, Unknown
  RNA secondary structure sequence
gtgcagcctcccgagtgcag

SEQ ID NO: 19010 - DNA, 20 bp, Unknown
  RNA secondary structure sequence
agtaccctgtgcagccagga

SEQ ID NO: 19011 - DNA, 20 bp, Unknown
  RNA secondary structure sequence
ggtcacagggagcaatcatt

SEQ ID NO: 19012 - DNA, 20 bp, Unknown
  RNA secondary structure sequence
tggcatctcacacagtggaa

SEQ ID NO: 19013 - DNA, 20 bp, Unknown
  RNA secondary structure sequence
tggacaaggccaataaaaca

SEQ ID NO: 19014 - DNA, 20 bp, Unknown
  RNA secondary structure sequence
cccaggacctattccgcagg

SEQ ID NO: 19015 - DNA, 20 bp, Unknown
  RNA secondary structure sequence
cggcagaggaacgaggacgc

SEQ ID NO: 19016 - DNA, 20 bp, Unknown
  RNA secondary structure sequence
tggatgatggtggctggaac

SEQ ID NO: 19017 - DNA, 20 bp, Unknown
  RNA secondary structure sequence
tgaagcgagaagctgcccta

SEQ ID NO: 19018 - DNA, 20 bp, Unknown
  RNA secondary structure sequence
tacggcatggtgtcgagtct

SEQ ID NO: 19019 - DNA, 20 bp, Unknown
  RNA secondary structure sequence
tgtggcgagaagccgggctt

SEQ ID NO: 19020 - DNA, 20 bp, Unknown
  RNA secondary structure sequence
agggcagcagtaaccagcgg

SEQ ID NO: 19021 - DNA, 20 bp, Unknown
  RNA secondary structure sequence
tgcagaaatacctgtgtgac

SEQ ID NO: 19022 - DNA, 20 bp, Unknown
  RNA secondary structure sequence
agcagcggcggtggcagtgg

SEQ ID NO: 19023 - DNA, 20 bp, Unknown
  RNA secondary structure sequence
ctggccttttagggcctgac

SEQ ID NO: 19024 - DNA, 20 bp, Unknown
  RNA secondary structure sequence
acaggggcgttccacatacg

SEQ ID NO: 19025 - DNA, 20 bp, Unknown
  RNA secondary structure sequence
gaaccagccaccccagattg

SEQ ID NO: 19026 - DNA, 20 bp, Unknown
  RNA secondary structure sequence
gccccaggttgctgtcattg

SEQ ID NO: 19027 - DNA, 20 bp, Unknown
  RNA secondary structure sequence
agtcctctctattcctgggg

SEQ ID NO: 19028 - DNA, 20 bp, Unknown
  RNA secondary structure sequence
gttttcttccagtcctctcc

SEQ ID NO: 19029 - DNA, 20 bp, Unknown
  RNA secondary structure sequence
tgcccaacctgaggaactgc

SEQ ID NO: 19030 - DNA, 20 bp, Unknown
  RNA secondary structure sequence
gaggagacggaaaattaagg

SEQ ID NO: 19031 - DNA, 20 bp, Unknown
  RNA secondary structure sequence
gccagagggattgccacata

SEQ ID NO: 19032 - DNA, 20 bp, Unknown
  RNA secondary structure sequence
tgagaaggccatttcagagc

SEQ ID NO: 19033 - DNA, 20 bp, Unknown
  RNA secondary structure sequence
tcctccaggccctcccatca

SEQ ID NO: 19034 - DNA, 20 bp, Unknown
  RNA secondary structure sequence
tagcctcacggaggatcggg

SEQ ID NO: 19035 - DNA, 20 bp, Unknown
  RNA secondary structure sequence
attggctgaggacatggaaa

SEQ ID NO: 19036 - DNA, 20 bp, Unknown
  RNA secondary structure sequence
cctgtgcaaaagcatgggtc

SEQ ID NO: 19037 - DNA, 20 bp, Unknown
  RNA secondary structure sequence
acagagatatattatatata

SEQ ID NO: 19038 - DNA, 20 bp, Unknown
  RNA secondary structure sequence
cattcggggagactctggtg

SEQ ID NO: 19039 - DNA, 20 bp, Unknown
  RNA secondary structure sequence
tgtgctccttgatgttaagt

SEQ ID NO: 19040 - DNA, 20 bp, Unknown
  RNA secondary structure sequence
ctgctcctatggctcaaggg

SEQ ID NO: 19041 - DNA, 20 bp, Unknown
  RNA secondary structure sequence
ttgtgactgaatatctaaat

SEQ ID NO: 19042 - DNA, 20 bp, Unknown
  RNA secondary structure sequence
cttttgttcccaggaaggga

SEQ ID NO: 19043 - DNA, 20 bp, Unknown
  RNA secondary structure sequence
tttcggagagacctcatcta

SEQ ID NO: 19044 - DNA, 20 bp, Unknown
  RNA secondary structure sequence
caaacgaaaaagaacgacat

SEQ ID NO: 19045 - DNA, 20 bp, Unknown
  RNA secondary structure sequence
tctatgataagcgtgaaaat

SEQ ID NO: 19046 - DNA, 20 bp, Unknown
  RNA secondary structure sequence
ctcccacacaatcgcagttt

SEQ ID NO: 19047 - DNA, 20 bp, Unknown
  RNA secondary structure sequence
ctcgtgccatcatttcagag

SEQ ID NO: 19048 - DNA, 20 bp, Unknown
  RNA secondary structure sequence
atcacgttgatctacaagtc

SEQ ID NO: 19049 - DNA, 20 bp, Unknown
  RNA secondary structure sequence
gcaggtccaaccacgctggt

SEQ ID NO: 19050 - DNA, 20 bp, Unknown
  RNA secondary structure sequence
aatcagcacatcatgatggt

SEQ ID NO: 19051 - DNA, 20 bp, Unknown
  RNA secondary structure sequence
ggaggtggcagcagaaatcc

SEQ ID NO: 19052 - DNA, 20 bp, Unknown
  RNA secondary structure sequence
gacagggagtttctgctgga

SEQ ID NO: 19053 - DNA, 20 bp, Unknown
  RNA secondary structure sequence
gattttggaaggcagacacc

SEQ ID NO: 19054 - DNA, 20 bp, Unknown
  RNA secondary structure sequence
gctattgatgaacccagttt

SEQ ID NO: 19055 - DNA, 20 bp, Unknown
  RNA secondary structure sequence
gtgaagctgctaaagaacca

SEQ ID NO: 19056 - DNA, 20 bp, Unknown
  RNA secondary structure sequence
gatgccttacggtcaagtgc

SEQ ID NO: 19057 - DNA, 20 bp, Unknown
  RNA secondary structure sequence
cggccaaatactttcatgag

SEQ ID NO: 19058 - DNA, 20 bp, Unknown
  RNA secondary structure sequence
gtggagtccaccctggaaag

SEQ ID NO: 19059 - DNA, 20 bp, Unknown
  RNA secondary structure sequence
gctgaactggtgacccccat

SEQ ID NO: 19060 - DNA, 20 bp, Unknown
  RNA secondary structure sequence
atcacagtgcagcaaggcca

SEQ ID NO: 19061 - DNA, 20 bp, Unknown
  RNA secondary structure sequence
cgaatcttcactcccgctgt

SEQ ID NO: 19062 - DNA, 20 bp, Unknown
  RNA secondary structure sequence
actgcagtgtaccaggctaa

SEQ ID NO: 19063 - DNA, 20 bp, Unknown
  RNA secondary structure sequence
cctggaccaggacctgggga

SEQ ID NO: 19064 - DNA, 20 bp, Unknown
  RNA secondary structure sequence
agcgaccagaagcaagagga

SEQ ID NO: 19065 - DNA, 20 bp, Unknown
  RNA secondary structure sequence
tcttctgttgctcgaagtac

SEQ ID NO: 19066 - DNA, 20 bp, Unknown
  RNA secondary structure sequence
acaccagcctttgctgattt

SEQ ID NO: 19067 - DNA, 20 bp, Unknown
  RNA secondary structure sequence
gttgggtcacgaagatctca

SEQ ID NO: 19068 - DNA, 20 bp, Unknown
  RNA secondary structure sequence
aggcttcatgatgaactgga

SEQ ID NO: 19069 - DNA, 20 bp, Unknown
  RNA secondary structure sequence
gcagatcaagggcctaaaac

SEQ ID NO: 19070 - DNA, 20 bp, Unknown
  RNA secondary structure sequence
caacctccagcaccctcagg

SEQ ID NO: 19071 - DNA, 20 bp, Unknown
  RNA secondary structure sequence
aatcagtctcaagaagagca

SEQ ID NO: 19072 - DNA, 20 bp, Unknown
  RNA secondary structure sequence
ctttatgcactacaagcatc

SEQ ID NO: 19073 - DNA, 20 bp, Unknown
  RNA secondary structure sequence
gagtgggagaggggaaagag

SEQ ID NO: 19074 - DNA, 20 bp, Unknown
  RNA secondary structure sequence
aagtggagaagaacaagtac

SEQ ID NO: 19075 - DNA, 20 bp, Unknown
  RNA secondary structure sequence
tcggagactatggcctcgcc

SEQ ID NO: 19076 - DNA, 20 bp, Unknown
  RNA secondary structure sequence
atctattttttctaaaacat

SEQ ID NO: 19077 - DNA, 20 bp, Unknown
  RNA secondary structure sequence
ttgtcttagctacctgtgta

SEQ ID NO: 19078 - DNA, 20 bp, Unknown
  RNA secondary structure sequence
gatgcgaatgatcctgtcac

SEQ ID NO: 19079 - DNA, 20 bp, Unknown
  RNA secondary structure sequence
tactgaccctgagcaacccc

SEQ ID NO: 19080 - DNA, 20 bp, Unknown
  RNA secondary structure sequence
ggccctttgaccagggcagc

SEQ ID NO: 19081 - DNA, 20 bp, Unknown
  RNA secondary structure sequence
gtgacgtggacctggatccc

SEQ ID NO: 19082 - DNA, 20 bp, Unknown
  RNA secondary structure sequence
cccacctgtgggagttcatc

SEQ ID NO: 19083 - DNA, 20 bp, Unknown
  RNA secondary structure sequence
aaaccttcctgggaggacag

SEQ ID NO: 19084 - DNA, 20 bp, Unknown
  RNA secondary structure sequence
caggccctccagtgggctga

SEQ ID NO: 19085 - DNA, 20 bp, Unknown
  RNA secondary structure sequence
caatcgattccagaactatt

SEQ ID NO: 19086 - DNA, 20 bp, Unknown
  RNA secondary structure sequence
gatacccctcgacgaggatg

SEQ ID NO: 19087 - DNA, 20 bp, Unknown
  RNA secondary structure sequence
gttcctcagcctccgctacc

SEQ ID NO: 19088 - DNA, 20 bp, Unknown
  RNA secondary structure sequence
cctcgcctggagccccgagg

SEQ ID NO: 19089 - DNA, 20 bp, Unknown
  RNA secondary structure sequence
tcagaaagcccggaggctgt

SEQ ID NO: 19090 - DNA, 20 bp, Unknown
  RNA secondary structure sequence
catccggctttcctgactct

SEQ ID NO: 19091 - DNA, 20 bp, Unknown
  RNA secondary structure sequence
aggcttcatctccggctcca

SEQ ID NO: 19092 - DNA, 20 bp, Unknown
  RNA secondary structure sequence
cccttccgtccccttttgcc

SEQ ID NO: 19093 - DNA, 20 bp, Unknown
  RNA secondary structure sequence
ctccagtgtctccactgtgg

SEQ ID NO: 19094 - DNA, 20 bp, Unknown
  RNA secondary structure sequence
tgtcacctgcatctcctttt

SEQ ID NO: 19095 - DNA, 20 bp, Unknown
  RNA secondary structure sequence
ggattgctggggaccctcaa

SEQ ID NO: 19096 - DNA, 20 bp, Unknown
  RNA secondary structure sequence
aatgtccacctcctgggttc

SEQ ID NO: 19097 - DNA, 20 bp, Unknown
  RNA secondary structure sequence
cctctagcgctgggtgttgg

SEQ ID NO: 19098 - DNA, 20 bp, Unknown
  RNA secondary structure sequence
gcctctggaaggggctgggg

SEQ ID NO: 19099 - DNA, 20 bp, Unknown
  RNA secondary structure sequence
cgtgaagtcagtcaacaaaa

SEQ ID NO: 19100 - DNA, 20 bp, Unknown
  RNA secondary structure sequence
aaggagcagggtcctggtcc

SEQ ID NO: 19101 - DNA, 20 bp, Unknown
  RNA secondary structure sequence
tctctaacatatgatactga

SEQ ID NO: 19102 - DNA, 20 bp, Unknown
  RNA secondary structure sequence
acatgctctagtttattaac

SEQ ID NO: 19103 - DNA, 20 bp, Unknown
  RNA secondary structure sequence
ggctaagtgggacattagta

SEQ ID NO: 19104 - DNA, 20 bp, Unknown
  RNA secondary structure sequence
acaaagaaatccccccttca

SEQ ID NO: 19105 - DNA, 20 bp, Unknown
  RNA secondary structure sequence
tctgcagttccatcaggtcc

SEQ ID NO: 19106 - DNA, 20 bp, Unknown
  RNA secondary structure sequence
ctacctgagcattcaggcag

SEQ ID NO: 19107 - DNA, 20 bp, Unknown
  RNA secondary structure sequence
gttaataatagtattttaga

SEQ ID NO: 19108 - DNA, 20 bp, Unknown
  RNA secondary structure sequence
taaacacagactttgtaggt

SEQ ID NO: 19109 - DNA, 20 bp, Unknown
  RNA secondary structure sequence
gcggagcaagtacaatgatg

SEQ ID NO: 19110 - DNA, 20 bp, Unknown
  RNA secondary structure sequence
acggagaacgctccaggagg

SEQ ID NO: 19111 - DNA, 20 bp, Unknown
  RNA secondary structure sequence
ggttataataaagatataaa

SEQ ID NO: 19112 - DNA, 20 bp, Unknown
  RNA secondary structure sequence
agggttggacctaatgcccc

SEQ ID NO: 19113 - DNA, 20 bp, Unknown
  RNA secondary structure sequence
actgcataattctgaagtta

SEQ ID NO: 19114 - DNA, 20 bp, Unknown
  RNA secondary structure sequence
cagatttgcacaaaaagata

SEQ ID NO: 19115 - DNA, 20 bp, Unknown
  RNA secondary structure sequence
taatatatagcatttatggt

SEQ ID NO: 19116 - DNA, 20 bp, Unknown
  RNA secondary structure sequence
ttggttttgttttttgagtc

SEQ ID NO: 19117 - DNA, 20 bp, Unknown
  RNA secondary structure sequence
aaacagaaattggtaccttg

SEQ ID NO: 19118 - DNA, 20 bp, Unknown
  RNA secondary structure sequence
cccggtggctgtcagtcaaa

SEQ ID NO: 19119 - DNA, 20 bp, Unknown
  RNA secondary structure sequence
caagtacactgggaacactt

SEQ ID NO: 19120 - DNA, 20 bp, Unknown
  RNA secondary structure sequence
gctttgcacgtgcctgggca

SEQ ID NO: 19121 - DNA, 20 bp, Unknown
  RNA secondary structure sequence
gaccacacagaactatgatg

SEQ ID NO: 19122 - DNA, 20 bp, Unknown
  RNA secondary structure sequence
atggacatgcattgcctact

SEQ ID NO: 19123 - DNA, 20 bp, Unknown
  RNA secondary structure sequence
ttcagagactgggacgtttt

SEQ ID NO: 19124 - DNA, 20 bp, Unknown
  RNA secondary structure sequence
tcagcccaactcccacccca

SEQ ID NO: 19125 - DNA, 20 bp, Unknown
  RNA secondary structure sequence
ccagctcatcagcatccagc

SEQ ID NO: 19126 - DNA, 20 bp, Unknown
  RNA secondary structure sequence
ggtctcctgggtctcagctt

SEQ ID NO: 19127 - DNA, 20 bp, Unknown
  RNA secondary structure sequence
ggatggggagcagagtttga

SEQ ID NO: 19128 - DNA, 20 bp, Unknown
  RNA secondary structure sequence
cacagaactcaaccttcctg

SEQ ID NO: 19129 - DNA, 20 bp, Unknown
  RNA secondary structure sequence
gcagcctgggagctctattc

SEQ ID NO: 19130 - DNA, 20 bp, Unknown
  RNA secondary structure sequence
ctctgataccatcatcccag

SEQ ID NO: 19131 - DNA, 20 bp, Unknown
  RNA secondary structure sequence
cgaacaacatgagagcacac

SEQ ID NO: 19132 - DNA, 20 bp, Unknown
  RNA secondary structure sequence
acctcgagaagatcgggtgc

SEQ ID NO: 19133 - DNA, 20 bp, Unknown
  RNA secondary structure sequence
cactgtgtatgctgtcactg

SEQ ID NO: 19134 - DNA, 20 bp, Unknown
  RNA secondary structure sequence
agttgtcaccactctggaga

SEQ ID NO: 19135 - DNA, 20 bp, Unknown
  RNA secondary structure sequence
tgtcagaagctacaccatca

SEQ ID NO: 19136 - DNA, 20 bp, Unknown
  RNA secondary structure sequence
atggcagccgccacgtgcca

SEQ ID NO: 19137 - DNA, 20 bp, Unknown
  RNA secondary structure sequence
cacttctggtcagcaaccca

SEQ ID NO: 19138 - DNA, 20 bp, Unknown
  RNA secondary structure sequence
tcacctgtacccacagggtc

SEQ ID NO: 19139 - DNA, 20 bp, Unknown
  RNA secondary structure sequence
taccagtgccactctgacag

SEQ ID NO: 19140 - DNA, 20 bp, Unknown
  RNA secondary structure sequence
ggagtttcctgagggttttc

SEQ ID NO: 19141 - DNA, 20 bp, Unknown
  RNA secondary structure sequence
atctcttcactaatggagat

SEQ ID NO: 19142 - DNA, 20 bp, Unknown
  RNA secondary structure sequence
gccgagagtcgtcggggttt

SEQ ID NO: 19143 - DNA, 20 bp, Unknown
  RNA secondary structure sequence
cgcctctccttagtcgccgc

SEQ ID NO: 19144 - DNA, 20 bp, Unknown
  RNA secondary structure sequence
aatgtgaatcagtcactact

SEQ ID NO: 19145 - DNA, 20 bp, Unknown
  RNA secondary structure sequence
gaatatctctttgacaagca

SEQ ID NO: 19146 - DNA, 20 bp, Unknown
  RNA secondary structure sequence
ttgggcagtatactaaggtg

SEQ ID NO: 19147 - DNA, 20 bp, Unknown
  RNA secondary structure sequence
gttacagtggttatagccag

SEQ ID NO: 19148 - DNA, 20 bp, Unknown
  RNA secondary structure sequence
gccgagggcgaggaggaccc

SEQ ID NO: 19149 - DNA, 20 bp, Unknown
  RNA secondary structure sequence
tgcatccttgaatcttgggt

SEQ ID NO: 19150 - DNA, 20 bp, Unknown
  RNA secondary structure sequence
ttcctgggtttcagtacttg

SEQ ID NO: 19151 - DNA, 20 bp, Unknown
  RNA secondary structure sequence
gtctcactctcacccaggct

SEQ ID NO: 19152 - DNA, 20 bp, Unknown
  RNA secondary structure sequence
gcggcgcctgtgagtgagtg

SEQ ID NO: 19153 - DNA, 20 bp, Unknown
  RNA secondary structure sequence
taagtcaacttatttgtttt

SEQ ID NO: 19154 - DNA, 20 bp, Unknown
  RNA secondary structure sequence
atcccatcaccatcttccag

SEQ ID NO: 19155 - DNA, 20 bp, Unknown
  RNA secondary structure sequence
tggatggcccctccgggaaa

SEQ ID NO: 19156 - DNA, 20 bp, Unknown
  RNA secondary structure sequence
acgaccactttgtcaagctc

SEQ ID NO: 19157 - DNA, 20 bp, Unknown
  RNA secondary structure sequence
ctcagtcccccaccacactg

SEQ ID NO: 19158 - DNA, 20 bp, Unknown
  RNA secondary structure sequence
ggtagagcggccgccatgtt

SEQ ID NO: 19159 - DNA, 20 bp, Unknown
  RNA secondary structure sequence
agattattctctgatttggt

SEQ ID NO: 19160 - DNA, 20 bp, Unknown
  RNA secondary structure sequence
acgggaagcttgtcatcaat

SEQ ID NO: 19161 - DNA, 20 bp, Unknown
  RNA secondary structure sequence
ccatcactgccacccagaag

SEQ ID NO: 19162 - DNA, 20 bp, Unknown
  RNA secondary structure sequence
cactgctggggagtccctgc

SEQ ID NO: 19163 - DNA, 20 bp, Unknown
  RNA secondary structure sequence
aaaggctaagctaaggtcaa

SEQ ID NO: 19164 - DNA, 20 bp, Unknown
  RNA secondary structure sequence
tttattttcataacagcatg

SEQ ID NO: 19165 - DNA, 20 bp, Unknown
  RNA secondary structure sequence
ggatgttatcgctattgaat

SEQ ID NO: 19166 - DNA, 20 bp, Unknown
  RNA secondary structure sequence
cacgggctggaagagacatg

SEQ ID NO: 19167 - DNA, 20 bp, Unknown
  RNA secondary structure sequence
ctattccacacattttcagc

SEQ ID NO: 19168 - DNA, 20 bp, Unknown
  RNA secondary structure sequence
cccaaagtgctgggatgaca

SEQ ID NO: 19169 - DNA, 20 bp, Unknown
  RNA secondary structure sequence
ctcagcagctccccagcacc

SEQ ID NO: 19170 - DNA, 20 bp, Unknown
  RNA secondary structure sequence
cttcaaattcctggggctga

SEQ ID NO: 19171 - DNA, 20 bp, Unknown
  RNA secondary structure sequence
tgaaagaatcttccaattct

SEQ ID NO: 19172 - DNA, 20 bp, Unknown
  RNA secondary structure sequence
ttctggaacaagatagagtg

SEQ ID NO: 19173 - DNA, 20 bp, Unknown
  RNA secondary structure sequence
aagtgcctggagtatcttct

SEQ ID NO: 19174 - DNA, 20 bp, Unknown
  RNA secondary structure sequence
tgaaaaagtctggcaagctg

SEQ ID NO: 19175 - DNA, 20 bp, Unknown
  RNA secondary structure sequence
ctaatgaaacttgtaccgtg

SEQ ID NO: 19176 - DNA, 20 bp, Unknown
  RNA secondary structure sequence
ggctgcagtgagccatgatc

SEQ ID NO: 19177 - DNA, 20 bp, Unknown
  RNA secondary structure sequence
gcatatcttctccagaagtc

SEQ ID NO: 19178 - DNA, 20 bp, Unknown
  RNA secondary structure sequence
ttttatttgcattttattga

SEQ ID NO: 19179 - DNA, 20 bp, Unknown
  RNA secondary structure sequence
gatggaaaggaaacaagaaa

SEQ ID NO: 19180 - DNA, 20 bp, Unknown
  RNA secondary structure sequence
tgtccagatgggagtcccat

SEQ ID NO: 19181 - DNA, 20 bp, Unknown
  RNA secondary structure sequence
gggtggatcacctgaggtca

SEQ ID NO: 19182 - DNA, 20 bp, Unknown
  RNA secondary structure sequence
agtatggctctgacatctct

SEQ ID NO: 19183 - DNA, 20 bp, Unknown
  RNA secondary structure sequence
agaagccaactagccaacac

SEQ ID NO: 19184 - DNA, 20 bp, Unknown
  RNA secondary structure sequence
ctcattttacattttaaagt

SEQ ID NO: 19185 - DNA, 20 bp, Unknown
  RNA secondary structure sequence
ctgcagtgcgaagaaactga

SEQ ID NO: 19186 - DNA, 20 bp, Unknown
  RNA secondary structure sequence
tcttggtctgatccacgctg

SEQ ID NO: 19187 - DNA, 20 bp, Unknown
  RNA secondary structure sequence
ctctgtccagcccacagcaa

SEQ ID NO: 19188 - DNA, 20 bp, Unknown
  RNA secondary structure sequence
tcagcatcagcccatcatca

SEQ ID NO: 19189 - DNA, 20 bp, Unknown
  RNA secondary structure sequence
ctcttctttgagcagccctt

SEQ ID NO: 19190 - DNA, 20 bp, Unknown
  RNA secondary structure sequence
aggtctcctgagcaataaga

SEQ ID NO: 19191 - DNA, 20 bp, Unknown
  RNA secondary structure sequence
catctgctgcaccagttcct

SEQ ID NO: 19192 - DNA, 20 bp, Unknown
  RNA secondary structure sequence
ataatgctgtaccgattgta

SEQ ID NO: 19193 - DNA, 20 bp, Unknown
  RNA secondary structure sequence
ggccggcgctggttgaacag

SEQ ID NO: 19194 - DNA, 20 bp, Unknown
  RNA secondary structure sequence
ccctaagttgttcaccggga

SEQ ID NO: 19195 - DNA, 20 bp, Unknown
  RNA secondary structure sequence
gtaagaaatgagatgcagga

SEQ ID NO: 19196 - DNA, 20 bp, Unknown
  RNA secondary structure sequence
gggtcacagtgacctgacct

SEQ ID NO: 19197 - DNA, 20 bp, Unknown
  RNA secondary structure sequence
ggtgatattattttcagtgc

SEQ ID NO: 19198 - DNA, 20 bp, Unknown
  RNA secondary structure sequence
acataatatggtaaaatgta

SEQ ID NO: 19199 - DNA, 20 bp, Unknown
  RNA secondary structure sequence
ggctcatcggggatgcggcc

SEQ ID NO: 19200 - DNA, 20 bp, Unknown
  RNA secondary structure sequence
acaagggggagaccaaggca

SEQ ID NO: 19201 - DNA, 20 bp, Unknown
  RNA secondary structure sequence
tgttggggcgcttcgagctg

SEQ ID NO: 19202 - DNA, 20 bp, Unknown
  RNA secondary structure sequence
gagggtctgggtcaggcccc

SEQ ID NO: 19203 - DNA, 20 bp, Unknown
  RNA secondary structure sequence
tttccggtttctacatgcag

SEQ ID NO: 19204 - DNA, 20 bp, Unknown
  RNA secondary structure sequence
tctacatgcagagatgaatt

SEQ ID NO: 19205 - DNA, 20 bp, Unknown
  RNA secondary structure sequence
tacggcctgtggctggactg

SEQ ID NO: 19206 - DNA, 20 bp, Unknown
  RNA secondary structure sequence
gtattcttcgagtgacagct

SEQ ID NO: 19207 - DNA, 20 bp, Unknown
  RNA secondary structure sequence
tggaaagctatgcctattct

SEQ ID NO: 19208 - DNA, 20 bp, Unknown
  RNA secondary structure sequence
taatctaagaaaaggggaga

SEQ ID NO: 19209 - DNA, 20 bp, Unknown
  RNA secondary structure sequence
agctgcttggattctctgag

SEQ ID NO: 19210 - DNA, 20 bp, Unknown
  RNA secondary structure sequence
ggtgacattgaaactacact

SEQ ID NO: 19211 - DNA, 20 bp, Unknown
  RNA secondary structure sequence
ggttaaatggtagttagcaa

SEQ ID NO: 19212 - DNA, 20 bp, Unknown
  RNA secondary structure sequence
ttagacgcaccccggtgagc

SEQ ID NO: 19213 - DNA, 20 bp, Unknown
  RNA secondary structure sequence
gggaccgcggcttctacttc

SEQ ID NO: 19214 - DNA, 20 bp, Unknown
  RNA secondary structure sequence
ccacccaagaccccgcccac

SEQ ID NO: 19215 - DNA, 20 bp, Unknown
  RNA secondary structure sequence
cttctcctgacccagtcccc

SEQ ID NO: 19216 - DNA, 20 bp, Unknown
  RNA secondary structure sequence
gaattttcagggtaaactgg

SEQ ID NO: 19217 - DNA, 20 bp, Unknown
  RNA secondary structure sequence
cacacaaacgcacagcacac

SEQ ID NO: 19218 - DNA, 20 bp, Unknown
  RNA secondary structure sequence
ggctggcctccttggcgcct

SEQ ID NO: 19219 - DNA, 20 bp, Unknown
  RNA secondary structure sequence
agcctgactccctggtgtgc

SEQ ID NO: 19220 - DNA, 20 bp, Unknown
  RNA secondary structure sequence
ccctcggtgacatcttgccc

SEQ ID NO: 19221 - DNA, 20 bp, Unknown
  RNA secondary structure sequence
cgtgcctagtcgtggctctc

SEQ ID NO: 19222 - DNA, 20 bp, Unknown
  RNA secondary structure sequence
ccagctgccccagcggcctc

SEQ ID NO: 19223 - DNA, 20 bp, Unknown
  RNA secondary structure sequence
gccccctgcccagcctgccc

SEQ ID NO: 19224 - DNA, 20 bp, Unknown
  RNA secondary structure sequence
caatggggaagtcgatgctg

SEQ ID NO: 19225 - DNA, 20 bp, Unknown
  RNA secondary structure sequence
gcagccgtggcatcgttgag

SEQ ID NO: 19226 - DNA, 20 bp, Unknown
  RNA secondary structure sequence
agcagtccacccagcgcctg

SEQ ID NO: 19227 - DNA, 20 bp, Unknown
  RNA secondary structure sequence
atcggaagtgagcaaaactg

SEQ ID NO: 19228 - DNA, 20 bp, Unknown
  RNA secondary structure sequence
ctcctcggccccctccatcg

SEQ ID NO: 19229 - DNA, 20 bp, Unknown
  RNA secondary structure sequence
ggctcctcactcccttttcc

SEQ ID NO: 19230 - DNA, 20 bp, Unknown
  RNA secondary structure sequence
acacacaaagacacagcaca

SEQ ID NO: 19231 - DNA, 20 bp, Unknown
  RNA secondary structure sequence
cgatgctccccataccccac

SEQ ID NO: 19232 - DNA, 20 bp, Unknown
  RNA secondary structure sequence
ggagggggctcctggctggc

SEQ ID NO: 19233 - DNA, 20 bp, Unknown
  RNA secondary structure sequence
ggcgcctagggctgcggcag

SEQ ID NO: 19234 - DNA, 20 bp, Unknown
  RNA secondary structure sequence
cagtcgcagagggtccctcg

SEQ ID NO: 19235 - DNA, 20 bp, Unknown
  RNA secondary structure sequence
gttatattctgcctcgccgg

SEQ ID NO: 19236 - DNA, 20 bp, Unknown
  RNA secondary structure sequence
gtcttcagtggggggccccc

SEQ ID NO: 19237 - DNA, 20 bp, Unknown
  RNA secondary structure sequence
ctgctcctgctgcagctgct

SEQ ID NO: 19238 - DNA, 20 bp, Unknown
  RNA secondary structure sequence
ggaactcctgaatttgtaac

SEQ ID NO: 19239 - DNA, 20 bp, Unknown
  RNA secondary structure sequence
ttggtggatgactccgatcc

SEQ ID NO: 19240 - DNA, 20 bp, Unknown
  RNA secondary structure sequence
tccgcgctggtccgccatgc

SEQ ID NO: 19241 - DNA, 20 bp, Unknown
  RNA secondary structure sequence
agacacacaccgagagctac

SEQ ID NO: 19242 - DNA, 20 bp, Unknown
  RNA secondary structure sequence
aaaagcctccagctgtccac

SEQ ID NO: 19243 - DNA, 20 bp, Unknown
  RNA secondary structure sequence
acttactttgagtttgaaac

SEQ ID NO: 19244 - DNA, 20 bp, Unknown
  RNA secondary structure sequence
tgcaatcctctcccttacat

SEQ ID NO: 19245 - DNA, 20 bp, Unknown
  RNA secondary structure sequence
tccaccaggatcacgtttga

SEQ ID NO: 19246 - DNA, 20 bp, Unknown
  RNA secondary structure sequence
acgcagtatgcctgcccacc

SEQ ID NO: 19247 - DNA, 20 bp, Unknown
  RNA secondary structure sequence
gctggcactgagccgtgccc

SEQ ID NO: 19248 - DNA, 20 bp, Unknown
  RNA secondary structure sequence
cgattcacctgcagcgagag

SEQ ID NO: 19249 - DNA, 20 bp, Unknown
  RNA secondary structure sequence
tccttaagtggcagggcggg

SEQ ID NO: 19250 - DNA, 20 bp, Unknown
  RNA secondary structure sequence
cagctggtgtacaaggatgg

SEQ ID NO: 19251 - DNA, 20 bp, Unknown
  RNA secondary structure sequence
tccacgagcacctttaaggt

SEQ ID NO: 19252 - DNA, 20 bp, Unknown
  RNA secondary structure sequence
caggatgaagcggtcgtttt

SEQ ID NO: 19253 - DNA, 20 bp, Unknown
  RNA secondary structure sequence
gacagctgcacttactactt

SEQ ID NO: 19254 - DNA, 20 bp, Unknown
  RNA secondary structure sequence
gacaactacctgtatgagat

SEQ ID NO: 19255 - DNA, 20 bp, Unknown
  RNA secondary structure sequence
gcctcttcctctaagtgcgg

SEQ ID NO: 19256 - DNA, 20 bp, Unknown
  RNA secondary structure sequence
gacagcgagaatcccgggga

SEQ ID NO: 19257 - DNA, 20 bp, Unknown
  RNA secondary structure sequence
tccctgcatggggatgacca

SEQ ID NO: 19258 - DNA, 20 bp, Unknown
  RNA secondary structure sequence
gcgaggaaagggaagtccag

SEQ ID NO: 19259 - DNA, 20 bp, Unknown
  RNA secondary structure sequence
actgtgcttatttttttaag

SEQ ID NO: 19260 - DNA, 20 bp, Unknown
  RNA secondary structure sequence
aggaggagggaggccaggcg

SEQ ID NO: 19261 - DNA, 20 bp, Unknown
  RNA secondary structure sequence
ccggtttggctggcttgttt

SEQ ID NO: 19262 - DNA, 20 bp, Unknown
  RNA secondary structure sequence
gcagtgtaactgcatagttt

SEQ ID NO: 19263 - DNA, 20 bp, Unknown
  RNA secondary structure sequence
gctaggaagtctggtgcagt

SEQ ID NO: 19264 - DNA, 20 bp, Unknown
  RNA secondary structure sequence
tacccaagtaaaagtaacct

SEQ ID NO: 19265 - DNA, 20 bp, Unknown
  RNA secondary structure sequence
cggctttcaaacaaaagagg

SEQ ID NO: 19266 - DNA, 20 bp, Unknown
  RNA secondary structure sequence
ggctcccggagcagggcgag

SEQ ID NO: 19267 - DNA, 20 bp, Unknown
  RNA secondary structure sequence
cttcatatgcaattcccaag

SEQ ID NO: 19268 - DNA, 20 bp, Unknown
  RNA secondary structure sequence
caacgaagtggaacctggtt

SEQ ID NO: 19269 - DNA, 20 bp, Unknown
  RNA secondary structure sequence
gtttttcattgacaacatac

SEQ ID NO: 19270 - DNA, 20 bp, Unknown
  RNA secondary structure sequence
tgccttctgcaatcccgtca

SEQ ID NO: 19271 - DNA, 20 bp, Unknown
  RNA secondary structure sequence
ctacaccatgggtcataact

SEQ ID NO: 19272 - DNA, 20 bp, Unknown
  RNA secondary structure sequence
ggaaggggaacactgtcagt

SEQ ID NO: 19273 - DNA, 20 bp, Unknown
  RNA secondary structure sequence
cttctggggagaccccgacg

SEQ ID NO: 19274 - DNA, 20 bp, Unknown
  RNA secondary structure sequence
ctgccaccagtgctttgctc

SEQ ID NO: 19275 - DNA, 20 bp, Unknown
  RNA secondary structure sequence
gagccccgcagcagagccac

SEQ ID NO: 19276 - DNA, 20 bp, Unknown
  RNA secondary structure sequence
cctagacaacactgtgaaag

SEQ ID NO: 19277 - DNA, 20 bp, Unknown
  RNA secondary structure sequence
atgtggcgggccaaactgca

SEQ ID NO: 19278 - DNA, 20 bp, Unknown
  RNA secondary structure sequence
tgaagtattgaaaatggaga

SEQ ID NO: 19279 - DNA, 20 bp, Unknown
  RNA secondary structure sequence
tgcaacagatgttaaagtca

SEQ ID NO: 19280 - DNA, 20 bp, Unknown
  RNA secondary structure sequence
caacgcgtcccagcgcatca

SEQ ID NO: 19281 - DNA, 20 bp, Unknown
  RNA secondary structure sequence
cccttccaactctcctttcc

SEQ ID NO: 19282 - DNA, 20 bp, Unknown
  RNA secondary structure sequence
cccttgtctccgggtggtgt

SEQ ID NO: 19283 - DNA, 20 bp, Unknown
  RNA secondary structure sequence
cctcagcatgaacagagaaa

SEQ ID NO: 19284 - DNA, 20 bp, Unknown
  RNA secondary structure sequence
gagcatcttgcatccaaacc

SEQ ID NO: 19285 - DNA, 20 bp, Unknown
  RNA secondary structure sequence
ctaaagcttttatttaacag

SEQ ID NO: 19286 - DNA, 20 bp, Unknown
  RNA secondary structure sequence
tcttcttttctttttttaaa

SEQ ID NO: 19287 - DNA, 20 bp, Unknown
  RNA secondary structure sequence
cgcagaagaaaggcggagaa

SEQ ID NO: 19288 - DNA, 20 bp, Unknown
  RNA secondary structure sequence
gtgcccgtggtgcagccatc

SEQ ID NO: 19289 - DNA, 20 bp, Unknown
  RNA secondary structure sequence
tctccgggtggtgttggaca

SEQ ID NO: 19290 - DNA, 20 bp, Unknown
  RNA secondary structure sequence
atggtggaaaacgaagctca

SEQ ID NO: 19291 - DNA, 20 bp, Unknown
  RNA secondary structure sequence
tatgggggttctggagagcg

SEQ ID NO: 19292 - DNA, 20 bp, Unknown
  RNA secondary structure sequence
gcagggtgcaaccgagctgg

SEQ ID NO: 19293 - DNA, 20 bp, Unknown
  RNA secondary structure sequence
gctatactcctggcctgtgc

SEQ ID NO: 19294 - DNA, 20 bp, Unknown
  RNA secondary structure sequence
ccgccgggatgctgctgagc

SEQ ID NO: 19295 - DNA, 20 bp, Unknown
  RNA secondary structure sequence
ctcccatgaggctcctggca

SEQ ID NO: 19296 - DNA, 20 bp, Unknown
  RNA secondary structure sequence
caccttggagctattcacag

SEQ ID NO: 19297 - DNA, 20 bp, Unknown
  RNA secondary structure sequence
cctccgtgccctgcatctca

SEQ ID NO: 19298 - DNA, 20 bp, Unknown
  RNA secondary structure sequence
tgctgctatgaagggcaact

SEQ ID NO: 19299 - DNA, 20 bp, Unknown
  RNA secondary structure sequence
cagcaaacaggcattctcac

SEQ ID NO: 19300 - DNA, 20 bp, Unknown
  RNA secondary structure sequence
cccatccctcctccagatgc

SEQ ID NO: 19301 - DNA, 20 bp, Unknown
  RNA secondary structure sequence
gagcctcctccaaaactgcc

SEQ ID NO: 19302 - DNA, 20 bp, Unknown
  RNA secondary structure sequence
acagcatgtgccaagattct

SEQ ID NO: 19303 - DNA, 20 bp, Unknown
  RNA secondary structure sequence
ggctgctcccacctggctct

SEQ ID NO: 19304 - DNA, 20 bp, Unknown
  RNA secondary structure sequence
aagaggggatgagttgtgtg

SEQ ID NO: 19305 - DNA, 20 bp, Unknown
  RNA secondary structure sequence
ctgggccgtggagcctatgg

SEQ ID NO: 19306 - DNA, 20 bp, Unknown
  RNA secondary structure sequence
gtgatccacagagatgtgaa

SEQ ID NO: 19307 - DNA, 20 bp, Unknown
  RNA secondary structure sequence
ggctacaatgtcaagtccga

SEQ ID NO: 19308 - DNA, 20 bp, Unknown
  RNA secondary structure sequence
actgctcagtgcctgaggaa

SEQ ID NO: 19309 - DNA, 20 bp, Unknown
  RNA secondary structure sequence
gagccccacagccccatctg

SEQ ID NO: 19310 - DNA, 20 bp, Unknown
  RNA secondary structure sequence
tcggccccaccagtgcctct

SEQ ID NO: 19311 - DNA, 20 bp, Unknown
  RNA secondary structure sequence
aaacagggcctctgcggagc

SEQ ID NO: 19312 - DNA, 20 bp, Unknown
  RNA secondary structure sequence
ctagggtaccagcaggcaga

SEQ ID NO: 19313 - DNA, 20 bp, Unknown
  RNA secondary structure sequence
cagaggtgctcatcagcact

SEQ ID NO: 19314 - DNA, 20 bp, Unknown
  RNA secondary structure sequence
ctctagccgacattgttttg

SEQ ID NO: 19315 - DNA, 20 bp, Unknown
  RNA secondary structure sequence
tgcctgtggctggagaaagg

SEQ ID NO: 19316 - DNA, 20 bp, Unknown
  RNA secondary structure sequence
cagcaacagagaccaaggct

SEQ ID NO: 19317 - DNA, 20 bp, Unknown
  RNA secondary structure sequence
tgaaacgaggttttgtgctg

SEQ ID NO: 19318 - DNA, 20 bp, Unknown
  RNA secondary structure sequence
agcctcagtgtaaagtctgc

SEQ ID NO: 19319 - DNA, 20 bp, Unknown
  RNA secondary structure sequence
tctttgggggctatgtgcct

SEQ ID NO: 19320 - DNA, 20 bp, Unknown
  RNA secondary structure sequence
agccacagcagatacaagcg

SEQ ID NO: 19321 - DNA, 20 bp, Unknown
  RNA secondary structure sequence
ctccgcccacactggcctca

SEQ ID NO: 19322 - DNA, 20 bp, Unknown
  RNA secondary structure sequence
tctgttccccttcgggtcca

SEQ ID NO: 19323 - DNA, 20 bp, Unknown
  RNA secondary structure sequence
tggggagcagccgctgtggg

SEQ ID NO: 19324 - DNA, 20 bp, Unknown
  RNA secondary structure sequence
ccctgctgcgccgcgcctgg

SEQ ID NO: 19325 - DNA, 20 bp, Unknown
  RNA secondary structure sequence
tgagcttcctgaccatcccg

SEQ ID NO: 19326 - DNA, 20 bp, Unknown
  RNA secondary structure sequence
cccttcggtactgggcctcc

SEQ ID NO: 19327 - DNA, 20 bp, Unknown
  RNA secondary structure sequence
tgccagctggtcccgggaat

SEQ ID NO: 19328 - DNA, 20 bp, Unknown
  RNA secondary structure sequence
ctgggagtgggaagcctctt

SEQ ID NO: 19329 - DNA, 20 bp, Unknown
  RNA secondary structure sequence
acaggcccgttcttccgcta

SEQ ID NO: 19330 - DNA, 20 bp, Unknown
  RNA secondary structure sequence
ttctacgcccgcccgctgcc

SEQ ID NO: 19331 - DNA, 20 bp, Unknown
  RNA secondary structure sequence
gactgggtgcactggttcct

SEQ ID NO: 19332 - DNA, 20 bp, Unknown
  RNA secondary structure sequence
tccccagctaaataccctgc

SEQ ID NO: 19333 - DNA, 20 bp, Unknown
  RNA secondary structure sequence
ggggcccctgggcagtgggt

SEQ ID NO: 19334 - DNA, 20 bp, Unknown
  RNA secondary structure sequence
ctggaggaagctgccaagga

SEQ ID NO: 19335 - DNA, 20 bp, Unknown
  RNA secondary structure sequence
gcggcctctggggtccgtgc

SEQ ID NO: 19336 - DNA, 20 bp, Unknown
  RNA secondary structure sequence
atgcccgacaaatgcaaatg

SEQ ID NO: 19337 - DNA, 20 bp, Unknown
  RNA secondary structure sequence
gtctatgaggtcatctccaa

SEQ ID NO: 19338 - DNA, 20 bp, Unknown
  RNA secondary structure sequence
cagcttctgaagtttgtgga

SEQ ID NO: 19339 - DNA, 20 bp, Unknown
  RNA secondary structure sequence
gacttcatgcccaccatctt

SEQ ID NO: 19340 - DNA, 20 bp, Unknown
  RNA secondary structure sequence
gaagccctcagcaagatgaa

SEQ ID NO: 19341 - DNA, 20 bp, Unknown
  RNA secondary structure sequence
ctcaagcgccgctttgccat

SEQ ID NO: 19342 - DNA, 20 bp, Unknown
  RNA secondary structure sequence
tggccaggctggcacatacc

SEQ ID NO: 19343 - DNA, 20 bp, Unknown
  RNA secondary structure sequence
ccccacccttgcccgcggca

SEQ ID NO: 19344 - DNA, 20 bp, Unknown
  RNA secondary structure sequence
gccccaagcctttgcagccc

SEQ ID NO: 19345 - DNA, 20 bp, Unknown
  RNA secondary structure sequence
aggacaacatagacgaggat

SEQ ID NO: 19346 - DNA, 20 bp, Unknown
  RNA secondary structure sequence
cccacctccccgtgcagcag

SEQ ID NO: 19347 - DNA, 20 bp, Unknown
  RNA secondary structure sequence
tccagactgtgaaccacgtt

SEQ ID NO: 19348 - DNA, 20 bp, Unknown
  RNA secondary structure sequence
tggtcaccatgccctccttc

SEQ ID NO: 19349 - DNA, 20 bp, Unknown
  RNA secondary structure sequence
gtgcgatgtggacgtcacgc

SEQ ID NO: 19350 - DNA, 20 bp, Unknown
  RNA secondary structure sequence
ccactgggcccctgtcccca

SEQ ID NO: 19351 - DNA, 20 bp, Unknown
  RNA secondary structure sequence
cctcctgcagtttgggagac

SEQ ID NO: 19352 - DNA, 20 bp, Unknown
  RNA secondary structure sequence
gcttctgctccagccccttt

SEQ ID NO: 19353 - DNA, 20 bp, Unknown
  RNA secondary structure sequence
ttcctgttccctcctggtcc

SEQ ID NO: 19354 - DNA, 20 bp, Unknown
  RNA secondary structure sequence
tgctattcccattgtgacag

SEQ ID NO: 19355 - DNA, 20 bp, Unknown
  RNA secondary structure sequence
cccccagcatcgggggcctg

SEQ ID NO: 19356 - DNA, 20 bp, Unknown
  RNA secondary structure sequence
cccactgttaacaacgacta

SEQ ID NO: 19357 - DNA, 20 bp, Unknown
  RNA secondary structure sequence
ttcaaacatgcacttgcagc

SEQ ID NO: 19358 - DNA, 20 bp, Unknown
  RNA secondary structure sequence
caagaggtggaatctccaac

SEQ ID NO: 19359 - DNA, 20 bp, Unknown
  RNA secondary structure sequence
ctcaaagcatttacagtacc

SEQ ID NO: 19360 - DNA, 20 bp, Unknown
  RNA secondary structure sequence
tccagaaaagcattatggtt

SEQ ID NO: 19361 - DNA, 20 bp, Unknown
  RNA secondary structure sequence
tatacaagcatgcgttgcac

SEQ ID NO: 19362 - DNA, 20 bp, Unknown
  RNA secondary structure sequence
actggggagacagaaactgt

SEQ ID NO: 19363 - DNA, 20 bp, Unknown
  RNA secondary structure sequence
ctagggtggaagagccgggc

SEQ ID NO: 19364 - DNA, 20 bp, Unknown
  RNA secondary structure sequence
tgcactggaacttacaacac

SEQ ID NO: 19365 - DNA, 20 bp, Unknown
  RNA secondary structure sequence
gtttcatctgcgacccggac

SEQ ID NO: 19366 - DNA, 20 bp, Unknown
  RNA secondary structure sequence
ccacctccagcttgtacctg

SEQ ID NO: 19367 - DNA, 20 bp, Unknown
  RNA secondary structure sequence
ccccgcagggcagccccgag

SEQ ID NO: 19368 - DNA, 20 bp, Unknown
  RNA secondary structure sequence
gcaaacctcctcacagccca

SEQ ID NO: 19369 - DNA, 20 bp, Unknown
  RNA secondary structure sequence
ggtcctcggacaccgaggag

SEQ ID NO: 19370 - DNA, 20 bp, Unknown
  RNA secondary structure sequence
aggtactataaaccctaatt

SEQ ID NO: 19371 - DNA, 20 bp, Unknown
  RNA secondary structure sequence
gccgatatttggagttctta

SEQ ID NO: 19372 - DNA, 20 bp, Unknown
  RNA secondary structure sequence
attcctgaattttggttaac

SEQ ID NO: 19373 - DNA, 20 bp, Unknown
  RNA secondary structure sequence
acaaatgaagtgctgacaaa

SEQ ID NO: 19374 - DNA, 20 bp, Unknown
  RNA secondary structure sequence
gggacagttcgtactgtgac

SEQ ID NO: 19375 - DNA, 20 bp, Unknown
  RNA secondary structure sequence
ttacataaaggggatgtggt

SEQ ID NO: 19376 - DNA, 20 bp, Unknown
  RNA secondary structure sequence
atcacttataaagaaaactg

SEQ ID NO: 19377 - DNA, 20 bp, Unknown
  RNA secondary structure sequence
atatggtaaggcccctaaaa

SEQ ID NO: 19378 - DNA, 20 bp, Unknown
  RNA secondary structure sequence
agcctccccaaaggcagctc

SEQ ID NO: 19379 - DNA, 20 bp, Unknown
  RNA secondary structure sequence
agtgactttgaacagcttcc

SEQ ID NO: 19380 - DNA, 20 bp, Unknown
  RNA secondary structure sequence
acaacacgatgccatgagct

SEQ ID NO: 19381 - DNA, 20 bp, Unknown
  RNA secondary structure sequence
aggccattcagaaaaagctt

SEQ ID NO: 19382 - DNA, 20 bp, Unknown
  RNA secondary structure sequence
tcttacctctttgactgaac

SEQ ID NO: 19383 - DNA, 20 bp, Unknown
  RNA secondary structure sequence
gaggccgcagtggcagcttc

SEQ ID NO: 19384 - DNA, 20 bp, Unknown
  RNA secondary structure sequence
gtccaagatgctaatggcct

SEQ ID NO: 19385 - DNA, 20 bp, Unknown
  RNA secondary structure sequence
gtagctgaattcacctgact

SEQ ID NO: 19386 - DNA, 20 bp, Unknown
  RNA secondary structure sequence
ccgagcatagtatgctgagt

SEQ ID NO: 19387 - DNA, 20 bp, Unknown
  RNA secondary structure sequence
tcataccagggtcatgcgtt

SEQ ID NO: 19388 - DNA, 20 bp, Unknown
  RNA secondary structure sequence
ggtctgccagctgagatgct

SEQ ID NO: 19389 - DNA, 20 bp, Unknown
  RNA secondary structure sequence
aattttctctactgtctgta

SEQ ID NO: 19390 - DNA, 20 bp, Unknown
  RNA secondary structure sequence
aacagctgagggtgtttgct

SEQ ID NO: 19391 - DNA, 20 bp, Unknown
  RNA secondary structure sequence
taggcctcagcccaggtcct

SEQ ID NO: 19392 - DNA, 20 bp, Unknown
  RNA secondary structure sequence
cggccacctacatgttccac

SEQ ID NO: 19393 - DNA, 20 bp, Unknown
  RNA secondary structure sequence
gcatcagcgtgcaccgctac

SEQ ID NO: 19394 - DNA, 20 bp, Unknown
  RNA secondary structure sequence
atgacaccactcggcctgaa

SEQ ID NO: 19395 - DNA, 20 bp, Unknown
  RNA secondary structure sequence
tccgcaccatagctgtggtg

SEQ ID NO: 19396 - DNA, 20 bp, Unknown
  RNA secondary structure sequence
atcctgtgctctacttgctc

SEQ ID NO: 19397 - DNA, 20 bp, Unknown
  RNA secondary structure sequence
gtgacctcatctctcataac

SEQ ID NO: 19398 - DNA, 20 bp, Unknown
  RNA secondary structure sequence
ttgtttctgttccttcctgg

SEQ ID NO: 19399 - DNA, 20 bp, Unknown
  RNA secondary structure sequence
agcttggctcgtggaagaag

SEQ ID NO: 19400 - DNA, 20 bp, Unknown
  RNA secondary structure sequence
tgctgcaacaaccgcaacgt

SEQ ID NO: 19401 - DNA, 20 bp, Unknown
  RNA secondary structure sequence
cgctgtggactgtcctgagg

SEQ ID NO: 19402 - DNA, 20 bp, Unknown
  RNA secondary structure sequence
aaacaccagtcacctcgtct

SEQ ID NO: 19403 - DNA, 20 bp, Unknown
  RNA secondary structure sequence
tatgacaatttctggcagat

SEQ ID NO: 19404 - DNA, 20 bp, Unknown
  RNA secondary structure sequence
ctcgtgggctgggaatgggg

SEQ ID NO: 19405 - DNA, 20 bp, Unknown
  RNA secondary structure sequence
cccgcccccctacccggccc

SEQ ID NO: 19406 - DNA, 20 bp, Unknown
  RNA secondary structure sequence
gccggccatgatcgccgagt

SEQ ID NO: 19407 - DNA, 20 bp, Unknown
  RNA secondary structure sequence
gcgacctgtccaggtgagaa

SEQ ID NO: 19408 - DNA, 20 bp, Unknown
  RNA secondary structure sequence
tcgggtgaccattcggacgg

SEQ ID NO: 19409 - DNA, 20 bp, Unknown
  RNA secondary structure sequence
gggtccttggagtgataata

SEQ ID NO: 19410 - DNA, 20 bp, Unknown
  RNA secondary structure sequence
gaactccatcgccatcttct

SEQ ID NO: 19411 - DNA, 20 bp, Unknown
  RNA secondary structure sequence
gcctgatccctgaacccctg

SEQ ID NO: 19412 - DNA, 20 bp, Unknown
  RNA secondary structure sequence
tgattcacctcttcctctgg

SEQ ID NO: 19413 - DNA, 20 bp, Unknown
  RNA secondary structure sequence
gggacacctgggagaaggtc

SEQ ID NO: 19414 - DNA, 20 bp, Unknown
  RNA secondary structure sequence
ccctggggtgggatctgagc

SEQ ID NO: 19415 - DNA, 20 bp, Unknown
  RNA secondary structure sequence
tggaatcctgaagtgcctgc

SEQ ID NO: 19416 - DNA, 20 bp, Unknown
  RNA secondary structure sequence
tggcatggttttgctgaatt

SEQ ID NO: 19417 - DNA, 20 bp, Unknown
  RNA secondary structure sequence
cacaccataggatgtgagca

SEQ ID NO: 19418 - DNA, 20 bp, Unknown
  RNA secondary structure sequence
tgacataatatgataatgtg

SEQ ID NO: 19419 - DNA, 20 bp, Unknown
  RNA secondary structure sequence
cttaaaagtaaattcagact

SEQ ID NO: 19420 - DNA, 20 bp, Unknown
  RNA secondary structure sequence
caccatgcctggctaatttt

SEQ ID NO: 19421 - DNA, 20 bp, Unknown
  RNA secondary structure sequence
tgaggtgttcttagaagggt

SEQ ID NO: 19422 - DNA, 20 bp, Unknown
  RNA secondary structure sequence
cagattcggctaggaaaaga

SEQ ID NO: 19423 - DNA, 20 bp, Unknown
  RNA secondary structure sequence
gattaattttttgattttcc

SEQ ID NO: 19424 - DNA, 20 bp, Unknown
  RNA secondary structure sequence
tagtcatcctaagtatacca

SEQ ID NO: 19425 - DNA, 20 bp, Unknown
  RNA secondary structure sequence
tgattcagagctgtcattct

SEQ ID NO: 19426 - DNA, 20 bp, Unknown
  RNA secondary structure sequence
ttctgtaattttaaaacatt

SEQ ID NO: 19427 - DNA, 20 bp, Unknown
  RNA secondary structure sequence
gtgagaaagggcctcaccca

SEQ ID NO: 19428 - DNA, 20 bp, Unknown
  RNA secondary structure sequence
tgctgttgtcagtattactc

SEQ ID NO: 19429 - DNA, 20 bp, Unknown
  RNA secondary structure sequence
tgcacattcctgaaccagcc

SEQ ID NO: 19430 - DNA, 20 bp, Unknown
  RNA secondary structure sequence
actagttagagtctacattt

SEQ ID NO: 19431 - DNA, 20 bp, Unknown
  RNA secondary structure sequence
gctcgcgcgccctcccgccg

SEQ ID NO: 19432 - DNA, 20 bp, Unknown
  RNA secondary structure sequence
tcctctgggcaccgtccctg

SEQ ID NO: 19433 - DNA, 20 bp, Unknown
  RNA secondary structure sequence
ggcagcggcggcttcggctc

SEQ ID NO: 19434 - DNA, 20 bp, Unknown
  RNA secondary structure sequence
gtcattaggctcctggactg

SEQ ID NO: 19435 - DNA, 20 bp, Unknown
  RNA secondary structure sequence
gataggccaaccttcgaaga

SEQ ID NO: 19436 - DNA, 20 bp, Unknown
  RNA secondary structure sequence
tctccagcttcccgagtacc

SEQ ID NO: 19437 - DNA, 20 bp, Unknown
  RNA secondary structure sequence
tcttctcataggtgtccagc

SEQ ID NO: 19438 - DNA, 20 bp, Unknown
  RNA secondary structure sequence
ccaccacatctacggactgc

SEQ ID NO: 19439 - DNA, 20 bp, Unknown
  RNA secondary structure sequence
cgagcctgctgtcattgaga

SEQ ID NO: 19440 - DNA, 20 bp, Unknown
  RNA secondary structure sequence
atcacctgaggccaggaatt

SEQ ID NO: 19441 - DNA, 20 bp, Unknown
  RNA secondary structure sequence
ccgtggctccggatctcttc

SEQ ID NO: 19442 - DNA, 20 bp, Unknown
  RNA secondary structure sequence
tcgggctgaaggcagtgatg

SEQ ID NO: 19443 - DNA, 20 bp, Unknown
  RNA secondary structure sequence
ccagacagctcgtcaggccc

SEQ ID NO: 19444 - DNA, 20 bp, Unknown
  RNA secondary structure sequence
agggaagaagatcaacgcct

SEQ ID NO: 19445 - DNA, 20 bp, Unknown
  RNA secondary structure sequence
tgtgtgtactctgtccagtt

SEQ ID NO: 19446 - DNA, 20 bp, Unknown
  RNA secondary structure sequence
cagctgtcctgcagcaaaca

SEQ ID NO: 19447 - DNA, 20 bp, Unknown
  RNA secondary structure sequence
gggcgtctgggatgcagtgg

SEQ ID NO: 19448 - DNA, 20 bp, Unknown
  RNA secondary structure sequence
catggctgacacattcctgg

SEQ ID NO: 19449 - DNA, 20 bp, Unknown
  RNA secondary structure sequence
aactcatgagtaccatgcgg

SEQ ID NO: 19450 - DNA, 20 bp, Unknown
  RNA secondary structure sequence
cgtggacctccgggtgaact

SEQ ID NO: 19451 - DNA, 20 bp, Unknown
  RNA secondary structure sequence
aagagttaggggccttaggg

SEQ ID NO: 19452 - DNA, 20 bp, Unknown
  RNA secondary structure sequence
agcgctctcactcgcacaag

SEQ ID NO: 19453 - DNA, 20 bp, Unknown
  RNA secondary structure sequence
tcaggcagattgtgtctgga

SEQ ID NO: 19454 - DNA, 20 bp, Unknown
  RNA secondary structure sequence
caagggttcttcggggatgt

SEQ ID NO: 19455 - DNA, 20 bp, Unknown
  RNA secondary structure sequence
acatgagcctccttccagac

SEQ ID NO: 19456 - DNA, 20 bp, Unknown
  RNA secondary structure sequence
ggatatctacaactttcagg

SEQ ID NO: 19457 - DNA, 20 bp, Unknown
  RNA secondary structure sequence
aagaatgatctagagtatgt

SEQ ID NO: 19458 - DNA, 20 bp, Unknown
  RNA secondary structure sequence
gggggaccgcggcccaggct

SEQ ID NO: 19459 - DNA, 20 bp, Unknown
  RNA secondary structure sequence
ctccccactcgaggccggcg

SEQ ID NO: 19460 - DNA, 20 bp, Unknown
  RNA secondary structure sequence
ggacacgctttcaccagctt

SEQ ID NO: 19461 - DNA, 20 bp, Unknown
  RNA secondary structure sequence
tatggagacactgtgtatgg

SEQ ID NO: 19462 - DNA, 20 bp, Unknown
  RNA secondary structure sequence
tgattttgccatgaagttca

SEQ ID NO: 19463 - DNA, 20 bp, Unknown
  RNA secondary structure sequence
catgctgctttttaatcata

SEQ ID NO: 19464 - DNA, 20 bp, Unknown
  RNA secondary structure sequence
aaaattagccgggtgtggtg

SEQ ID NO: 19465 - DNA, 20 bp, Unknown
  RNA secondary structure sequence
gttatgttgcttttaaagat

SEQ ID NO: 19466 - DNA, 20 bp, Unknown
  RNA secondary structure sequence
tactctgcaggctgaggtgg

SEQ ID NO: 19467 - DNA, 20 bp, Unknown
  RNA secondary structure sequence
gtcaacaagatccaggggct

SEQ ID NO: 19468 - DNA, 20 bp, Unknown
  RNA secondary structure sequence
ctgaaagtcactcgacattg

SEQ ID NO: 19469 - DNA, 20 bp, Unknown
  RNA secondary structure sequence
cagttacagcggcaggagcg

SEQ ID NO: 19470 - DNA, 20 bp, Unknown
  RNA secondary structure sequence
gttgtctggaggttccaggg

SEQ ID NO: 19471 - DNA, 20 bp, Unknown
  RNA secondary structure sequence
ggccaccttcaacagctggt

SEQ ID NO: 19472 - DNA, 20 bp, Unknown
  RNA secondary structure sequence
ccaccacctgaaggctcatg

SEQ ID NO: 19473 - DNA, 20 bp, Unknown
  RNA secondary structure sequence
aaatacactgcgtacacgtg

SEQ ID NO: 19474 - DNA, 20 bp, Unknown
  RNA secondary structure sequence
tagataagagtagcttggag

SEQ ID NO: 19475 - DNA, 20 bp, Unknown
  RNA secondary structure sequence
atttcacaagtgcctttctg

SEQ ID NO: 19476 - DNA, 20 bp, Unknown
  RNA secondary structure sequence
tcactgctgccagtgcacgt

SEQ ID NO: 19477 - DNA, 20 bp, Unknown
  RNA secondary structure sequence
caagaagacggagtcggatg

SEQ ID NO: 19478 - DNA, 20 bp, Unknown
  RNA secondary structure sequence
tagagcttggacagtctgag

SEQ ID NO: 19479 - DNA, 20 bp, Unknown
  RNA secondary structure sequence
ggaatggtggtgttcttagg

SEQ ID NO: 19480 - DNA, 20 bp, Unknown
  RNA secondary structure sequence
ttcatagcctgggctgggtg

SEQ ID NO: 19481 - DNA, 20 bp, Unknown
  RNA secondary structure sequence
aggaccaccgcctccaggga

SEQ ID NO: 19482 - DNA, 20 bp, Unknown
  RNA secondary structure sequence
tgacagagttagattccacc

SEQ ID NO: 19483 - DNA, 20 bp, Unknown
  RNA secondary structure sequence
ccaggagtgtcggagcacat

SEQ ID NO: 19484 - DNA, 20 bp, Unknown
  RNA secondary structure sequence
gcagacaaggcacccttctg

SEQ ID NO: 19485 - DNA, 20 bp, Unknown
  RNA secondary structure sequence
agcaagcccaatgcacccag

SEQ ID NO: 19486 - DNA, 20 bp, Unknown
  RNA secondary structure sequence
tggatgccatggctctgggc

SEQ ID NO: 19487 - DNA, 20 bp, Unknown
  RNA secondary structure sequence
gccatctcaccaaaggatta

SEQ ID NO: 19488 - DNA, 20 bp, Unknown
  RNA secondary structure sequence
tggaaattactgccctcctg

SEQ ID NO: 19489 - DNA, 20 bp, Unknown
  RNA secondary structure sequence
cgtgcttcgcccggcagtgt

SEQ ID NO: 19490 - DNA, 20 bp, Unknown
  RNA secondary structure sequence
acaccccagcgcagacacgc

SEQ ID NO: 19491 - DNA, 20 bp, Unknown
  RNA secondary structure sequence
acagatgcagtgcaagctgt

SEQ ID NO: 19492 - DNA, 20 bp, Unknown
  RNA secondary structure sequence
ggcccagatgcagatcgaca

SEQ ID NO: 19493 - DNA, 20 bp, Unknown
  RNA secondary structure sequence
ctcatcatattgatgagcga

SEQ ID NO: 19494 - DNA, 20 bp, Unknown
  RNA secondary structure sequence
acacccttcccaccctgctg

SEQ ID NO: 19495 - DNA, 20 bp, Unknown
  RNA secondary structure sequence
gcacactggagtggacgcct

SEQ ID NO: 19496 - DNA, 20 bp, Unknown
  RNA secondary structure sequence
ctgtgccgtccacacctcta

SEQ ID NO: 19497 - DNA, 20 bp, Unknown
  RNA secondary structure sequence
gctttaagccttagccagct

SEQ ID NO: 19498 - DNA, 20 bp, Unknown
  RNA secondary structure sequence
ccggcctcacccccacgagc

SEQ ID NO: 19499 - DNA, 20 bp, Unknown
  RNA secondary structure sequence
ccaagttcctatagaagagc

SEQ ID NO: 19500 - DNA, 20 bp, Unknown
  RNA secondary structure sequence
gaaccgaaactctggcagct

SEQ ID NO: 19501 - DNA, 20 bp, Unknown
  RNA secondary structure sequence
tggggaaggaacgctgtcag

SEQ ID NO: 19502 - DNA, 20 bp, Unknown
  RNA secondary structure sequence
tgagcccatgctgatggagt

SEQ ID NO: 19503 - DNA, 20 bp, Unknown
  RNA secondary structure sequence
cagaagcaggctggaggtaa

SEQ ID NO: 19504 - DNA, 20 bp, Unknown
  RNA secondary structure sequence
ggccaacaaaaaagacctgc

SEQ ID NO: 19505 - DNA, 20 bp, Unknown
  RNA secondary structure sequence
cagagtgtgtggctgtgtgt

SEQ ID NO: 19506 - DNA, 20 bp, Unknown
  RNA secondary structure sequence
gagcaagaggtgtcggaggt

SEQ ID NO: 19507 - DNA, 20 bp, Unknown
  RNA secondary structure sequence
gaagatgtcctcttagtgct

SEQ ID NO: 19508 - DNA, 20 bp, Unknown
  RNA secondary structure sequence
aaactatgtgcagaatctaa

SEQ ID NO: 19509 - DNA, 20 bp, Unknown
  RNA secondary structure sequence
tgtccagtttgtattaaaaa

SEQ ID NO: 19510 - DNA, 20 bp, Unknown
  RNA secondary structure sequence
gtctttgggccctccagttt

SEQ ID NO: 19511 - DNA, 20 bp, Unknown
  RNA secondary structure sequence
gacccaggtcttcaagctgg

SEQ ID NO: 19512 - DNA, 20 bp, Unknown
  RNA secondary structure sequence
tgtagacagtggctgccttc

SEQ ID NO: 19513 - DNA, 20 bp, Unknown
  RNA secondary structure sequence
taatggatttctgttgtgtt

SEQ ID NO: 19514 - DNA, 20 bp, Unknown
  RNA secondary structure sequence
tgttacgggagataattgtg

SEQ ID NO: 19515 - DNA, 20 bp, Unknown
  RNA secondary structure sequence
atacaaggcagatccaacca

SEQ ID NO: 19516 - DNA, 20 bp, Unknown
  RNA secondary structure sequence
tgacagcgttcagcgacccg

SEQ ID NO: 19517 - DNA, 20 bp, Unknown
  RNA secondary structure sequence
accccggctcgtcgcaagcg

SEQ ID NO: 19518 - DNA, 20 bp, Unknown
  RNA secondary structure sequence
accccagcctcccgaaccag

SEQ ID NO: 19519 - DNA, 20 bp, Unknown
  RNA secondary structure sequence
gtgatcgcttggttatccag

SEQ ID NO: 19520 - DNA, 20 bp, Unknown
  RNA secondary structure sequence
acttcctccttaaaacagag

SEQ ID NO: 19521 - DNA, 20 bp, Unknown
  RNA secondary structure sequence
ctcaacaacatctttgtgtt

SEQ ID NO: 19522 - DNA, 20 bp, Unknown
  RNA secondary structure sequence
cccactttctccctcctcct

SEQ ID NO: 19523 - DNA, 20 bp, Unknown
  RNA secondary structure sequence
gccaaccatattggatctgc

SEQ ID NO: 19524 - DNA, 20 bp, Unknown
  RNA secondary structure sequence
tgtttaccgtagcgtataca

SEQ ID NO: 19525 - DNA, 20 bp, Unknown
  RNA secondary structure sequence
tataaaatattgttaatgcc

SEQ ID NO: 19526 - DNA, 20 bp, Unknown
  RNA secondary structure sequence
gagagaatatcccagaaccc

SEQ ID NO: 19527 - DNA, 20 bp, Unknown
  RNA secondary structure sequence
ccagatggcactctggtcac

SEQ ID NO: 19528 - DNA, 20 bp, Unknown
  RNA secondary structure sequence
taataggatttttagacact

SEQ ID NO: 19529 - DNA, 20 bp, Unknown
  RNA secondary structure sequence
gtcaatttgcctctgtgtgc

SEQ ID NO: 19530 - DNA, 20 bp, Unknown
  RNA secondary structure sequence
aacgtacctcttaaaattcg

SEQ ID NO: 19531 - DNA, 20 bp, Unknown
  RNA secondary structure sequence
ctggagaaaaatgaaggaaa

SEQ ID NO: 19532 - DNA, 20 bp, Unknown
  RNA secondary structure sequence
ggtatctttttattcattgc

SEQ ID NO: 19533 - DNA, 20 bp, Unknown
  RNA secondary structure sequence
ccagttcttcccccttcaca

SEQ ID NO: 19534 - DNA, 20 bp, Unknown
  RNA secondary structure sequence
tcgggtgggccgcctcccct

SEQ ID NO: 19535 - DNA, 20 bp, Unknown
  RNA secondary structure sequence
tgtcaaaagaaacacttgga

SEQ ID NO: 19536 - DNA, 20 bp, Unknown
  RNA secondary structure sequence
tactcaaggagctccaagaa

SEQ ID NO: 19537 - DNA, 20 bp, Unknown
  RNA secondary structure sequence
tgccaggcaactcagcaagc

SEQ ID NO: 19538 - DNA, 20 bp, Unknown
  RNA secondary structure sequence
gagaccttttgtcatcccat

SEQ ID NO: 19539 - DNA, 20 bp, Unknown
  RNA secondary structure sequence
cccacctccacctcagcatt

SEQ ID NO: 19540 - DNA, 20 bp, Unknown
  RNA secondary structure sequence
agaagagtggaaacatcttg

SEQ ID NO: 19541 - DNA, 20 bp, Unknown
  RNA secondary structure sequence
cagcagccactctaggcagc

SEQ ID NO: 19542 - DNA, 20 bp, Unknown
  RNA secondary structure sequence
aattatcctatttcagtact

SEQ ID NO: 19543 - DNA, 20 bp, Unknown
  RNA secondary structure sequence
cggaattttgaaaagcacca

SEQ ID NO: 19544 - DNA, 20 bp, Unknown
  RNA secondary structure sequence
tctgcatagaggcaatccta

SEQ ID NO: 19545 - DNA, 20 bp, Unknown
  RNA secondary structure sequence
gtgaaaacaaatacaaaaaa

SEQ ID NO: 19546 - DNA, 20 bp, Unknown
  RNA secondary structure sequence
tgtgagaatataatttgtag

SEQ ID NO: 19547 - DNA, 20 bp, Unknown
  RNA secondary structure sequence
ctgttgaaatgcagatttga

SEQ ID NO: 19548 - DNA, 20 bp, Unknown
  RNA secondary structure sequence
cgtccccggtgtgccatggt

SEQ ID NO: 19549 - DNA, 20 bp, Unknown
  RNA secondary structure sequence
agctcattcataaggggatg

SEQ ID NO: 19550 - DNA, 20 bp, Unknown
  RNA secondary structure sequence
tctagtttccttcttgtgcc

SEQ ID NO: 19551 - DNA, 20 bp, Unknown
  RNA secondary structure sequence
cacttttcctccctctcccg

SEQ ID NO: 19552 - DNA, 20 bp, Unknown
  RNA secondary structure sequence
tttggcaatgacatttcacc

SEQ ID NO: 19553 - DNA, 20 bp, Unknown
  RNA secondary structure sequence
cgtgagctcctccactgcgc

SEQ ID NO: 19554 - DNA, 20 bp, Unknown
  RNA secondary structure sequence
ggctttgacagagagccttt

SEQ ID NO: 19555 - DNA, 20 bp, Unknown
  RNA secondary structure sequence
gccaagatggagcgcacggt

SEQ ID NO: 19556 - DNA, 20 bp, Unknown
  RNA secondary structure sequence
aaagactgggagaagcacca

SEQ ID NO: 19557 - DNA, 20 bp, Unknown
  RNA secondary structure sequence
cttctccaaatacatataca

SEQ ID NO: 19558 - DNA, 20 bp, Unknown
  RNA secondary structure sequence
gaaagcacataaccaggctc

SEQ ID NO: 19559 - DNA, 20 bp, Unknown
  RNA secondary structure sequence
acccacacgtctttatctct

SEQ ID NO: 19560 - DNA, 20 bp, Unknown
  RNA secondary structure sequence
ttcctcttcctccttcccct

SEQ ID NO: 19561 - DNA, 20 bp, Unknown
  RNA secondary structure sequence
attggatagaattgaatggt

SEQ ID NO: 19562 - DNA, 20 bp, Unknown
  RNA secondary structure sequence
ccatcctccatggtgctgaa

SEQ ID NO: 19563 - DNA, 20 bp, Unknown
  RNA secondary structure sequence
ggaggagaattactaccttc

SEQ ID NO: 19564 - DNA, 20 bp, Unknown
  RNA secondary structure sequence
gtcaggttgcttggctgcct

SEQ ID NO: 19565 - DNA, 20 bp, Unknown
  RNA secondary structure sequence
tatctcctctgacacatatt

SEQ ID NO: 19566 - DNA, 20 bp, Unknown
  RNA secondary structure sequence
actctaaaagtcaaatcttc

SEQ ID NO: 19567 - DNA, 20 bp, Unknown
  RNA secondary structure sequence
aagcacaggaccccaggaac

SEQ ID NO: 19568 - DNA, 20 bp, Unknown
  RNA secondary structure sequence
ctcatttcatttgcccagcc

SEQ ID NO: 19569 - DNA, 20 bp, Unknown
  RNA secondary structure sequence
ttgtgattccaaagaatccc

SEQ ID NO: 19570 - DNA, 20 bp, Unknown
  RNA secondary structure sequence
gcttcctcaagcaaggccat

SEQ ID NO: 19571 - DNA, 20 bp, Unknown
  RNA secondary structure sequence
tgctttcatcctgtggcctc

SEQ ID NO: 19572 - DNA, 20 bp, Unknown
  RNA secondary structure sequence
tgaatgccttccacgtgatg

SEQ ID NO: 19573 - DNA, 20 bp, Unknown
  RNA secondary structure sequence
cagcgcctgtccattgcttc

SEQ ID NO: 19574 - DNA, 20 bp, Unknown
  RNA secondary structure sequence
atgacttctggcggctggtt

SEQ ID NO: 19575 - DNA, 20 bp, Unknown
  RNA secondary structure sequence
gggggcgtaaaccaggaaag

SEQ ID NO: 19576 - DNA, 20 bp, Unknown
  RNA secondary structure sequence
gtgcctctgtggtgttgcag

SEQ ID NO: 19577 - DNA, 20 bp, Unknown
  RNA secondary structure sequence
tccgcttcctggagaaactc

SEQ ID NO: 19578 - DNA, 20 bp, Unknown
  RNA secondary structure sequence
cacactcagactcaatggac

SEQ ID NO: 19579 - DNA, 20 bp, Unknown
  RNA secondary structure sequence
gccttgaccacatcactcca

SEQ ID NO: 19580 - DNA, 20 bp, Unknown
  RNA secondary structure sequence
cggaaggccaagaaggcgct

SEQ ID NO: 19581 - DNA, 20 bp, Unknown
  RNA secondary structure sequence
cattcttgtgagccaaacct

SEQ ID NO: 19582 - DNA, 20 bp, Unknown
  RNA secondary structure sequence
caagaagaagctccaaagca

SEQ ID NO: 19583 - DNA, 20 bp, Unknown
  RNA secondary structure sequence
cgcctgcagctggcattggt

SEQ ID NO: 19584 - DNA, 20 bp, Unknown
  RNA secondary structure sequence
ctcaacaactttttgcaggg

SEQ ID NO: 19585 - DNA, 20 bp, Unknown
  RNA secondary structure sequence
cccaaagcttccactcgctg

SEQ ID NO: 19586 - DNA, 20 bp, Unknown
  RNA secondary structure sequence
atcgtctttggtgtggcgct

SEQ ID NO: 19587 - DNA, 20 bp, Unknown
  RNA secondary structure sequence
ttactctttgcccgccttgg

SEQ ID NO: 19588 - DNA, 20 bp, Unknown
  RNA secondary structure sequence
aatgtagaaggtgacgctct

SEQ ID NO: 19589 - DNA, 20 bp, Unknown
  RNA secondary structure sequence
ctccaggacaggagatctgg

SEQ ID NO: 19590 - DNA, 20 bp, Unknown
  RNA secondary structure sequence
tacgtcccaccctgtcccca

SEQ ID NO: 19591 - DNA, 20 bp, Unknown
  RNA secondary structure sequence
tcccggacaccagaccaccg

SEQ ID NO: 19592 - DNA, 20 bp, Unknown
  RNA secondary structure sequence
gcgtccgggatctgcgccac

SEQ ID NO: 19593 - DNA, 20 bp, Unknown
  RNA secondary structure sequence
cggttcccgggaccaggtgc

SEQ ID NO: 19594 - DNA, 20 bp, Unknown
  RNA secondary structure sequence
gcgtctgctgcggatgatca

SEQ ID NO: 19595 - DNA, 20 bp, Unknown
  RNA secondary structure sequence
ggacggtgccgcgctcttcc

SEQ ID NO: 19596 - DNA, 20 bp, Unknown
  RNA secondary structure sequence
agtcaacctcccggtcgacc

SEQ ID NO: 19597 - DNA, 20 bp, Unknown
  RNA secondary structure sequence
gaggaatggataaatggatg

SEQ ID NO: 19598 - DNA, 20 bp, Unknown
  RNA secondary structure sequence
gatgtgtgtgtgcacgtgtg

SEQ ID NO: 19599 - DNA, 20 bp, Unknown
  RNA secondary structure sequence
gggcaacctggcgggtctga

SEQ ID NO: 19600 - DNA, 20 bp, Unknown
  RNA secondary structure sequence
ggctaaaaaaaagagcatcc

SEQ ID NO: 19601 - DNA, 20 bp, Unknown
  RNA secondary structure sequence
tgagattggcctggatgcag

SEQ ID NO: 19602 - DNA, 20 bp, Unknown
  RNA secondary structure sequence
ttcccaggccctttggcttc

SEQ ID NO: 19603 - DNA, 20 bp, Unknown
  RNA secondary structure sequence
cttgcggcgcgaaaaaggcg

SEQ ID NO: 19604 - DNA, 20 bp, Unknown
  RNA secondary structure sequence
ccccttgcccacacacccca

SEQ ID NO: 19605 - DNA, 20 bp, Unknown
  RNA secondary structure sequence
ttacccaggctggtcttcaa

SEQ ID NO: 19606 - DNA, 20 bp, Unknown
  RNA secondary structure sequence
ctaagttcacgggcctgtcc

SEQ ID NO: 19607 - DNA, 20 bp, Unknown
  RNA secondary structure sequence
agtggtggcacacgggcgcc

SEQ ID NO: 19608 - DNA, 20 bp, Unknown
  RNA secondary structure sequence
ccccgcagccaacgggccgc

SEQ ID NO: 19609 - DNA, 20 bp, Unknown
  RNA secondary structure sequence
accctgtggagatcctgcag

SEQ ID NO: 19610 - DNA, 20 bp, Unknown
  RNA secondary structure sequence
gcattctccagcatgccaag

SEQ ID NO: 19611 - DNA, 20 bp, Unknown
  RNA secondary structure sequence
aggggtaccgcaagctcatc

SEQ ID NO: 19612 - DNA, 20 bp, Unknown
  RNA secondary structure sequence
tgtacaacaacaacctgaac

SEQ ID NO: 19613 - DNA, 20 bp, Unknown
  RNA secondary structure sequence
agggcggccggcggcggccg

SEQ ID NO: 19614 - DNA, 20 bp, Unknown
  RNA secondary structure sequence
agaattccgaattggggaac

SEQ ID NO: 19615 - DNA, 20 bp, Unknown
  RNA secondary structure sequence
ggggaggcgccgggaagtcg

SEQ ID NO: 19616 - DNA, 20 bp, Unknown
  RNA secondary structure sequence
agaagctgattcccccgcag

SEQ ID NO: 19617 - DNA, 20 bp, Unknown
  RNA secondary structure sequence
ggctggtgtccctgtacaac

SEQ ID NO: 19618 - DNA, 20 bp, Unknown
  RNA secondary structure sequence
ttgacaagtgggccccctcc

SEQ ID NO: 19619 - DNA, 20 bp, Unknown
  RNA secondary structure sequence
acatcgaggagtccttttcc

SEQ ID NO: 19620 - DNA, 20 bp, Unknown
  RNA secondary structure sequence
aggagccacctctaaaggag

SEQ ID NO: 19621 - DNA, 20 bp, Unknown
  RNA secondary structure sequence
aacaagaggaggaccgctca

SEQ ID NO: 19622 - DNA, 20 bp, Unknown
  RNA secondary structure sequence
ttggagtcactgtagttaag

SEQ ID NO: 19623 - DNA, 20 bp, Unknown
  RNA secondary structure sequence
cggcggcccatgaacgcctt

SEQ ID NO: 19624 - DNA, 20 bp, Unknown
  RNA secondary structure sequence
cagcacatgcaggactaccc

SEQ ID NO: 19625 - DNA, 20 bp, Unknown
  RNA secondary structure sequence
ttctcctccccctgccagga

SEQ ID NO: 19626 - DNA, 20 bp, Unknown
  RNA secondary structure sequence
ccacgttccagcccctgcag

SEQ ID NO: 19627 - DNA, 20 bp, Unknown
  RNA secondary structure sequence
tctgtagattcaaaaggtgc

SEQ ID NO: 19628 - DNA, 20 bp, Unknown
  RNA secondary structure sequence
ttcctcaccagccaggtcct

SEQ ID NO: 19629 - DNA, 20 bp, Unknown
  RNA secondary structure sequence
ctctggcagatgagcgtgaa

SEQ ID NO: 19630 - DNA, 20 bp, Unknown
  RNA secondary structure sequence
attttgacaaactaaagaaa

SEQ ID NO: 19631 - DNA, 20 bp, Unknown
  RNA secondary structure sequence
cctgggaaagactggaaaaa

SEQ ID NO: 19632 - DNA, 20 bp, Unknown
  RNA secondary structure sequence
accttcctgcagttgaggcc

SEQ ID NO: 19633 - DNA, 20 bp, Unknown
  RNA secondary structure sequence
aatacctactggaactgctc

SEQ ID NO: 19634 - DNA, 20 bp, Unknown
  RNA secondary structure sequence
cggctgagcgcagggcccgt

SEQ ID NO: 19635 - DNA, 20 bp, Unknown
  RNA secondary structure sequence
acgagatgagcggccgcagt

SEQ ID NO: 19636 - DNA, 20 bp, Unknown
  RNA secondary structure sequence
cctccctgctgcaccagttc

SEQ ID NO: 19637 - DNA, 20 bp, Unknown
  RNA secondary structure sequence
acacgctgcacgaacaagcc

SEQ ID NO: 19638 - DNA, 20 bp, Unknown
  RNA secondary structure sequence
atgcctgtgagctctggatc

SEQ ID NO: 19639 - DNA, 20 bp, Unknown
  RNA secondary structure sequence
acagcggccacccaagtgag

SEQ ID NO: 19640 - DNA, 20 bp, Unknown
  RNA secondary structure sequence
ccaaggtcatcgagtccacc

SEQ ID NO: 19641 - DNA, 20 bp, Unknown
  RNA secondary structure sequence
tcctgtctcggctggccgag

SEQ ID NO: 19642 - DNA, 20 bp, Unknown
  RNA secondary structure sequence
caaacaccctgaccgaggct

SEQ ID NO: 19643 - DNA, 20 bp, Unknown
  RNA secondary structure sequence
ctggatggaacgagctccac

SEQ ID NO: 19644 - DNA, 20 bp, Unknown
  RNA secondary structure sequence
tccaaagccaagcccaggcc

SEQ ID NO: 19645 - DNA, 20 bp, Unknown
  RNA secondary structure sequence
gcagcagcctcagcgctgag

SEQ ID NO: 19646 - DNA, 20 bp, Unknown
  RNA secondary structure sequence
tgcggcagtccaaagtggat

SEQ ID NO: 19647 - DNA, 20 bp, Unknown
  RNA secondary structure sequence
actatgagcatgtcacgatg

SEQ ID NO: 19648 - DNA, 20 bp, Unknown
  RNA secondary structure sequence
tgcacactacatttgagcat

SEQ ID NO: 19649 - DNA, 20 bp, Unknown
  RNA secondary structure sequence
tccatcagttctcaagagac

SEQ ID NO: 19650 - DNA, 20 bp, Unknown
  RNA secondary structure sequence
aacagggatctccacggatg

SEQ ID NO: 19651 - DNA, 20 bp, Unknown
  RNA secondary structure sequence
ctacagaccaaaccatttgt

SEQ ID NO: 19652 - DNA, 20 bp, Unknown
  RNA secondary structure sequence
gagacctcaccatcctctcc

SEQ ID NO: 19653 - DNA, 20 bp, Unknown
  RNA secondary structure sequence
tggcaataagttcataccag

SEQ ID NO: 19654 - DNA, 20 bp, Unknown
  RNA secondary structure sequence
ttgttgccataatgctgtgc

SEQ ID NO: 19655 - DNA, 20 bp, Unknown
  RNA secondary structure sequence
gttgggatgcatcttctgat

SEQ ID NO: 19656 - DNA, 20 bp, Unknown
  RNA secondary structure sequence
cgtggcatgcttaggattgg

SEQ ID NO: 19657 - DNA, 20 bp, Unknown
  RNA secondary structure sequence
actctcttgcagccaacttc

SEQ ID NO: 19658 - DNA, 20 bp, Unknown
  RNA secondary structure sequence
gaattgcagaggacgtctag

SEQ ID NO: 19659 - DNA, 20 bp, Unknown
  RNA secondary structure sequence
tgccggatcacagacctgta

SEQ ID NO: 19660 - DNA, 20 bp, Unknown
  RNA secondary structure sequence
gaagtgctgctcttcaccat

SEQ ID NO: 19661 - DNA, 20 bp, Unknown
  RNA secondary structure sequence
gaacagctcgcccgcagatt

SEQ ID NO: 19662 - DNA, 20 bp, Unknown
  RNA secondary structure sequence
caggctgtggtagccgtggc

SEQ ID NO: 19663 - DNA, 20 bp, Unknown
  RNA secondary structure sequence
gcaacagacggggaaggtta

SEQ ID NO: 19664 - DNA, 20 bp, Unknown
  RNA secondary structure sequence
tggatacgggagaaggagaa

SEQ ID NO: 19665 - DNA, 20 bp, Unknown
  RNA secondary structure sequence
atcgaggagcggtataagga

SEQ ID NO: 19666 - DNA, 20 bp, Unknown
  RNA secondary structure sequence
ctggttgacaggaagaagga

SEQ ID NO: 19667 - DNA, 20 bp, Unknown
  RNA secondary structure sequence
cggaggctggtgagcgatgg

SEQ ID NO: 19668 - DNA, 20 bp, Unknown
  RNA secondary structure sequence
gctgtggtgaaggagaaact

SEQ ID NO: 19669 - DNA, 20 bp, Unknown
  RNA secondary structure sequence
ttaataaagaaaaatcagac

SEQ ID NO: 19670 - DNA, 20 bp, Unknown
  RNA secondary structure sequence
agacacaggttattccagct

SEQ ID NO: 19671 - DNA, 20 bp, Unknown
  RNA secondary structure sequence
ataggccagagcgtggacga

SEQ ID NO: 19672 - DNA, 20 bp, Unknown
  RNA secondary structure sequence
cccgagccgagcacgaaggt

SEQ ID NO: 19673 - DNA, 20 bp, Unknown
  RNA secondary structure sequence
cttgcacagatgttgcagcc

SEQ ID NO: 19674 - DNA, 20 bp, Unknown
  RNA secondary structure sequence
ttggattaatcttctgattc

SEQ ID NO: 19675 - DNA, 20 bp, Unknown
  RNA secondary structure sequence
aagagaagcaacgtgggggg

SEQ ID NO: 19676 - DNA, 20 bp, Unknown
  RNA secondary structure sequence
aacagcgggctggggcagcc

SEQ ID NO: 19677 - DNA, 20 bp, Unknown
  RNA secondary structure sequence
cagagctacagacctatggg

SEQ ID NO: 19678 - DNA, 20 bp, Unknown
  RNA secondary structure sequence
tttccccaacacctgcggca

SEQ ID NO: 19679 - DNA, 20 bp, Unknown
  RNA secondary structure sequence
cacatcagcacccttgagag

SEQ ID NO: 19680 - DNA, 20 bp, Unknown
  RNA secondary structure sequence
ctagtgctgaagaggatcca

SEQ ID NO: 19681 - DNA, 20 bp, Unknown
  RNA secondary structure sequence
cgggcatcgctgactggccg

SEQ ID NO: 19682 - DNA, 20 bp, Unknown
  RNA secondary structure sequence
cggtgtgagcggaagggcac

SEQ ID NO: 19683 - DNA, 20 bp, Unknown
  RNA secondary structure sequence
aaacagtacgttactagcct

SEQ ID NO: 19684 - DNA, 20 bp, Unknown
  RNA secondary structure sequence
ctgggggaccgaatccggga

SEQ ID NO: 19685 - DNA, 20 bp, Unknown
  RNA secondary structure sequence
ttccaggagcctcacctgca

SEQ ID NO: 19686 - DNA, 20 bp, Unknown
  RNA secondary structure sequence
ccagtgacagcgtttcctca

SEQ ID NO: 19687 - DNA, 20 bp, Unknown
  RNA secondary structure sequence
atctcaatgtcccacatgga

SEQ ID NO: 19688 - DNA, 20 bp, Unknown
  RNA secondary structure sequence
tcaggaggaaaagactaaca

SEQ ID NO: 19689 - DNA, 20 bp, Unknown
  RNA secondary structure sequence
acagagctctctgagggtga

SEQ ID NO: 19690 - DNA, 20 bp, Unknown
  RNA secondary structure sequence
gggccctgcctgctgcatct

SEQ ID NO: 19691 - DNA, 20 bp, Unknown
  RNA secondary structure sequence
gagcttgagcccaagacccg

SEQ ID NO: 19692 - DNA, 20 bp, Unknown
  RNA secondary structure sequence
gccaagcctccgctggtcag

SEQ ID NO: 19693 - DNA, 20 bp, Unknown
  RNA secondary structure sequence
aagatcttcaatgacaacag

SEQ ID NO: 19694 - DNA, 20 bp, Unknown
  RNA secondary structure sequence
caaccacttcctaccccaga

SEQ ID NO: 19695 - DNA, 20 bp, Unknown
  RNA secondary structure sequence
gtcaacgtgttgtcagcctt

SEQ ID NO: 19696 - DNA, 20 bp, Unknown
  RNA secondary structure sequence
acgcacgcacacacacatac

SEQ ID NO: 19697 - DNA, 20 bp, Unknown
  RNA secondary structure sequence
atgcaaaagtacaagggctg

SEQ ID NO: 19698 - DNA, 20 bp, Unknown
  RNA secondary structure sequence
gggctatcccgacccggcgg

SEQ ID NO: 19699 - DNA, 20 bp, Unknown
  RNA secondary structure sequence
cggcgctcggcttcctcctg

SEQ ID NO: 19700 - DNA, 20 bp, Unknown
  RNA secondary structure sequence
aggcagagtcgggggccttg

SEQ ID NO: 19701 - DNA, 20 bp, Unknown
  RNA secondary structure sequence
aggggggatgtcacacgcag

SEQ ID NO: 19702 - DNA, 20 bp, Unknown
  RNA secondary structure sequence
catttctatgtgtaatttct

SEQ ID NO: 19703 - DNA, 20 bp, Unknown
  RNA secondary structure sequence
ctcttctggagtagggggtc

SEQ ID NO: 19704 - DNA, 20 bp, Unknown
  RNA secondary structure sequence
acttgttcctggggaatgcc

SEQ ID NO: 19705 - DNA, 20 bp, Unknown
  RNA secondary structure sequence
gcaagatctggggctgcaga

SEQ ID NO: 19706 - DNA, 20 bp, Unknown
  RNA secondary structure sequence
aaagctaaagcaataacatt

SEQ ID NO: 19707 - DNA, 20 bp, Unknown
  RNA secondary structure sequence
tgacggttgaggacttcaac

SEQ ID NO: 19708 - DNA, 20 bp, Unknown
  RNA secondary structure sequence
gctgtgctgagacagctgtc

SEQ ID NO: 19709 - DNA, 20 bp, Unknown
  RNA secondary structure sequence
cactccaggacttgcagacg

SEQ ID NO: 19710 - DNA, 20 bp, Unknown
  RNA secondary structure sequence
gtctggtgggcagtgtcctc

SEQ ID NO: 19711 - DNA, 20 bp, Unknown
  RNA secondary structure sequence
ccggggacaagaaggagccg

SEQ ID NO: 19712 - DNA, 20 bp, Unknown
  RNA secondary structure sequence
cgtacgggcctagcccggcc

SEQ ID NO: 19713 - DNA, 20 bp, Unknown
  RNA secondary structure sequence
gccagtgcgcatgcgcgagt

SEQ ID NO: 19714 - DNA, 20 bp, Unknown
  RNA secondary structure sequence
cgtgacggtgggggacttcc

SEQ ID NO: 19715 - DNA, 20 bp, Unknown
  RNA secondary structure sequence
gctcagccactgactgcccc

SEQ ID NO: 19716 - DNA, 20 bp, Unknown
  RNA secondary structure sequence
tggtgaccctgggcgtctga

SEQ ID NO: 19717 - DNA, 20 bp, Unknown
  RNA secondary structure sequence
agtgcctgagagacaagtgt

SEQ ID NO: 19718 - DNA, 20 bp, Unknown
  RNA secondary structure sequence
tgccctccacctggcctgct

SEQ ID NO: 19719 - DNA, 20 bp, Unknown
  RNA secondary structure sequence
cgggagctgctggaggagat

SEQ ID NO: 19720 - DNA, 20 bp, Unknown
  RNA secondary structure sequence
acacggggcactgccgagtg

SEQ ID NO: 19721 - DNA, 20 bp, Unknown
  RNA secondary structure sequence
actctgaaccctgaagcatc

SEQ ID NO: 19722 - DNA, 20 bp, Unknown
  RNA secondary structure sequence
accaccactgcctgactgcc

SEQ ID NO: 19723 - DNA, 20 bp, Unknown
  RNA secondary structure sequence
gacacttcagatctgaggtt

SEQ ID NO: 19724 - DNA, 20 bp, Unknown
  RNA secondary structure sequence
tttccttgggccttcaaact

SEQ ID NO: 19725 - DNA, 20 bp, Unknown
  RNA secondary structure sequence
ctgcaggccaggggcctggc

SEQ ID NO: 19726 - DNA, 20 bp, Unknown
  RNA secondary structure sequence
acagtgctttccaggtggat

SEQ ID NO: 19727 - DNA, 20 bp, Unknown
  RNA secondary structure sequence
ggctccctcggccaaaggac

SEQ ID NO: 19728 - DNA, 20 bp, Unknown
  RNA secondary structure sequence
attacaccattattgagaat

SEQ ID NO: 19729 - DNA, 20 bp, Unknown
  RNA secondary structure sequence
gtacgaagatggagaagcac

SEQ ID NO: 19730 - DNA, 20 bp, Unknown
  RNA secondary structure sequence
tgaaggaaccaaatccaatt

SEQ ID NO: 19731 - DNA, 20 bp, Unknown
  RNA secondary structure sequence
aggcttgggggttttcaatg

SEQ ID NO: 19732 - DNA, 20 bp, Unknown
  RNA secondary structure sequence
ctgaaccaagatgtaaaaca

SEQ ID NO: 19733 - DNA, 20 bp, Unknown
  RNA secondary structure sequence
caccaagacagtgctgagat

SEQ ID NO: 19734 - DNA, 20 bp, Unknown
  RNA secondary structure sequence
taaaaaaaaaaaaaaaaaaa

SEQ ID NO: 19735 - DNA, 20 bp, Unknown
  RNA secondary structure sequence
cccactgcccttaaaataag

SEQ ID NO: 19736 - DNA, 20 bp, Unknown
  RNA secondary structure sequence
ttgatgctgaagctgttgtt

SEQ ID NO: 19737 - DNA, 20 bp, Unknown
  RNA secondary structure sequence
tgggtgagtcctatgtgatt

SEQ ID NO: 19738 - DNA, 20 bp, Unknown
  RNA secondary structure sequence
aaaacgagtacccttaaaat

SEQ ID NO: 19739 - DNA, 20 bp, Unknown
  RNA secondary structure sequence
ccgcgcgctgattgctgtgg

SEQ ID NO: 19740 - DNA, 20 bp, Unknown
  RNA secondary structure sequence
tttagccactgcaggtccag

SEQ ID NO: 19741 - DNA, 20 bp, Unknown
  RNA secondary structure sequence
ttctgtggtccagttttcat

SEQ ID NO: 19742 - DNA, 20 bp, Unknown
  RNA secondary structure sequence
aaatccaatttctccaccaa

SEQ ID NO: 19743 - DNA, 20 bp, Unknown
  RNA secondary structure sequence
aaacagcagtgctgcccaca

SEQ ID NO: 19744 - DNA, 20 bp, Unknown
  RNA secondary structure sequence
cacactttacagttttaata

SEQ ID NO: 19745 - DNA, 20 bp, Unknown
  RNA secondary structure sequence
gtgacttgcacgtactcccc

SEQ ID NO: 19746 - DNA, 20 bp, Unknown
  RNA secondary structure sequence
gagcgctgctcagatagcga

SEQ ID NO: 19747 - DNA, 20 bp, Unknown
  RNA secondary structure sequence
tgtaacagttcctgcatggg

SEQ ID NO: 19748 - DNA, 20 bp, Unknown
  RNA secondary structure sequence
gcatttgcacctacctcaca

SEQ ID NO: 19749 - DNA, 20 bp, Unknown
  RNA secondary structure sequence
ttttttcttttttttttttt

SEQ ID NO: 19750 - DNA, 20 bp, Unknown
  RNA secondary structure sequence
cagccaacttttgcatgttt

SEQ ID NO: 19751 - DNA, 20 bp, Unknown
  RNA secondary structure sequence
acctgccctgtgcagctgtg

SEQ ID NO: 19752 - DNA, 20 bp, Unknown
  RNA secondary structure sequence
aaaaagggtcagtctacctc

SEQ ID NO: 19753 - DNA, 20 bp, Unknown
  RNA secondary structure sequence
gtcagaagcacccaggactt

SEQ ID NO: 19754 - DNA, 20 bp, Unknown
  RNA secondary structure sequence
cttggtgaaccttagtacct

SEQ ID NO: 19755 - DNA, 20 bp, Unknown
  RNA secondary structure sequence
ttgcccaggctggagtggag

SEQ ID NO: 19756 - DNA, 20 bp, Unknown
  RNA secondary structure sequence
catcgccttgagctgcccac

SEQ ID NO: 19757 - DNA, 20 bp, Unknown
  RNA secondary structure sequence
gctgcctccgacagcgccgc

SEQ ID NO: 19758 - DNA, 20 bp, Unknown
  RNA secondary structure sequence
ctgcatcacggagcactggg

SEQ ID NO: 19759 - DNA, 20 bp, Unknown
  RNA secondary structure sequence
accctgccaggcgcacgaca

SEQ ID NO: 19760 - DNA, 20 bp, Unknown
  RNA secondary structure sequence
cgagcgggaacacaccgaag

SEQ ID NO: 19761 - DNA, 20 bp, Unknown
  RNA secondary structure sequence
gctgaccgacatcgagcaga

SEQ ID NO: 19762 - DNA, 20 bp, Unknown
  RNA secondary structure sequence
atatgaagacttcccgacct

SEQ ID NO: 19763 - DNA, 20 bp, Unknown
  RNA secondary structure sequence
gcccagccgcggcttctact

SEQ ID NO: 19764 - DNA, 20 bp, Unknown
  RNA secondary structure sequence
agatagaagacctggactcc

SEQ ID NO: 19765 - DNA, 20 bp, Unknown
  RNA secondary structure sequence
ccccagtagctctgaacaag

SEQ ID NO: 19766 - DNA, 20 bp, Unknown
  RNA secondary structure sequence
gcaggaagccactatgccag

SEQ ID NO: 19767 - DNA, 20 bp, Unknown
  RNA secondary structure sequence
agccagaagattttatctag

SEQ ID NO: 19768 - DNA, 20 bp, Unknown
  RNA secondary structure sequence
ttgcgcttagtgtcctacat

SEQ ID NO: 19769 - DNA, 20 bp, Unknown
  RNA secondary structure sequence
tagtactgtgcctctttctt

SEQ ID NO: 19770 - DNA, 20 bp, Unknown
  RNA secondary structure sequence
gaagtaaatccttgttcact

SEQ ID NO: 19771 - DNA, 20 bp, Unknown
  RNA secondary structure sequence
ggggcgtgatttgactgcat

SEQ ID NO: 19772 - DNA, 20 bp, Unknown
  RNA secondary structure sequence
cggagcgtcaggtcccgttt

SEQ ID NO: 19773 - DNA, 20 bp, Unknown
  RNA secondary structure sequence
cccggcaatgttccctcgaa

SEQ ID NO: 19774 - DNA, 20 bp, Unknown
  RNA secondary structure sequence
acaaagcctgaacctccttt

SEQ ID NO: 19775 - DNA, 20 bp, Unknown
  RNA secondary structure sequence
cccagtatctagaaaactct

SEQ ID NO: 19776 - DNA, 20 bp, Unknown
  RNA secondary structure sequence
gctaccatattctcaggcgg

SEQ ID NO: 19777 - DNA, 20 bp, Unknown
  RNA secondary structure sequence
tcttcaaacagcaatgtcct

SEQ ID NO: 19778 - DNA, 20 bp, Unknown
  RNA secondary structure sequence
tttcccgttgaaggtgctac

SEQ ID NO: 19779 - DNA, 20 bp, Unknown
  RNA secondary structure sequence
caaagaactaatagagaaaa

SEQ ID NO: 19780 - DNA, 20 bp, Unknown
  RNA secondary structure sequence
ctcaggaccaaccgcatagc

SEQ ID NO: 19781 - DNA, 20 bp, Unknown
  RNA secondary structure sequence
ggcagtggaatgattggaaa

SEQ ID NO: 19782 - DNA, 20 bp, Unknown
  RNA secondary structure sequence
gaaagagatgatctcttaca

SEQ ID NO: 19783 - DNA, 20 bp, Unknown
  RNA secondary structure sequence
tctaaggcttgtcttaagtc

SEQ ID NO: 19784 - DNA, 20 bp, Unknown
  RNA secondary structure sequence
atgatggatggctcactgcc

SEQ ID NO: 19785 - DNA, 20 bp, Unknown
  RNA secondary structure sequence
atggtcactctgtggtcatc

SEQ ID NO: 19786 - DNA, 20 bp, Unknown
  RNA secondary structure sequence
ggacaccaggccgactcaga

SEQ ID NO: 19787 - DNA, 20 bp, Unknown
  RNA secondary structure sequence
atgaagaacagaccaatgtg

SEQ ID NO: 19788 - DNA, 20 bp, Unknown
  RNA secondary structure sequence
tgggctttcacgtactgggt

SEQ ID NO: 19789 - DNA, 20 bp, Unknown
  RNA secondary structure sequence
aggctggctgctgaggttaa

SEQ ID NO: 19790 - DNA, 20 bp, Unknown
  RNA secondary structure sequence
ttggaggctatgtaggcttg

SEQ ID NO: 19791 - DNA, 20 bp, Unknown
  RNA secondary structure sequence
ttaaggtctgtttaggaagg

SEQ ID NO: 19792 - DNA, 20 bp, Unknown
  RNA secondary structure sequence
tctcagttgcagcactgagt

SEQ ID NO: 19793 - DNA, 20 bp, Unknown
  RNA secondary structure sequence
taggttgccagggctgcacg

SEQ ID NO: 19794 - DNA, 20 bp, Unknown
  RNA secondary structure sequence
ctgaaggagggcctgatgtc

SEQ ID NO: 19795 - DNA, 20 bp, Unknown
  RNA secondary structure sequence
gaccaggacatggccaacaa

SEQ ID NO: 19796 - DNA, 20 bp, Unknown
  RNA secondary structure sequence
catagttacttttggccatt

SEQ ID NO: 19797 - DNA, 20 bp, Unknown
  RNA secondary structure sequence
accaaaaagcagctggacag

SEQ ID NO: 19798 - DNA, 20 bp, Unknown
  RNA secondary structure sequence
ccaaatccaaggcgaagttt

SEQ ID NO: 19799 - DNA, 20 bp, Unknown
  RNA secondary structure sequence
caccattatttgtcatggag

SEQ ID NO: 19800 - DNA, 20 bp, Unknown
  RNA secondary structure sequence
taggcagcagagcccctgac

SEQ ID NO: 19801 - DNA, 20 bp, Unknown
  RNA secondary structure sequence
tgaaattagaacagtaggcg

SEQ ID NO: 19802 - DNA, 20 bp, Unknown
  RNA secondary structure sequence
gaagtaccttatgagccata

SEQ ID NO: 19803 - DNA, 20 bp, Unknown
  RNA secondary structure sequence
aatgtctatgcagatggtag

SEQ ID NO: 19804 - DNA, 20 bp, Unknown
  RNA secondary structure sequence
cactcatgccaagtttcaga

SEQ ID NO: 19805 - DNA, 20 bp, Unknown
  RNA secondary structure sequence
gtaccaggagaacaaacggg

SEQ ID NO: 19806 - DNA, 20 bp, Unknown
  RNA secondary structure sequence
agtgaataaactcaattgtc

SEQ ID NO: 19807 - DNA, 20 bp, Unknown
  RNA secondary structure sequence
tggcagattatgaagcacgg

SEQ ID NO: 19808 - DNA, 20 bp, Unknown
  RNA secondary structure sequence
atgctaaatggtatccaggg

SEQ ID NO: 19809 - DNA, 20 bp, Unknown
  RNA secondary structure sequence
aagctatacgaatggggttc

SEQ ID NO: 19810 - DNA, 20 bp, Unknown
  RNA secondary structure sequence
tttttatgtcttaatctaac

SEQ ID NO: 19811 - DNA, 20 bp, Unknown
  RNA secondary structure sequence
cttttcagataggcttaaca

SEQ ID NO: 19812 - DNA, 20 bp, Unknown
  RNA secondary structure sequence
tttcttttaaagttataaac

SEQ ID NO: 19813 - DNA, 20 bp, Unknown
  RNA secondary structure sequence
gaattttttataagtatgta

SEQ ID NO: 19814 - DNA, 20 bp, Unknown
  RNA secondary structure sequence
gaatagttgtttaaatattt

SEQ ID NO: 19815 - DNA, 20 bp, Unknown
  RNA secondary structure sequence
ctcaaggactgaattgtttt

SEQ ID NO: 19816 - DNA, 20 bp, Unknown
  RNA secondary structure sequence
tgtttctcatagataagata

SEQ ID NO: 19817 - DNA, 20 bp, Unknown
  RNA secondary structure sequence
gctcatgcctgtaatcccag

SEQ ID NO: 19818 - DNA, 20 bp, Unknown
  RNA secondary structure sequence
tattgtattaggtattaaag

SEQ ID NO: 19819 - DNA, 20 bp, Unknown
  RNA secondary structure sequence
cacatgcagactatcttttg

SEQ ID NO: 19820 - DNA, 20 bp, Unknown
  RNA secondary structure sequence
caaattcaacaaatcttcca

SEQ ID NO: 19821 - DNA, 20 bp, Unknown
  RNA secondary structure sequence
agtcaagtcagacttcatta

SEQ ID NO: 19822 - DNA, 20 bp, Unknown
  RNA secondary structure sequence
gattctcatatcatcttgta

SEQ ID NO: 19823 - DNA, 20 bp, Unknown
  RNA secondary structure sequence
ttggaaattataaaaatatt

SEQ ID NO: 19824 - DNA, 20 bp, Unknown
  RNA secondary structure sequence
gtttcaccatgttggccagg

SEQ ID NO: 19825 - DNA, 20 bp, Unknown
  RNA secondary structure sequence
ttgatcatttgcaaagtcaa

SEQ ID NO: 19826 - DNA, 20 bp, Unknown
  RNA secondary structure sequence
agggtagagtgggtgtagtg

SEQ ID NO: 19827 - DNA, 20 bp, Unknown
  RNA secondary structure sequence
gtttcacatgatataccctt

SEQ ID NO: 19828 - DNA, 20 bp, Unknown
  RNA secondary structure sequence
ttcatctgtgaaaggaaaat

SEQ ID NO: 19829 - DNA, 20 bp, Unknown
  RNA secondary structure sequence
ctactaaaaatacaaaatta

SEQ ID NO: 19830 - DNA, 20 bp, Unknown
  RNA secondary structure sequence
cagagtgagaccccatctct

SEQ ID NO: 19831 - DNA, 20 bp, Unknown
  RNA secondary structure sequence
gaatttcttcctcagcataa

SEQ ID NO: 19832 - DNA, 20 bp, Unknown
  RNA secondary structure sequence
tgaaaaacttcaccaagcta

SEQ ID NO: 19833 - DNA, 20 bp, Unknown
  RNA secondary structure sequence
aaaaaaagcaattattttta

SEQ ID NO: 19834 - DNA, 20 bp, Unknown
  RNA secondary structure sequence
ggagcctgaggtgggaggat

SEQ ID NO: 19835 - DNA, 20 bp, Unknown
  RNA secondary structure sequence
aatttctgacctcaagtgat

SEQ ID NO: 19836 - DNA, 20 bp, Unknown
  RNA secondary structure sequence
acatatggaggctcctgtca

SEQ ID NO: 19837 - DNA, 20 bp, Unknown
  RNA secondary structure sequence
caaaaccacatctaagagaa

SEQ ID NO: 19838 - DNA, 20 bp, Unknown
  RNA secondary structure sequence
ctgttaaaccaaaatatttt

SEQ ID NO: 19839 - DNA, 20 bp, Unknown
  RNA secondary structure sequence
gtgccagacactgttctgga

SEQ ID NO: 19840 - DNA, 20 bp, Unknown
  RNA secondary structure sequence
ctgaatgaaatggacatttt

SEQ ID NO: 19841 - DNA, 20 bp, Unknown
  RNA secondary structure sequence
tgccattttcctcaccagta

SEQ ID NO: 19842 - DNA, 20 bp, Unknown
  RNA secondary structure sequence
gttcccaatgtccttctagt

SEQ ID NO: 19843 - DNA, 20 bp, Unknown
  RNA secondary structure sequence
atgacagagtgagacttcat

SEQ ID NO: 19844 - DNA, 20 bp, Unknown
  RNA secondary structure sequence
ttacggcagcatacgacctg

SEQ ID NO: 19845 - DNA, 20 bp, Unknown
  RNA secondary structure sequence
tcattggaatggtaagagtt

SEQ ID NO: 19846 - DNA, 20 bp, Unknown
  RNA secondary structure sequence
aacggccagaatgaattcta

SEQ ID NO: 19847 - DNA, 20 bp, Unknown
  RNA secondary structure sequence
gagccgccagagcgatcccc

SEQ ID NO: 19848 - DNA, 20 bp, Unknown
  RNA secondary structure sequence
cgctcagccctacatccagc

SEQ ID NO: 19849 - DNA, 20 bp, Unknown
  RNA secondary structure sequence
catgaaccccgcgagcatgg

SEQ ID NO: 19850 - DNA, 20 bp, Unknown
  RNA secondary structure sequence
aaagaggccataccctggag

SEQ ID NO: 19851 - DNA, 20 bp, Unknown
  RNA secondary structure sequence
ccccacggtcaacatggggc

SEQ ID NO: 19852 - DNA, 20 bp, Unknown
  RNA secondary structure sequence
catgacccctgggagcagca

SEQ ID NO: 19853 - DNA, 20 bp, Unknown
  RNA secondary structure sequence
ccgcctggagcacaacctgg

SEQ ID NO: 19854 - DNA, 20 bp, Unknown
  RNA secondary structure sequence
actcctcaagaagcgcctcc

SEQ ID NO: 19855 - DNA, 20 bp, Unknown
  RNA secondary structure sequence
cgagctcctgtcttatctgg

SEQ ID NO: 19856 - DNA, 20 bp, Unknown
  RNA secondary structure sequence
taagccaagataccccataa

SEQ ID NO: 19857 - DNA, 20 bp, Unknown
  RNA secondary structure sequence
tggggaacagagagagcagg

SEQ ID NO: 19858 - DNA, 20 bp, Unknown
  RNA secondary structure sequence
agaaaccagagcccagggca

SEQ ID NO: 19859 - DNA, 20 bp, Unknown
  RNA secondary structure sequence
agcctaccctgcctgcactc

SEQ ID NO: 19860 - DNA, 20 bp, Unknown
  RNA secondary structure sequence
ccgtgagccacatggcctag

SEQ ID NO: 19861 - DNA, 20 bp, Unknown
  RNA secondary structure sequence
tgacttccagtcactgtccc

SEQ ID NO: 19862 - DNA, 20 bp, Unknown
  RNA secondary structure sequence
agatgccttccttaggagtt

SEQ ID NO: 19863 - DNA, 20 bp, Unknown
  RNA secondary structure sequence
gcaaccatctctgggctcag

SEQ ID NO: 19864 - DNA, 20 bp, Unknown
  RNA secondary structure sequence
tgcaagccacttttccatgc

SEQ ID NO: 19865 - DNA, 20 bp, Unknown
  RNA secondary structure sequence
tattttttaagaaactgcta

SEQ ID NO: 19866 - DNA, 20 bp, Unknown
  RNA secondary structure sequence
actgttatctttttgatgga

SEQ ID NO: 19867 - DNA, 20 bp, Unknown
  RNA secondary structure sequence
ctgtgccaggagctgttctt

SEQ ID NO: 19868 - DNA, 20 bp, Unknown
  RNA secondary structure sequence
ctaaagagcttagtttgccc

SEQ ID NO: 19869 - DNA, 20 bp, Unknown
  RNA secondary structure sequence
cgctccgccaatacaataga

SEQ ID NO: 19870 - DNA, 20 bp, Unknown
  RNA secondary structure sequence
gcttaggtatctgtgctgtg

SEQ ID NO: 19871 - DNA, 20 bp, Unknown
  RNA secondary structure sequence
aggcttggaaccagcacagc

SEQ ID NO: 19872 - DNA, 20 bp, Unknown
  RNA secondary structure sequence
ccaagtgctgttcaactcag

SEQ ID NO: 19873 - DNA, 20 bp, Unknown
  RNA secondary structure sequence
ggttgtgtagatgtggccgg

SEQ ID NO: 19874 - DNA, 20 bp, Unknown
  RNA secondary structure sequence
gcctttccagaccggagacg

SEQ ID NO: 19875 - DNA, 20 bp, Unknown
  RNA secondary structure sequence
cagccaaaacctgctaagtc

SEQ ID NO: 19876 - DNA, 20 bp, Unknown
  RNA secondary structure sequence
gtttcaagtgatcctcccgc

SEQ ID NO: 19877 - DNA, 20 bp, Unknown
  RNA secondary structure sequence
tgcccctccctccgggtgga

SEQ ID NO: 19878 - DNA, 20 bp, Unknown
  RNA secondary structure sequence
cggcgaggtgaaggccgacc

SEQ ID NO: 19879 - DNA, 20 bp, Unknown
  RNA secondary structure sequence
tcttagatctcgttttgagg

SEQ ID NO: 19880 - DNA, 20 bp, Unknown
  RNA secondary structure sequence
atcccccacagaagccccct

SEQ ID NO: 19881 - DNA, 20 bp, Unknown
  RNA secondary structure sequence
ccctgaggccggcccgcgtc

SEQ ID NO: 19882 - DNA, 20 bp, Unknown
  RNA secondary structure sequence
ctgacgggtgacgccagcgg

SEQ ID NO: 19883 - DNA, 20 bp, Unknown
  RNA secondary structure sequence
accttagacaaggaaagttt

SEQ ID NO: 19884 - DNA, 20 bp, Unknown
  RNA secondary structure sequence
ctggcagagcctgtagttgg

SEQ ID NO: 19885 - DNA, 20 bp, Unknown
  RNA secondary structure sequence
agttgtctctgatcacttgt

SEQ ID NO: 19886 - DNA, 20 bp, Unknown
  RNA secondary structure sequence
ccaaaaataatccggagaca

SEQ ID NO: 19887 - DNA, 20 bp, Unknown
  RNA secondary structure sequence
ccatttgaccagaacgtgtg

SEQ ID NO: 19888 - DNA, 20 bp, Unknown
  RNA secondary structure sequence
tcgacccagcttgaggtctc

SEQ ID NO: 19889 - DNA, 20 bp, Unknown
  RNA secondary structure sequence
gcgcgcggggcgcccccgcg

SEQ ID NO: 19890 - DNA, 20 bp, Unknown
  RNA secondary structure sequence
agctccggccccgccgttcc

SEQ ID NO: 19891 - DNA, 20 bp, Unknown
  RNA secondary structure sequence
ggctctgacgcggcgcccca

SEQ ID NO: 19892 - DNA, 20 bp, Unknown
  RNA secondary structure sequence
tctccagcttgcatggcctg

SEQ ID NO: 19893 - DNA, 20 bp, Unknown
  RNA secondary structure sequence
aggaaggaacgctcgagatt

SEQ ID NO: 19894 - DNA, 20 bp, Unknown
  RNA secondary structure sequence
cagagatcccggtcctccgg

SEQ ID NO: 19895 - DNA, 20 bp, Unknown
  RNA secondary structure sequence
gcgaaggtgtcgctgccaag

SEQ ID NO: 19896 - DNA, 20 bp, Unknown
  RNA secondary structure sequence
cgggcactgccccaggtctt

SEQ ID NO: 19897 - DNA, 20 bp, Unknown
  RNA secondary structure sequence
agattttggagcggagcgtt

SEQ ID NO: 19898 - DNA, 20 bp, Unknown
  RNA secondary structure sequence
tgctcgcgttcgcaagctcc

SEQ ID NO: 19899 - DNA, 20 bp, Unknown
  RNA secondary structure sequence
ccggggctgaggctggggct

SEQ ID NO: 19900 - DNA, 20 bp, Unknown
  RNA secondary structure sequence
cccgagcatgagcagagatc

SEQ ID NO: 19901 - DNA, 20 bp, Unknown
  RNA secondary structure sequence
cccggcttcagcggcaccgc

SEQ ID NO: 19902 - DNA, 20 bp, Unknown
  RNA secondary structure sequence
tggcaaagacacgctggctg

SEQ ID NO: 19903 - DNA, 20 bp, Unknown
  RNA secondary structure sequence
aaagaatggagaattattga

SEQ ID NO: 19904 - DNA, 20 bp, Unknown
  RNA secondary structure sequence
gctgacaccgacccaacgtc

SEQ ID NO: 19905 - DNA, 20 bp, Unknown
  RNA secondary structure sequence
aagtgtaattctggaccaat

SEQ ID NO: 19906 - DNA, 20 bp, Unknown
  RNA secondary structure sequence
agccgtagtcttggcccacg

SEQ ID NO: 19907 - DNA, 20 bp, Unknown
  RNA secondary structure sequence
gtagctcggcagccctgcca

SEQ ID NO: 19908 - DNA, 20 bp, Unknown
  RNA secondary structure sequence
aaccctacagcttggggcct

SEQ ID NO: 19909 - DNA, 20 bp, Unknown
  RNA secondary structure sequence
caggcgactgaagacgatgg

SEQ ID NO: 19910 - DNA, 20 bp, Unknown
  RNA secondary structure sequence
ggggctgtttttcaactcct

SEQ ID NO: 19911 - DNA, 20 bp, Unknown
  RNA secondary structure sequence
gtggacacaattctcacctg

SEQ ID NO: 19912 - DNA, 20 bp, Unknown
  RNA secondary structure sequence
ggagctctggaggctgggct

SEQ ID NO: 19913 - DNA, 20 bp, Unknown
  RNA secondary structure sequence
acaatgaaagtcgctgaaga

SEQ ID NO: 19914 - DNA, 20 bp, Unknown
  RNA secondary structure sequence
ggcaccaagagagtggacgc

SEQ ID NO: 19915 - DNA, 20 bp, Unknown
  RNA secondary structure sequence
tccaaggaggtggctgtgca

SEQ ID NO: 19916 - DNA, 20 bp, Unknown
  RNA secondary structure sequence
ggtggagccgcctcggcgtt

SEQ ID NO: 19917 - DNA, 20 bp, Unknown
  RNA secondary structure sequence
caaagatcaactcccactga

SEQ ID NO: 19918 - DNA, 20 bp, Unknown
  RNA secondary structure sequence
gcagaaagggacggagaaca

SEQ ID NO: 19919 - DNA, 20 bp, Unknown
  RNA secondary structure sequence
ctggtaaatccacaggaatt

SEQ ID NO: 19920 - DNA, 20 bp, Unknown
  RNA secondary structure sequence
tgtactttgacgacaagaaa

SEQ ID NO: 19921 - DNA, 20 bp, Unknown
  RNA secondary structure sequence
gcttcagtggccaaagatct

SEQ ID NO: 19922 - DNA, 20 bp, Unknown
  RNA secondary structure sequence
agagtgatggctgttttagt

SEQ ID NO: 19923 - DNA, 20 bp, Unknown
  RNA secondary structure sequence
aaaccccgagtgctataccg

SEQ ID NO: 19924 - DNA, 20 bp, Unknown
  RNA secondary structure sequence
gactgacccaccatgacacc

SEQ ID NO: 19925 - DNA, 20 bp, Unknown
  RNA secondary structure sequence
cataaactgtcagaggcagc

SEQ ID NO: 19926 - DNA, 20 bp, Unknown
  RNA secondary structure sequence
ccgctcccaaactgtacctg

SEQ ID NO: 19927 - DNA, 20 bp, Unknown
  RNA secondary structure sequence
ggtacggggagctcgcaaat

SEQ ID NO: 19928 - DNA, 20 bp, Unknown
  RNA secondary structure sequence
gtatcagttctccgtcaact

SEQ ID NO: 19929 - DNA, 20 bp, Unknown
  RNA secondary structure sequence
agcccttgtctcgggaccgc

SEQ ID NO: 19930 - DNA, 20 bp, Unknown
  RNA secondary structure sequence
aagggaggaaggagtcccag

SEQ ID NO: 19931 - DNA, 20 bp, Unknown
  RNA secondary structure sequence
gtgtattcctgggacgatgc

SEQ ID NO: 19932 - DNA, 20 bp, Unknown
  RNA secondary structure sequence
cgggcgcaccgcggccccca

SEQ ID NO: 19933 - DNA, 20 bp, Unknown
  RNA secondary structure sequence
acagcaacttttctaagacc

SEQ ID NO: 19934 - DNA, 20 bp, Unknown
  RNA secondary structure sequence
tccaagatgtccacgccctg

SEQ ID NO: 19935 - DNA, 20 bp, Unknown
  RNA secondary structure sequence
gcgagccggagaccgagccc

SEQ ID NO: 19936 - DNA, 20 bp, Unknown
  RNA secondary structure sequence
acctgatttgtgaacctatc

SEQ ID NO: 19937 - DNA, 20 bp, Unknown
  RNA secondary structure sequence
agtttcgatgctgccggcgc

SEQ ID NO: 19938 - DNA, 20 bp, Unknown
  RNA secondary structure sequence
acccttaccggcacccggcc

SEQ ID NO: 19939 - DNA, 20 bp, Unknown
  RNA secondary structure sequence
cgcttccattgtcagaatgg

SEQ ID NO: 19940 - DNA, 20 bp, Unknown
  RNA secondary structure sequence
actggtgctgactgcaacca

SEQ ID NO: 19941 - DNA, 20 bp, Unknown
  RNA secondary structure sequence
gggctgtttggaaagaccca

SEQ ID NO: 19942 - DNA, 20 bp, Unknown
  RNA secondary structure sequence
attgccagtacctgcctcca

SEQ ID NO: 19943 - DNA, 20 bp, Unknown
  RNA secondary structure sequence
gtcggagcccgggcgggcga

SEQ ID NO: 19944 - DNA, 20 bp, Unknown
  RNA secondary structure sequence
tcggattgctcaaggaccca

SEQ ID NO: 19945 - DNA, 20 bp, Unknown
  RNA secondary structure sequence
agaccacccagcccagccaa

SEQ ID NO: 19946 - DNA, 20 bp, Unknown
  RNA secondary structure sequence
cggggccctggaagctccta

SEQ ID NO: 19947 - DNA, 20 bp, Unknown
  RNA secondary structure sequence
aagatcctgatcctcctgct

SEQ ID NO: 19948 - DNA, 20 bp, Unknown
  RNA secondary structure sequence
ccccttcatgggactcccaa

SEQ ID NO: 19949 - DNA, 20 bp, Unknown
  RNA secondary structure sequence
ggttgctgacaccctgtgcc

SEQ ID NO: 19950 - DNA, 20 bp, Unknown
  RNA secondary structure sequence
tctagccggaacctgggggc

SEQ ID NO: 19951 - DNA, 20 bp, Unknown
  RNA secondary structure sequence
cggggcgaccctgcagtggc

SEQ ID NO: 19952 - DNA, 20 bp, Unknown
  RNA secondary structure sequence
tcctgctcccccccacaccg

SEQ ID NO: 19953 - DNA, 20 bp, Unknown
  RNA secondary structure sequence
ttcgcctagcgcgtgctcag

SEQ ID NO: 19954 - DNA, 20 bp, Unknown
  RNA secondary structure sequence
gagcctggggaaactattat

SEQ ID NO: 19955 - DNA, 20 bp, Unknown
  RNA secondary structure sequence
accgatcccagggctgtggt

SEQ ID NO: 19956 - DNA, 20 bp, Unknown
  RNA secondary structure sequence
aacgtagagaaatcctttca

SEQ ID NO: 19957 - DNA, 20 bp, Unknown
  RNA secondary structure sequence
gtggggccgctgccggctcc

SEQ ID NO: 19958 - DNA, 20 bp, Unknown
  RNA secondary structure sequence
actgcctctgcctccaagct

SEQ ID NO: 19959 - DNA, 20 bp, Unknown
  RNA secondary structure sequence
tggtggccctcctggtggcc

SEQ ID NO: 19960 - DNA, 20 bp, Unknown
  RNA secondary structure sequence
cccgggagatcggggctggg

SEQ ID NO: 19961 - DNA, 20 bp, Unknown
  RNA secondary structure sequence
agaaaagcaggtggaaggag

SEQ ID NO: 19962 - DNA, 20 bp, Unknown
  RNA secondary structure sequence
aggaagcggatgccgtgggg

SEQ ID NO: 19963 - DNA, 20 bp, Unknown
  RNA secondary structure sequence
gtggacagctcacctagcgg

SEQ ID NO: 19964 - DNA, 20 bp, Unknown
  RNA secondary structure sequence
gcacgcaccgcgccaggcca

SEQ ID NO: 19965 - DNA, 20 bp, Unknown
  RNA secondary structure sequence
atccattccccctcagatct

SEQ ID NO: 19966 - DNA, 20 bp, Unknown
  RNA secondary structure sequence
gggcttggcgcggcggccag

SEQ ID NO: 19967 - DNA, 20 bp, Unknown
  RNA secondary structure sequence
tcccctccgggttttcacac

SEQ ID NO: 19968 - DNA, 20 bp, Unknown
  RNA secondary structure sequence
gagagcgtctaccccgaact

SEQ ID NO: 19969 - DNA, 20 bp, Unknown
  RNA secondary structure sequence
ccgccgccgccgccgcctcc

SEQ ID NO: 19970 - DNA, 20 bp, Unknown
  RNA secondary structure sequence
tcccgtctctccgtctcgac

SEQ ID NO: 19971 - DNA, 20 bp, Unknown
  RNA secondary structure sequence
ggcgccgcccgcctgctgcc

SEQ ID NO: 19972 - DNA, 20 bp, Unknown
  RNA secondary structure sequence
ggcagggaagctgagggccc

SEQ ID NO: 19973 - DNA, 20 bp, Unknown
  RNA secondary structure sequence
ctgggtgagtagccgggaac

SEQ ID NO: 19974 - DNA, 20 bp, Unknown
  RNA secondary structure sequence
agggccccaacccagaacga

SEQ ID NO: 19975 - DNA, 20 bp, Unknown
  RNA secondary structure sequence
attggaaatatgctacagat

SEQ ID NO: 19976 - DNA, 20 bp, Unknown
  RNA secondary structure sequence
gttttcaaaggagcattctt

SEQ ID NO: 19977 - DNA, 20 bp, Unknown
  RNA secondary structure sequence
ttcacctgtggattcgtcag

SEQ ID NO: 19978 - DNA, 20 bp, Unknown
  RNA secondary structure sequence
gattttggaagaaacgaatt

SEQ ID NO: 19979 - DNA, 20 bp, Unknown
  RNA secondary structure sequence
cacagagaatgctctgcacc

SEQ ID NO: 19980 - DNA, 20 bp, Unknown
  RNA secondary structure sequence
cgaagaaggtgagcgcagtg

SEQ ID NO: 19981 - DNA, 20 bp, Unknown
  RNA secondary structure sequence
gaggcgcagggaacctggag

SEQ ID NO: 19982 - DNA, 20 bp, Unknown
  RNA secondary structure sequence
catctcagtcctgacatcgc

SEQ ID NO: 19983 - DNA, 20 bp, Unknown
  RNA secondary structure sequence
acagagatcaatgcattttc

SEQ ID NO: 19984 - DNA, 20 bp, Unknown
  RNA secondary structure sequence
aggcactgcgggttttgcag

SEQ ID NO: 19985 - DNA, 20 bp, Unknown
  RNA secondary structure sequence
ccacatgcttccattgcttg

SEQ ID NO: 19986 - DNA, 20 bp, Unknown
  RNA secondary structure sequence
ctcccaggccgatacagtgc

SEQ ID NO: 19987 - DNA, 20 bp, Unknown
  RNA secondary structure sequence
ggttctccagcttcttgtcc

SEQ ID NO: 19988 - DNA, 20 bp, Unknown
  RNA secondary structure sequence
gtcgcgaggacttctaccgc

SEQ ID NO: 19989 - DNA, 20 bp, Unknown
  RNA secondary structure sequence
cacgtcgggagggtccgggc

SEQ ID NO: 19990 - DNA, 20 bp, Unknown
  RNA secondary structure sequence
gggtccccgagggcgctgcg

SEQ ID NO: 19991 - DNA, 20 bp, Unknown
  RNA secondary structure sequence
attccaagataaataggatt

SEQ ID NO: 19992 - DNA, 20 bp, Unknown
  RNA secondary structure sequence
caggctgccacacacgcact

SEQ ID NO: 19993 - DNA, 20 bp, Unknown
  RNA secondary structure sequence
gagccagagattcgagccgg

SEQ ID NO: 19994 - DNA, 20 bp, Unknown
  RNA secondary structure sequence
tacacgtggatgtgaaatga

SEQ ID NO: 19995 - DNA, 20 bp, Unknown
  RNA secondary structure sequence
aggagctccaggcccgtcgg

SEQ ID NO: 19996 - DNA, 20 bp, Unknown
  RNA secondary structure sequence
caccccctattttactgcag

SEQ ID NO: 19997 - DNA, 20 bp, Unknown
  RNA secondary structure sequence
gccccaactgctcttcccgc

SEQ ID NO: 19998 - DNA, 20 bp, Unknown
  RNA secondary structure sequence
gcccctcccacgagcccaag

SEQ ID NO: 19999 - DNA, 20 bp, Unknown
  RNA secondary structure sequence
agccagcagcagccggcggg

SEQ ID NO: 20000 - DNA, 20 bp, Unknown
  RNA secondary structure sequence
ggcagaagtacaagcgcagg

SEQ ID NO: 20001 - DNA, 20 bp, Unknown
  RNA secondary structure sequence
agtgaacaaaactttaatgt

SEQ ID NO: 20002 - DNA, 20 bp, Unknown
  RNA secondary structure sequence
taacctgctgcagttctgac

SEQ ID NO: 20003 - DNA, 20 bp, Unknown
  RNA secondary structure sequence
ccggtggcttcctcacctcc

SEQ ID NO: 20004 - DNA, 20 bp, Unknown
  RNA secondary structure sequence
atgagctgctccagtacatc

SEQ ID NO: 20005 - DNA, 20 bp, Unknown
  RNA secondary structure sequence
ttcttccggggttggtggcg

SEQ ID NO: 20006 - DNA, 20 bp, Unknown
  RNA secondary structure sequence
gacttcccttcccaaggact

SEQ ID NO: 20007 - DNA, 20 bp, Unknown
  RNA secondary structure sequence
gaactggggcctgggggatg

SEQ ID NO: 20008 - DNA, 20 bp, Unknown
  RNA secondary structure sequence
ggacgagcttgggcttagcg

SEQ ID NO: 20009 - DNA, 20 bp, Unknown
  RNA secondary structure sequence
aaagatggacaaacagagat

SEQ ID NO: 20010 - DNA, 20 bp, Unknown
  RNA secondary structure sequence
gctccagctgctttccaaaa

SEQ ID NO: 20011 - DNA, 20 bp, Unknown
  RNA secondary structure sequence
ctgcctggagtggagctgag

SEQ ID NO: 20012 - DNA, 20 bp, Unknown
  RNA secondary structure sequence
aggaaggaggaaacctggaa

SEQ ID NO: 20013 - DNA, 20 bp, Unknown
  RNA secondary structure sequence
agatgtggagccttgtcacc

SEQ ID NO: 20014 - DNA, 20 bp, Unknown
  RNA secondary structure sequence
ccgagacagctgcgcgggcg

SEQ ID NO: 20015 - DNA, 20 bp, Unknown
  RNA secondary structure sequence
aattctttctctgggtcatc

SEQ ID NO: 20016 - DNA, 20 bp, Unknown
  RNA secondary structure sequence
agaggggtgtcctgaaggtc

SEQ ID NO: 20017 - DNA, 20 bp, Unknown
  RNA secondary structure sequence
tccgagttgtcggaggaagg

SEQ ID NO: 20018 - DNA, 20 bp, Unknown
  RNA secondary structure sequence
gccagggcgcgcgtgcgcgg

SEQ ID NO: 20019 - DNA, 20 bp, Unknown
  RNA secondary structure sequence
ggccctcgccccctcctccc

SEQ ID NO: 20020 - DNA, 20 bp, Unknown
  RNA secondary structure sequence
tcgcatcgagcagtttccag

SEQ ID NO: 20021 - DNA, 20 bp, Unknown
  RNA secondary structure sequence
gcatccctaaaagcttcggc

SEQ ID NO: 20022 - DNA, 20 bp, Unknown
  RNA secondary structure sequence
atcagtcactcagccagggt

SEQ ID NO: 20023 - DNA, 20 bp, Unknown
  RNA secondary structure sequence
caagctgcgcgcccacgagc

SEQ ID NO: 20024 - DNA, 20 bp, Unknown
  RNA secondary structure sequence
ccggtgcacggcggctggcg

SEQ ID NO: 20025 - DNA, 20 bp, Unknown
  RNA secondary structure sequence
ggatggagctgaactttggg

SEQ ID NO: 20026 - DNA, 20 bp, Unknown
  RNA secondary structure sequence
caggattccttctggaactg

SEQ ID NO: 20027 - DNA, 20 bp, Unknown
  RNA secondary structure sequence
ctgccgccgccgaagctgga

SEQ ID NO: 20028 - DNA, 20 bp, Unknown
  RNA secondary structure sequence
aggctcgcgctctgcctgct

SEQ ID NO: 20029 - DNA, 20 bp, Unknown
  RNA secondary structure sequence
tatgaaaaggcctagtaagt

SEQ ID NO: 20030 - DNA, 20 bp, Unknown
  RNA secondary structure sequence
ggaaaggaacctcctccctg

SEQ ID NO: 20031 - DNA, 20 bp, Unknown
  RNA secondary structure sequence
aactcttgtttccaagctta

SEQ ID NO: 20032 - DNA, 20 bp, Unknown
  RNA secondary structure sequence
ggcagaattccttcctttag

SEQ ID NO: 20033 - DNA, 20 bp, Unknown
  RNA secondary structure sequence
aaacttggctcagcccactc

SEQ ID NO: 20034 - DNA, 20 bp, Unknown
  RNA secondary structure sequence
ggtctgtgatttcgaggcag

SEQ ID NO: 20035 - DNA, 20 bp, Unknown
  RNA secondary structure sequence
gaagcaagcaagcaaggaag

SEQ ID NO: 20036 - DNA, 20 bp, Unknown
  RNA secondary structure sequence
tgactattggtgttcctgtt

SEQ ID NO: 20037 - DNA, 20 bp, Unknown
  RNA secondary structure sequence
agcagccgctgtctccagtg

SEQ ID NO: 20038 - DNA, 20 bp, Unknown
  RNA secondary structure sequence
tggcatagtgagtttggagt

SEQ ID NO: 20039 - DNA, 20 bp, Unknown
  RNA secondary structure sequence
atttccgaagctcctgctca

SEQ ID NO: 20040 - DNA, 20 bp, Unknown
  RNA secondary structure sequence
ccagacttgaagccacacag

SEQ ID NO: 20041 - DNA, 20 bp, Unknown
  RNA secondary structure sequence
gagctgcctgacagtgacaa

SEQ ID NO: 20042 - DNA, 20 bp, Unknown
  RNA secondary structure sequence
tatgcctggataaggaggat

SEQ ID NO: 20043 - DNA, 20 bp, Unknown
  RNA secondary structure sequence
gctgagaagagggtgcagaa

SEQ ID NO: 20044 - DNA, 20 bp, Unknown
  RNA secondary structure sequence
gagaccgagccaaactcctg

SEQ ID NO: 20045 - DNA, 20 bp, Unknown
  RNA secondary structure sequence
acaatctctggacaaaattt

SEQ ID NO: 20046 - DNA, 20 bp, Unknown
  RNA secondary structure sequence
ccaattataccccgttggag

SEQ ID NO: 20047 - DNA, 20 bp, Unknown
  RNA secondary structure sequence
tcgctgggactcggaagtgc

SEQ ID NO: 20048 - DNA, 20 bp, Unknown
  RNA secondary structure sequence
gtgcgcacccactcgtaact

SEQ ID NO: 20049 - DNA, 20 bp, Unknown
  RNA secondary structure sequence
tgagagagggtcttagcagg

SEQ ID NO: 20050 - DNA, 20 bp, Unknown
  RNA secondary structure sequence
cgtcttgggtttggctccca

SEQ ID NO: 20051 - DNA, 20 bp, Unknown
  RNA secondary structure sequence
ttaaacgcgtagcattcctg

SEQ ID NO: 20052 - DNA, 20 bp, Unknown
  RNA secondary structure sequence
agtgctcccagtaaccttcc

SEQ ID NO: 20053 - DNA, 20 bp, Unknown
  RNA secondary structure sequence
ccgcggcgtggaggcaggga

SEQ ID NO: 20054 - DNA, 20 bp, Unknown
  RNA secondary structure sequence
tgggagggcggagggcgggg

SEQ ID NO: 20055 - DNA, 20 bp, Unknown
  RNA secondary structure sequence
aggagctggcctatcactac

SEQ ID NO: 20056 - DNA, 20 bp, Unknown
  RNA secondary structure sequence
cagataatgagaggaaatgc

SEQ ID NO: 20057 - DNA, 20 bp, Unknown
  RNA secondary structure sequence
gcatgcactgctgagcccga

SEQ ID NO: 20058 - DNA, 20 bp, Unknown
  RNA secondary structure sequence
ctctccgatgactttgccca

SEQ ID NO: 20059 - DNA, 20 bp, Unknown
  RNA secondary structure sequence
aggccctgccacccaccttc

SEQ ID NO: 20060 - DNA, 20 bp, Unknown
  RNA secondary structure sequence
cccatcccggctgcttttgc

SEQ ID NO: 20061 - DNA, 20 bp, Unknown
  RNA secondary structure sequence
cttcaagcccagcgagcatg

SEQ ID NO: 20062 - DNA, 20 bp, Unknown
  RNA secondary structure sequence
gccgaagcaggagccggcgg

SEQ ID NO: 20063 - DNA, 20 bp, Unknown
  RNA secondary structure sequence
tgtctgagcagtggaatgtg

SEQ ID NO: 20064 - DNA, 20 bp, Unknown
  RNA secondary structure sequence
atggaagaagttagctgtag

SEQ ID NO: 20065 - DNA, 20 bp, Unknown
  RNA secondary structure sequence
cagagctcagcttggtcccg

SEQ ID NO: 20066 - DNA, 20 bp, Unknown
  RNA secondary structure sequence
ggaggaggagccgccgccac

SEQ ID NO: 20067 - DNA, 20 bp, Unknown
  RNA secondary structure sequence
tcctcaaagcttctcgccat

SEQ ID NO: 20068 - DNA, 20 bp, Unknown
  RNA secondary structure sequence
ggctccgtccgctccctgga

SEQ ID NO: 20069 - DNA, 20 bp, Unknown
  RNA secondary structure sequence
tctttatatcctgacactat

SEQ ID NO: 20070 - DNA, 20 bp, Unknown
  RNA secondary structure sequence
ctttgcagcagatgtgtgac

SEQ ID NO: 20071 - DNA, 20 bp, Unknown
  RNA secondary structure sequence
cgctcccgtgcagacccgtg

SEQ ID NO: 20072 - DNA, 20 bp, Unknown
  RNA secondary structure sequence
agcggttattgagcattcgc

SEQ ID NO: 20073 - DNA, 20 bp, Unknown
  RNA secondary structure sequence
aagttctgagccccacaggt

SEQ ID NO: 20074 - DNA, 20 bp, Unknown
  RNA secondary structure sequence
atccccatagtgctgggtta

SEQ ID NO: 20075 - DNA, 20 bp, Unknown
  RNA secondary structure sequence
cccccacaggcagagctgac

SEQ ID NO: 20076 - DNA, 20 bp, Unknown
  RNA secondary structure sequence
cccacggaagccagttccaa

SEQ ID NO: 20077 - DNA, 20 bp, Unknown
  RNA secondary structure sequence
gttctctccatcgccttgtc

SEQ ID NO: 20078 - DNA, 20 bp, Unknown
  RNA secondary structure sequence
gcaaaaaaccgaatcttcag

SEQ ID NO: 20079 - DNA, 20 bp, Unknown
  RNA secondary structure sequence
acaagattattgatggcgcc

SEQ ID NO: 20080 - DNA, 20 bp, Unknown
  RNA secondary structure sequence
ccaggctggagtgcagtggt

SEQ ID NO: 20081 - DNA, 20 bp, Unknown
  RNA secondary structure sequence
tgcggggtgagaggccaggg

SEQ ID NO: 20082 - DNA, 20 bp, Unknown
  RNA secondary structure sequence
aggagggaggacagaggcca

SEQ ID NO: 20083 - DNA, 20 bp, Unknown
  RNA secondary structure sequence
aacaagtcaactaaggggtt

SEQ ID NO: 20084 - DNA, 20 bp, Unknown
  RNA secondary structure sequence
gtaggtttgctgtggaacgt

SEQ ID NO: 20085 - DNA, 20 bp, Unknown
  RNA secondary structure sequence
gtggcccagcctgctgagaa

SEQ ID NO: 20086 - DNA, 20 bp, Unknown
  RNA secondary structure sequence
acaggtgaaaattctggatc

SEQ ID NO: 20087 - DNA, 20 bp, Unknown
  RNA secondary structure sequence
ttcgtcagctgacaaagaca

SEQ ID NO: 20088 - DNA, 20 bp, Unknown
  RNA secondary structure sequence
ggaaggagacatcgaagcag

SEQ ID NO: 20089 - DNA, 20 bp, Unknown
  RNA secondary structure sequence
caggggacagggagagcaag

SEQ ID NO: 20090 - DNA, 20 bp, Unknown
  RNA secondary structure sequence
cacaggggcccccatgtagt

SEQ ID NO: 20091 - DNA, 20 bp, Unknown
  RNA secondary structure sequence
atccaggagtacaactcgaa

SEQ ID NO: 20092 - DNA, 20 bp, Unknown
  RNA secondary structure sequence
acctggaagagcggaagaag

SEQ ID NO: 20093 - DNA, 20 bp, Unknown
  RNA secondary structure sequence
actcctggcctcaagtgatc

SEQ ID NO: 20094 - DNA, 20 bp, Unknown
  RNA secondary structure sequence
ttggaagctggctcaagtac

SEQ ID NO: 20095 - DNA, 20 bp, Unknown
  RNA secondary structure sequence
tcaccacctgaaccacgggc

SEQ ID NO: 20096 - DNA, 20 bp, Unknown
  RNA secondary structure sequence
gccaggaggcgcctgagatt

SEQ ID NO: 20097 - DNA, 20 bp, Unknown
  RNA secondary structure sequence
atccagcacatgcacattga

SEQ ID NO: 20098 - DNA, 20 bp, Unknown
  RNA secondary structure sequence
tgctctcagccaaccgcctc

SEQ ID NO: 20099 - DNA, 20 bp, Unknown
  RNA secondary structure sequence
gccaggccacccgggactac

SEQ ID NO: 20100 - DNA, 20 bp, Unknown
  RNA secondary structure sequence
gaagaaaggtgcatggctgc

SEQ ID NO: 20101 - DNA, 20 bp, Unknown
  RNA secondary structure sequence
tgcaatcgcatctttgtaat

SEQ ID NO: 20102 - DNA, 20 bp, Unknown
  RNA secondary structure sequence
gagccaggagtccggggtcg

SEQ ID NO: 20103 - DNA, 20 bp, Unknown
  RNA secondary structure sequence
agaaaaggactctctggaac

SEQ ID NO: 20104 - DNA, 20 bp, Unknown
  RNA secondary structure sequence
gcggcggcggcatcagtcga

SEQ ID NO: 20105 - DNA, 20 bp, Unknown
  RNA secondary structure sequence
caggaggcttccgaccccac

SEQ ID NO: 20106 - DNA, 20 bp, Unknown
  RNA secondary structure sequence
cccaggctggagtgcagtgg

SEQ ID NO: 20107 - DNA, 20 bp, Unknown
  RNA secondary structure sequence
cctaggctggagtgcattgg

SEQ ID NO: 20108 - DNA, 20 bp, Unknown
  RNA secondary structure sequence
cgtcagtgcgcgctggcgca

SEQ ID NO: 20109 - DNA, 20 bp, Unknown
  RNA secondary structure sequence
cgcgcggcaggcgcggccat

SEQ ID NO: 20110 - DNA, 20 bp, Unknown
  RNA secondary structure sequence
gcaggccaggggcactgtga

SEQ ID NO: 20111 - DNA, 20 bp, Unknown
  RNA secondary structure sequence
ggggaccctcagccttgggg

SEQ ID NO: 20112 - DNA, 20 bp, Unknown
  RNA secondary structure sequence
tcctccttaccccgcctccc

SEQ ID NO: 20113 - DNA, 20 bp, Unknown
  RNA secondary structure sequence
gagaggcatgggcacgtggc

SEQ ID NO: 20114 - DNA, 20 bp, Unknown
  RNA secondary structure sequence
ggtggtgaggcaggctcgcc

SEQ ID NO: 20115 - DNA, 20 bp, Unknown
  RNA secondary structure sequence
cccgagcggcagccccaacc

SEQ ID NO: 20116 - DNA, 20 bp, Unknown
  RNA secondary structure sequence
ccgtcggccgcggtgaatcc

SEQ ID NO: 20117 - DNA, 20 bp, Unknown
  RNA secondary structure sequence
ctctggaggaagactggagc

SEQ ID NO: 20118 - DNA, 20 bp, Unknown
  RNA secondary structure sequence
gacagattgtccgggcaaac

SEQ ID NO: 20119 - DNA, 20 bp, Unknown
  RNA secondary structure sequence
agacacacacactcttggag

SEQ ID NO: 20120 - DNA, 20 bp, Unknown
  RNA secondary structure sequence
gaatcacatttcagcatgag

SEQ ID NO: 20121 - DNA, 20 bp, Unknown
  RNA secondary structure sequence
ggctggagcttccgggccct

SEQ ID NO: 20122 - DNA, 20 bp, Unknown
  RNA secondary structure sequence
tccatcgtgtgggaagaacg

SEQ ID NO: 20123 - DNA, 20 bp, Unknown
  RNA secondary structure sequence
cacccttctcccctcagaga

SEQ ID NO: 20124 - DNA, 20 bp, Unknown
  RNA secondary structure sequence
aagctcccggcgtctgcacc

SEQ ID NO: 20125 - DNA, 20 bp, Unknown
  RNA secondary structure sequence
gggggagggcgtcgcgggca

SEQ ID NO: 20126 - DNA, 20 bp, Unknown
  RNA secondary structure sequence
gggccgctggaccccgttgc

SEQ ID NO: 20127 - DNA, 20 bp, Unknown
  RNA secondary structure sequence
cccatctcgggcagaggctg

SEQ ID NO: 20128 - DNA, 20 bp, Unknown
  RNA secondary structure sequence
tgggctcagtaaggtcctcc

SEQ ID NO: 20129 - DNA, 20 bp, Unknown
  RNA secondary structure sequence
cgccgggcactgctgatgct

SEQ ID NO: 20130 - DNA, 20 bp, Unknown
  RNA secondary structure sequence
ataaagggggaagactttaa

SEQ ID NO: 20131 - DNA, 20 bp, Unknown
  RNA secondary structure sequence
tttaaaacagtttttgttaa

SEQ ID NO: 20132 - DNA, 20 bp, Unknown
  RNA secondary structure sequence
ccggttgtcttcctgtcggt

SEQ ID NO: 20133 - DNA, 20 bp, Unknown
  RNA secondary structure sequence
ctcatgtgccggcaccgggc

SEQ ID NO: 20134 - DNA, 20 bp, Unknown
  RNA secondary structure sequence
gttggctcgccgctctttgc

SEQ ID NO: 20135 - DNA, 20 bp, Unknown
  RNA secondary structure sequence
atcgatggacgcattcagaa

SEQ ID NO: 20136 - DNA, 20 bp, Unknown
  RNA secondary structure sequence
atccctccagagcattcaaa

SEQ ID NO: 20137 - DNA, 20 bp, Unknown
  RNA secondary structure sequence
tgagtggatgtgattggcga

SEQ ID NO: 20138 - DNA, 20 bp, Unknown
  RNA secondary structure sequence
aggcaccgtgatgtggagtc

SEQ ID NO: 20139 - DNA, 20 bp, Unknown
  RNA secondary structure sequence
cacggggctgcgtggaaaga

SEQ ID NO: 20140 - DNA, 20 bp, Unknown
  RNA secondary structure sequence
ctgggaggtctcctcccacc

SEQ ID NO: 20141 - DNA, 20 bp, Unknown
  RNA secondary structure sequence
gagtcctcgcgtgaaataag

SEQ ID NO: 20142 - DNA, 20 bp, Unknown
  RNA secondary structure sequence
gtaaattaccataaagcctc

SEQ ID NO: 20143 - DNA, 20 bp, Unknown
  RNA secondary structure sequence
ccatcctctgggtgaggagc

SEQ ID NO: 20144 - DNA, 20 bp, Unknown
  RNA secondary structure sequence
gcacggatgctgagcagaga

SEQ ID NO: 20145 - DNA, 20 bp, Unknown
  RNA secondary structure sequence
tcgttgtggctccttgggct

SEQ ID NO: 20146 - DNA, 20 bp, Unknown
  RNA secondary structure sequence
ccagggcctggagacccgtg

SEQ ID NO: 20147 - DNA, 20 bp, Unknown
  RNA secondary structure sequence
agagagattccctgctctcc

SEQ ID NO: 20148 - DNA, 20 bp, Unknown
  RNA secondary structure sequence
ggagctgcaaaagctgggga

SEQ ID NO: 20149 - DNA, 20 bp, Unknown
  RNA secondary structure sequence
gcctcatgcctctgacaacc

SEQ ID NO: 20150 - DNA, 20 bp, Unknown
  RNA secondary structure sequence
cgatcgcccagggccccgga

SEQ ID NO: 20151 - DNA, 20 bp, Unknown
  RNA secondary structure sequence
gcgagaagcagtcgggtttg

SEQ ID NO: 20152 - DNA, 20 bp, Unknown
  RNA secondary structure sequence
gctgcctctcccgtggtctg

SEQ ID NO: 20153 - DNA, 20 bp, Unknown
  RNA secondary structure sequence
cgtttcctgggtggctcccc

SEQ ID NO: 20154 - DNA, 20 bp, Unknown
  RNA secondary structure sequence
gtccacaatggaaggcttct

SEQ ID NO: 20155 - DNA, 20 bp, Unknown
  RNA secondary structure sequence
cggagagcgtagcgcggcct

SEQ ID NO: 20156 - DNA, 20 bp, Unknown
  RNA secondary structure sequence
gatgtaaatggaccaaaagt

SEQ ID NO: 20157 - DNA, 20 bp, Unknown
  RNA secondary structure sequence
acccaggcttcacacatttg

SEQ ID NO: 20158 - DNA, 20 bp, Unknown
  RNA secondary structure sequence
aacttgacaactttcctttc

SEQ ID NO: 20159 - DNA, 20 bp, Unknown
  RNA secondary structure sequence
ggggaccatgcagcggagcc

SEQ ID NO: 20160 - DNA, 20 bp, Unknown
  RNA secondary structure sequence
tcaccaacagatgaagacag

SEQ ID NO: 20161 - DNA, 20 bp, Unknown
  RNA secondary structure sequence
ctgcctttctcctcccgttg

SEQ ID NO: 20162 - DNA, 20 bp, Unknown
  RNA secondary structure sequence
tatgtaagaaggatggggca

SEQ ID NO: 20163 - DNA, 20 bp, Unknown
  RNA secondary structure sequence
ggcaagggtccacccagcca

SEQ ID NO: 20164 - DNA, 20 bp, Unknown
  RNA secondary structure sequence
aactccaattgctccagttc

SEQ ID NO: 20165 - DNA, 20 bp, Unknown
  RNA secondary structure sequence
gaagtaaaatagaaagaaga

SEQ ID NO: 20166 - DNA, 20 bp, Unknown
  RNA secondary structure sequence
tgctgcccttctgaggcctg

SEQ ID NO: 20167 - DNA, 20 bp, Unknown
  RNA secondary structure sequence
cggggccggaagacaggtgc

SEQ ID NO: 20168 - DNA, 20 bp, Unknown
  RNA secondary structure sequence
ccgcccccagacacgccggg

SEQ ID NO: 20169 - DNA, 20 bp, Unknown
  RNA secondary structure sequence
ggcggcgatggcggtcgggg

SEQ ID NO: 20170 - DNA, 20 bp, Unknown
  RNA secondary structure sequence
tcgccgtcttccagcgcaag

SEQ ID NO: 20171 - DNA, 20 bp, Unknown
  RNA secondary structure sequence
actgggcaaggcggtggtgg

SEQ ID NO: 20172 - DNA, 20 bp, Unknown
  RNA secondary structure sequence
acccgagttacctgtagtca

SEQ ID NO: 20173 - DNA, 20 bp, Unknown
  RNA secondary structure sequence
taaagaagcagccccgccct

SEQ ID NO: 20174 - DNA, 20 bp, Unknown
  RNA secondary structure sequence
gccccaactgcaccatccct

SEQ ID NO: 20175 - DNA, 20 bp, Unknown
  RNA secondary structure sequence
agggtccccgtggccccgag

SEQ ID NO: 20176 - DNA, 20 bp, Unknown
  RNA secondary structure sequence
acaaaagaaagaacgtcttc

SEQ ID NO: 20177 - DNA, 20 bp, Unknown
  RNA secondary structure sequence
ggcctgacctcagttgttcc

SEQ ID NO: 20178 - DNA, 20 bp, Unknown
  RNA secondary structure sequence
cgggaccgggggggatagat

SEQ ID NO: 20179 - DNA, 20 bp, Unknown
  RNA secondary structure sequence
tcacttctcgccggagtgtg

SEQ ID NO: 20180 - DNA, 20 bp, Unknown
  RNA secondary structure sequence
ttgggccctctgctcctctg

SEQ ID NO: 20181 - DNA, 20 bp, Unknown
  RNA secondary structure sequence
tgcccgggtcaccagtcggg

SEQ ID NO: 20182 - DNA, 20 bp, Unknown
  RNA secondary structure sequence
tgggctgggaacccgcggtg

SEQ ID NO: 20183 - DNA, 20 bp, Unknown
  RNA secondary structure sequence
tggctcggagactcctgcct

SEQ ID NO: 20184 - DNA, 20 bp, Unknown
  RNA secondary structure sequence
gtgcttccactgataacata

SEQ ID NO: 20185 - DNA, 20 bp, Unknown
  RNA secondary structure sequence
attacaggcctttgagccca

SEQ ID NO: 20186 - DNA, 20 bp, Unknown
  RNA secondary structure sequence
ctgttgctttgtaaaaatgc

SEQ ID NO: 20187 - DNA, 20 bp, Unknown
  RNA secondary structure sequence
gaactgcccagggaccatcc

SEQ ID NO: 20188 - DNA, 20 bp, Unknown
  RNA secondary structure sequence
cgctcttgttgcccaggctg

SEQ ID NO: 20189 - DNA, 20 bp, Unknown
  RNA secondary structure sequence
ccggcgactgcagcttcccc

SEQ ID NO: 20190 - DNA, 20 bp, Unknown
  RNA secondary structure sequence
ggagtttcttggtcacagga

SEQ ID NO: 20191 - DNA, 20 bp, Unknown
  RNA secondary structure sequence
ccaaggtggagaaaccagga

SEQ ID NO: 20192 - DNA, 20 bp, Unknown
  RNA secondary structure sequence
ggaatggccaaatatcaaga

SEQ ID NO: 20193 - DNA, 20 bp, Unknown
  RNA secondary structure sequence
ggtttctttcactacttatc

SEQ ID NO: 20194 - DNA, 20 bp, Unknown
  RNA secondary structure sequence
aggggtgaggcggtgtctcc

SEQ ID NO: 20195 - DNA, 20 bp, Unknown
  RNA secondary structure sequence
agaacactaccgttcaagag

SEQ ID NO: 20196 - DNA, 20 bp, Unknown
  RNA secondary structure sequence
tgtcccatgacgctctggga

SEQ ID NO: 20197 - DNA, 20 bp, Unknown
  RNA secondary structure sequence
tttccttaccaatcggctgc

SEQ ID NO: 20198 - DNA, 20 bp, Unknown
  RNA secondary structure sequence
cgtccgttccctaagcagac

SEQ ID NO: 20199 - DNA, 20 bp, Unknown
  RNA secondary structure sequence
ggctagtgcaaggatcagat

SEQ ID NO: 20200 - DNA, 20 bp, Unknown
  RNA secondary structure sequence
aacctggatctggagccggg

SEQ ID NO: 20201 - DNA, 20 bp, Unknown
  RNA secondary structure sequence
ccaggccccgcagcccatgg

SEQ ID NO: 20202 - DNA, 20 bp, Unknown
  RNA secondary structure sequence
cccggagcctctccctgggc

SEQ ID NO: 20203 - DNA, 20 bp, Unknown
  RNA secondary structure sequence
gtgggtcgctgatttcttgg

SEQ ID NO: 20204 - DNA, 20 bp, Unknown
  RNA secondary structure sequence
ctgcaccctccacctcccgc

SEQ ID NO: 20205 - DNA, 20 bp, Unknown
  RNA secondary structure sequence
gtacggcttgcggcttaagc

SEQ ID NO: 20206 - DNA, 20 bp, Unknown
  RNA secondary structure sequence
catgtctgtgttctggctcc

SEQ ID NO: 20207 - DNA, 20 bp, Unknown
  RNA secondary structure sequence
cctgcatcctcctctgctca

SEQ ID NO: 20208 - DNA, 20 bp, Unknown
  RNA secondary structure sequence
atggcggcgctggcagcagc

SEQ ID NO: 20209 - DNA, 20 bp, Unknown
  RNA secondary structure sequence
ttccctcaccaggaacccag

SEQ ID NO: 20210 - DNA, 20 bp, Unknown
  RNA secondary structure sequence
atgagatgaagtgagtttcc

SEQ ID NO: 20211 - DNA, 20 bp, Unknown
  RNA secondary structure sequence
catcttcacctccacaatcg

SEQ ID NO: 20212 - DNA, 20 bp, Unknown
  RNA secondary structure sequence
agtcgggggagtcgtaaaca

SEQ ID NO: 20213 - DNA, 20 bp, Unknown
  RNA secondary structure sequence
gaggaggtgagcgccaggtc

SEQ ID NO: 20214 - DNA, 20 bp, Unknown
  RNA secondary structure sequence
acaaccaccgccacctccta

SEQ ID NO: 20215 - DNA, 20 bp, Unknown
  RNA secondary structure sequence
agagttcagagagggggtgt

SEQ ID NO: 20216 - DNA, 20 bp, Unknown
  RNA secondary structure sequence
tcttgctgagcacattgaaa

SEQ ID NO: 20217 - DNA, 20 bp, Unknown
  RNA secondary structure sequence
gcggccctgcgcccccagcc

SEQ ID NO: 20218 - DNA, 20 bp, Unknown
  RNA secondary structure sequence
ctctggctacactgaaaggc

SEQ ID NO: 20219 - DNA, 20 bp, Unknown
  RNA secondary structure sequence
gaagataaatgttactcctc

SEQ ID NO: 20220 - DNA, 20 bp, Unknown
  RNA secondary structure sequence
cgcgatgggcctcttggaac

SEQ ID NO: 20221 - DNA, 20 bp, Unknown
  RNA secondary structure sequence
cccgccgatcaggttccttt

SEQ ID NO: 20222 - DNA, 20 bp, Unknown
  RNA secondary structure sequence
acggaggcttcgcgggaaga

SEQ ID NO: 20223 - DNA, 20 bp, Unknown
  RNA secondary structure sequence
ctctctctgccaccatttcg

SEQ ID NO: 20224 - DNA, 20 bp, Unknown
  RNA secondary structure sequence
tagggcgtggtgcttgctcc

SEQ ID NO: 20225 - DNA, 20 bp, Unknown
  RNA secondary structure sequence
tcattatacctctttatcca

SEQ ID NO: 20226 - DNA, 20 bp, Unknown
  RNA secondary structure sequence
gctgaactccctgaggtctc

SEQ ID NO: 20227 - DNA, 20 bp, Unknown
  RNA secondary structure sequence
agatccacttcttcctagcc

SEQ ID NO: 20228 - DNA, 20 bp, Unknown
  RNA secondary structure sequence
ccgttgcccggccctctccc

SEQ ID NO: 20229 - DNA, 20 bp, Unknown
  RNA secondary structure sequence
tccgccgcccgccccgaccc

SEQ ID NO: 20230 - DNA, 20 bp, Unknown
  RNA secondary structure sequence
cagggcaagctccccgtctc

SEQ ID NO: 20231 - DNA, 20 bp, Unknown
  RNA secondary structure sequence
tggccgctgcacaagaacct

SEQ ID NO: 20232 - DNA, 20 bp, Unknown
  RNA secondary structure sequence
aggcattgaggaactcaatc

SEQ ID NO: 20233 - DNA, 20 bp, Unknown
  RNA secondary structure sequence
aaatcgatcctcctaccttg

SEQ ID NO: 20234 - DNA, 20 bp, Unknown
  RNA secondary structure sequence
tcttgcttcaggaaggtgaa

SEQ ID NO: 20235 - DNA, 20 bp, Unknown
  RNA secondary structure sequence
ccttgggaacatgggagagg

SEQ ID NO: 20236 - DNA, 20 bp, Unknown
  RNA secondary structure sequence
aaaaaaaaggattcaatagt

SEQ ID NO: 20237 - DNA, 20 bp, Unknown
  RNA secondary structure sequence
tgtaagtaaaccagagcgaa

SEQ ID NO: 20238 - DNA, 20 bp, Unknown
  RNA secondary structure sequence
acgcggtggcttagacgcgc

SEQ ID NO: 20239 - DNA, 20 bp, Unknown
  RNA secondary structure sequence
atcactcctgaagatcttct

SEQ ID NO: 20240 - DNA, 20 bp, Unknown
  RNA secondary structure sequence
ccgtgtatgcctcccacaag

SEQ ID NO: 20241 - DNA, 20 bp, Unknown
  RNA secondary structure sequence
ccctcagagtgctcccttca

SEQ ID NO: 20242 - DNA, 20 bp, Unknown
  RNA secondary structure sequence
ccctttgcccatccttcctt

SEQ ID NO: 20243 - DNA, 20 bp, Unknown
  RNA secondary structure sequence
cattttcaatagaaacgaag

SEQ ID NO: 20244 - DNA, 20 bp, Unknown
  RNA secondary structure sequence
ggctggaatatagtggcaca

SEQ ID NO: 20245 - DNA, 20 bp, Unknown
  RNA secondary structure sequence
cactaagccgtagcggcagc

SEQ ID NO: 20246 - DNA, 20 bp, Unknown
  RNA secondary structure sequence
gtccctgcagacggcttccc

SEQ ID NO: 20247 - DNA, 20 bp, Unknown
  RNA secondary structure sequence
atagaaggcagaacaacaac

SEQ ID NO: 20248 - DNA, 20 bp, Unknown
  RNA secondary structure sequence
tgaggagctgtccgtgtgca

SEQ ID NO: 20249 - DNA, 20 bp, Unknown
  RNA secondary structure sequence
caaggctcccaccccgcctg

SEQ ID NO: 20250 - DNA, 20 bp, Unknown
  RNA secondary structure sequence
tcaagaaccagggtctgtca

SEQ ID NO: 20251 - DNA, 20 bp, Unknown
  RNA secondary structure sequence
tcagcctgcagacagcctat

SEQ ID NO: 20252 - DNA, 20 bp, Unknown
  RNA secondary structure sequence
gaccgcagtcgagtctgcag

SEQ ID NO: 20253 - DNA, 20 bp, Unknown
  RNA secondary structure sequence
tacagattgtggagagctgc

SEQ ID NO: 20254 - DNA, 20 bp, Unknown
  RNA secondary structure sequence
ggaggaaaggaaaagacaga

SEQ ID NO: 20255 - DNA, 20 bp, Unknown
  RNA secondary structure sequence
cgggaagggcgcggggcgga

SEQ ID NO: 20256 - DNA, 20 bp, Unknown
  RNA secondary structure sequence
acggccctgctcatcacatg

SEQ ID NO: 20257 - DNA, 20 bp, Unknown
  RNA secondary structure sequence
ggtctgaagacggatggagt

SEQ ID NO: 20258 - DNA, 20 bp, Unknown
  RNA secondary structure sequence
ttaagtgtatcgagctgata

SEQ ID NO: 20259 - DNA, 20 bp, Unknown
  RNA secondary structure sequence
gacgcgagcgcggggcgggt

SEQ ID NO: 20260 - DNA, 20 bp, Unknown
  RNA secondary structure sequence
cctaggagtgctacgggggg

SEQ ID NO: 20261 - DNA, 20 bp, Unknown
  RNA secondary structure sequence
cggagcccaggccgggagca

SEQ ID NO: 20262 - DNA, 20 bp, Unknown
  RNA secondary structure sequence
cctggcttccctgcgctgca

SEQ ID NO: 20263 - DNA, 20 bp, Unknown
  RNA secondary structure sequence
tcaatgacaggagccagcct

SEQ ID NO: 20264 - DNA, 20 bp, Unknown
  RNA secondary structure sequence
tgcggagcctctcccgctcg

SEQ ID NO: 20265 - DNA, 20 bp, Unknown
  RNA secondary structure sequence
tgtccttccgaacgcacact

SEQ ID NO: 20266 - DNA, 20 bp, Unknown
  RNA secondary structure sequence
cctctgaggttttccattta

SEQ ID NO: 20267 - DNA, 20 bp, Unknown
  RNA secondary structure sequence
gcctgaaaggcagctctcag

SEQ ID NO: 20268 - DNA, 20 bp, Unknown
  RNA secondary structure sequence
gtagagatgacttctacccg

SEQ ID NO: 20269 - DNA, 20 bp, Unknown
  RNA secondary structure sequence
accgtccctgtgttccccac

SEQ ID NO: 20270 - DNA, 20 bp, Unknown
  RNA secondary structure sequence
cccagctgggaggctgtggc

SEQ ID NO: 20271 - DNA, 20 bp, Unknown
  RNA secondary structure sequence
gagtgttgttctacctgcgc

SEQ ID NO: 20272 - DNA, 20 bp, Unknown
  RNA secondary structure sequence
cggctggcaagaagaggatg

SEQ ID NO: 20273 - DNA, 20 bp, Unknown
  RNA secondary structure sequence
agctcttctgcctggaacac

SEQ ID NO: 20274 - DNA, 20 bp, Unknown
  RNA secondary structure sequence
atggcatcgaccccagcggc

SEQ ID NO: 20275 - DNA, 20 bp, Unknown
  RNA secondary structure sequence
cagagttggaggtggtggcg

SEQ ID NO: 20276 - DNA, 20 bp, Unknown
  RNA secondary structure sequence
cctcaaactagccaatgaga

SEQ ID NO: 20277 - DNA, 20 bp, Unknown
  RNA secondary structure sequence
cgacgctcctcgggaagcca

SEQ ID NO: 20278 - DNA, 20 bp, Unknown
  RNA secondary structure sequence
cagaaaacagctgaaacgga

SEQ ID NO: 20279 - DNA, 20 bp, Unknown
  RNA secondary structure sequence
cccacccaccgcccccactg

SEQ ID NO: 20280 - DNA, 20 bp, Unknown
  RNA secondary structure sequence
atccagaggagtggaaggct

SEQ ID NO: 20281 - DNA, 20 bp, Unknown
  RNA secondary structure sequence
gctgttgtttccagcaagac

SEQ ID NO: 20282 - DNA, 20 bp, Unknown
  RNA secondary structure sequence
acacatttcctgaaggagtt

SEQ ID NO: 20283 - DNA, 20 bp, Unknown
  RNA secondary structure sequence
taggagggagcccgccgggg

SEQ ID NO: 20284 - DNA, 20 bp, Unknown
  RNA secondary structure sequence
ctcggaagggtctttgttcc

SEQ ID NO: 20285 - DNA, 20 bp, Unknown
  RNA secondary structure sequence
aggaggagaagcggcggcgc

SEQ ID NO: 20286 - DNA, 20 bp, Unknown
  RNA secondary structure sequence
ggggccggcggtggcggagc

SEQ ID NO: 20287 - DNA, 20 bp, Unknown
  RNA secondary structure sequence
tgttttcttgcataaaattc

SEQ ID NO: 20288 - DNA, 20 bp, Unknown
  RNA secondary structure sequence
tggtttcatagccttctccc

SEQ ID NO: 20289 - DNA, 20 bp, Unknown
  RNA secondary structure sequence
ccgacgaggagctgaaccag

SEQ ID NO: 20290 - DNA, 20 bp, Unknown
  RNA secondary structure sequence
ctgctaatgagacttgttga

SEQ ID NO: 20291 - DNA, 20 bp, Unknown
  RNA secondary structure sequence
cggcggcggcggcggtggag

SEQ ID NO: 20292 - DNA, 20 bp, Unknown
  RNA secondary structure sequence
cgcctgcacgtacgtagcct

SEQ ID NO: 20293 - DNA, 20 bp, Unknown
  RNA secondary structure sequence
tgaaccagttattaggggcg

SEQ ID NO: 20294 - DNA, 20 bp, Unknown
  RNA secondary structure sequence
accgggagatccagaagtga

SEQ ID NO: 20295 - DNA, 20 bp, Unknown
  RNA secondary structure sequence
ctcctggtctgcaacctctc

SEQ ID NO: 20296 - DNA, 20 bp, Unknown
  RNA secondary structure sequence
atttggacacacagagagat

SEQ ID NO: 20297 - DNA, 20 bp, Unknown
  RNA secondary structure sequence
gctagggagtgggactggca

SEQ ID NO: 20298 - DNA, 20 bp, Unknown
  RNA secondary structure sequence
gggtccagagagagggtcta

SEQ ID NO: 20299 - DNA, 20 bp, Unknown
  RNA secondary structure sequence
ttgacaaactgctgacagct

SEQ ID NO: 20300 - DNA, 20 bp, Unknown
  RNA secondary structure sequence
cccagtgctccataaaggat

SEQ ID NO: 20301 - DNA, 20 bp, Unknown
  RNA secondary structure sequence
ccatgtgttgctgagagatg

SEQ ID NO: 20302 - DNA, 20 bp, Unknown
  RNA secondary structure sequence
catgagttgctcctgacggc

SEQ ID NO: 20303 - DNA, 20 bp, Unknown
  RNA secondary structure sequence
caggaattcgaacgtttcgt

SEQ ID NO: 20304 - DNA, 20 bp, Unknown
  RNA secondary structure sequence
acgacatacaagatttttgc

SEQ ID NO: 20305 - DNA, 20 bp, Unknown
  RNA secondary structure sequence
agagaaaatttatgacattg

SEQ ID NO: 20306 - DNA, 20 bp, Unknown
  RNA secondary structure sequence
tcacggaggaggagaggaaa

SEQ ID NO: 20307 - DNA, 20 bp, Unknown
  RNA secondary structure sequence
tctacaagtccatctttgtc

SEQ ID NO: 20308 - DNA, 20 bp, Unknown
  RNA secondary structure sequence
gcaatgcctctccttgtttg

SEQ ID NO: 20309 - DNA, 20 bp, Unknown
  RNA secondary structure sequence
gcaaatgaaggggaaacaac

SEQ ID NO: 20310 - DNA, 20 bp, Unknown
  RNA secondary structure sequence
gtatgttgagtctaaaaagg

SEQ ID NO: 20311 - DNA, 20 bp, Unknown
  RNA secondary structure sequence
tggacaaaacaggacatgtt

SEQ ID NO: 20312 - DNA, 20 bp, Unknown
  RNA secondary structure sequence
gcagaggaagacaagaagaa

SEQ ID NO: 20313 - DNA, 20 bp, Unknown
  RNA secondary structure sequence
gagaaagaaagatctatgct

SEQ ID NO: 20314 - DNA, 20 bp, Unknown
  RNA secondary structure sequence
agccacgctattcaaagaca

SEQ ID NO: 20315 - DNA, 20 bp, Unknown
  RNA secondary structure sequence
agaacaatcaacctgtggag

SEQ ID NO: 20316 - DNA, 20 bp, Unknown
  RNA secondary structure sequence
agatctggacgatatgattg

SEQ ID NO: 20317 - DNA, 20 bp, Unknown
  RNA secondary structure sequence
aggaagaaagagggaagaca

SEQ ID NO: 20318 - DNA, 20 bp, Unknown
  RNA secondary structure sequence
gcctacatttaaaactgcaa

SEQ ID NO: 20319 - DNA, 20 bp, Unknown
  RNA secondary structure sequence
attgctggaaatcatcacca

SEQ ID NO: 20320 - DNA, 20 bp, Unknown
  RNA secondary structure sequence
ggtagcataaaaaaacaata

SEQ ID NO: 20321 - DNA, 20 bp, Unknown
  RNA secondary structure sequence
acgtggatagaatcacctaa

SEQ ID NO: 20322 - DNA, 20 bp, Unknown
  RNA secondary structure sequence
caaattcctccggaaacagg

SEQ ID NO: 20323 - DNA, 20 bp, Unknown
  RNA secondary structure sequence
gcagctggggccggacctgg

SEQ ID NO: 20324 - DNA, 20 bp, Unknown
  RNA secondary structure sequence
cgctgcgcaacagcatcgga

SEQ ID NO: 20325 - DNA, 20 bp, Unknown
  RNA secondary structure sequence
actgggtgcgcgactcggtt

SEQ ID NO: 20326 - DNA, 20 bp, Unknown
  RNA secondary structure sequence
gtcgccgccagaggagctgc

SEQ ID NO: 20327 - DNA, 20 bp, Unknown
  RNA secondary structure sequence
tgtggtgagctgtttgattc

SEQ ID NO: 20328 - DNA, 20 bp, Unknown
  RNA secondary structure sequence
gcgacggcgacggggacgac

SEQ ID NO: 20329 - DNA, 20 bp, Unknown
  RNA secondary structure sequence
cctcttcccgactggccatt

SEQ ID NO: 20330 - DNA, 20 bp, Unknown
  RNA secondary structure sequence
caacaaagcccgccaagagt

SEQ ID NO: 20331 - DNA, 20 bp, Unknown
  RNA secondary structure sequence
ttcccaactttgacgcggtg

SEQ ID NO: 20332 - DNA, 20 bp, Unknown
  RNA secondary structure sequence
gtttgtacctattgtcagct

SEQ ID NO: 20333 - DNA, 20 bp, Unknown
  RNA secondary structure sequence
gggatatgctccaggcgggc

SEQ ID NO: 20334 - DNA, 20 bp, Unknown
  RNA secondary structure sequence
atctgcagcctcgtcactgt

SEQ ID NO: 20335 - DNA, 20 bp, Unknown
  RNA secondary structure sequence
agatgccatgaaccacccta

SEQ ID NO: 20336 - DNA, 20 bp, Unknown
  RNA secondary structure sequence
gcgctggtccgtgcagacct

SEQ ID NO: 20337 - DNA, 20 bp, Unknown
  RNA secondary structure sequence
tacggtcacgccggcatggc

SEQ ID NO: 20338 - DNA, 20 bp, Unknown
  RNA secondary structure sequence
cgagtggtgttttttaatag

SEQ ID NO: 20339 - DNA, 20 bp, Unknown
  RNA secondary structure sequence
cgcgagccttcgtctcagag

SEQ ID NO: 20340 - DNA, 20 bp, Unknown
  RNA secondary structure sequence
acggggacacggacagcctt

SEQ ID NO: 20341 - DNA, 20 bp, Unknown
  RNA secondary structure sequence
gcgagtagagttttctcctc

SEQ ID NO: 20342 - DNA, 20 bp, Unknown
  RNA secondary structure sequence
aacgccacaacataaagaag

SEQ ID NO: 20343 - DNA, 20 bp, Unknown
  RNA secondary structure sequence
ggggttggggttattctctg

SEQ ID NO: 20344 - DNA, 20 bp, Unknown
  RNA secondary structure sequence
atttgcatttattgtcagct

SEQ ID NO: 20345 - DNA, 20 bp, Unknown
  RNA secondary structure sequence
ccacccaactttccccgcgc

SEQ ID NO: 20346 - DNA, 20 bp, Unknown
  RNA secondary structure sequence
cctcctgttcctgtccatcc

SEQ ID NO: 20347 - DNA, 20 bp, Unknown
  RNA secondary structure sequence
tgtgcaacatcttacaaatg

SEQ ID NO: 20348 - DNA, 20 bp, Unknown
  RNA secondary structure sequence
tcttcattttgaggttttgg

SEQ ID NO: 20349 - DNA, 20 bp, Unknown
  RNA secondary structure sequence
ttacgtcattttttagtcct

SEQ ID NO: 20350 - DNA, 20 bp, Unknown
  RNA secondary structure sequence
ggggtcttatgtagttttgt

SEQ ID NO: 20351 - DNA, 20 bp, Unknown
  RNA secondary structure sequence
tatgatctggaattggaaga

SEQ ID NO: 20352 - DNA, 20 bp, Unknown
  RNA secondary structure sequence
gcaacccgttcgctcatctg

SEQ ID NO: 20353 - DNA, 20 bp, Unknown
  RNA secondary structure sequence
gcgaccgagcgtgcgttcgt

SEQ ID NO: 20354 - DNA, 20 bp, Unknown
  RNA secondary structure sequence
tagtcgcgccgcgcgttctt

SEQ ID NO: 20355 - DNA, 20 bp, Unknown
  RNA secondary structure sequence
gtgtttatttaatgtgacgt

SEQ ID NO: 20356 - DNA, 20 bp, Unknown
  RNA secondary structure sequence
cagcaaattgactcccgccg

SEQ ID NO: 20357 - DNA, 20 bp, Unknown
  RNA secondary structure sequence
agaatggactctgacgctcc

SEQ ID NO: 20358 - DNA, 20 bp, Unknown
  RNA secondary structure sequence
agaggagaaaggaagaggtc

SEQ ID NO: 20359 - DNA, 20 bp, Unknown
  RNA secondary structure sequence
ctgcggtctggccttggaag

SEQ ID NO: 20360 - DNA, 20 bp, Unknown
  RNA secondary structure sequence
ggaactctccagttcgtgga

SEQ ID NO: 20361 - DNA, 20 bp, Unknown
  RNA secondary structure sequence
agtgcggattaccatcgaag

SEQ ID NO: 20362 - DNA, 20 bp, Unknown
  RNA secondary structure sequence
aaagagaaaatgccttaacc

SEQ ID NO: 20363 - DNA, 20 bp, Unknown
  RNA secondary structure sequence
tctaagatcttttttttttt

SEQ ID NO: 20364 - DNA, 20 bp, Unknown
  RNA secondary structure sequence
gtgtagcatagtctgcctgg

SEQ ID NO: 20365 - DNA, 20 bp, Unknown
  RNA secondary structure sequence
ataccgcaatcaaaatgttg

SEQ ID NO: 20366 - DNA, 20 bp, Unknown
  RNA secondary structure sequence
cagcacctcacttccctctt

SEQ ID NO: 20367 - DNA, 20 bp, Unknown
  RNA secondary structure sequence
aagcagtttggtgataatat

SEQ ID NO: 20368 - DNA, 20 bp, Unknown
  RNA secondary structure sequence
aggttttacgagggtcgagc

SEQ ID NO: 20369 - DNA, 20 bp, Unknown
  RNA secondary structure sequence
tggagcggagttcggttcca

SEQ ID NO: 20370 - DNA, 20 bp, Unknown
  RNA secondary structure sequence
gcctgttgctgcatcacgct

SEQ ID NO: 20371 - DNA, 20 bp, Unknown
  RNA secondary structure sequence
gtactagacacagataacaa

SEQ ID NO: 20372 - DNA, 20 bp, Unknown
  RNA secondary structure sequence
tcctgtgtttttacgtaggt

SEQ ID NO: 20373 - DNA, 20 bp, Unknown
  RNA secondary structure sequence
agaagagttttctccttcgc

SEQ ID NO: 20374 - DNA, 20 bp, Unknown
  RNA secondary structure sequence
aataggtgaccggaggtcgg

SEQ ID NO: 20375 - DNA, 20 bp, Unknown
  RNA secondary structure sequence
gatagggtccttgcgagggg

SEQ ID NO: 20376 - DNA, 20 bp, Unknown
  RNA secondary structure sequence
aaagaggttaaaacattaca

SEQ ID NO: 20377 - DNA, 20 bp, Unknown
  RNA secondary structure sequence
cgcctccgggtaagggacgc

SEQ ID NO: 20378 - DNA, 20 bp, Unknown
  RNA secondary structure sequence
aactcgtaagcggggcaacc

SEQ ID NO: 20379 - DNA, 20 bp, Unknown
  RNA secondary structure sequence
tggatccaccactctcgact

SEQ ID NO: 20380 - DNA, 20 bp, Unknown
  RNA secondary structure sequence
ccagtgtcttccgtttgtac

SEQ ID NO: 20381 - DNA, 20 bp, Unknown
  RNA secondary structure sequence
gaaagtggtgaaccgaaaac

SEQ ID NO: 20382 - DNA, 20 bp, Unknown
  RNA secondary structure sequence
ggaagggcaagttaattgta

SEQ ID NO: 20383 - DNA, 20 bp, Unknown
  RNA secondary structure sequence
acaggttttcccatttcctt

SEQ ID NO: 20384 - DNA, 20 bp, Unknown
  RNA secondary structure sequence
ttttgttgtcagtgtaagtc

SEQ ID NO: 20385 - DNA, 20 bp, Unknown
  RNA secondary structure sequence
ctccttaacttattgaaatt

SEQ ID NO: 20386 - DNA, 20 bp, Unknown
  RNA secondary structure sequence
aagaatgccctggaggcaag

SEQ ID NO: 20387 - DNA, 20 bp, Unknown
  RNA secondary structure sequence
cagcagcaggaacgcgggag

SEQ ID NO: 20388 - DNA, 20 bp, Unknown
  RNA secondary structure sequence
atttacatttccaaatccat

SEQ ID NO: 20389 - DNA, 20 bp, Unknown
  RNA secondary structure sequence
tttcctgccttttatataca

SEQ ID NO: 20390 - DNA, 20 bp, Unknown
  RNA secondary structure sequence
gggaacaccctttagtcctg

SEQ ID NO: 20391 - DNA, 20 bp, Unknown
  RNA secondary structure sequence
tgttgctgtggatgtgacag

SEQ ID NO: 20392 - DNA, 20 bp, Unknown
  RNA secondary structure sequence
ctgaggtactcaggggcatt

SEQ ID NO: 20393 - DNA, 20 bp, Unknown
  RNA secondary structure sequence
tactcaggggcatttaggtt

SEQ ID NO: 20394 - DNA, 20 bp, Unknown
  RNA secondary structure sequence
cgggccgaggtaccaaaggc

SEQ ID NO: 20395 - DNA, 20 bp, Unknown
  RNA secondary structure sequence
attggccagacaaggggagg

SEQ ID NO: 20396 - DNA, 20 bp, Unknown
  RNA secondary structure sequence
ccgccagctgattcgcctct

SEQ ID NO: 20397 - DNA, 20 bp, Unknown
  RNA secondary structure sequence
ggaaagtactaccccaaggg

SEQ ID NO: 20398 - DNA, 20 bp, Unknown
  RNA secondary structure sequence
cgaccactcatacaaccccc

SEQ ID NO: 20399 - DNA, 20 bp, Unknown
  RNA secondary structure sequence
gcccacggcaagtaccgcgg

SEQ ID NO: 20400 - DNA, 20 bp, Unknown
  RNA secondary structure sequence
ctatgaaaactgggcaataa

SEQ ID NO: 20401 - DNA, 20 bp, Unknown
  RNA secondary structure sequence
taatggatggaaatttcgag

SEQ ID NO: 20402 - DNA, 20 bp, Unknown
  RNA secondary structure sequence
taaccttaaaaattctccag

SEQ ID NO: 20403 - DNA, 20 bp, Unknown
  RNA secondary structure sequence
aattatgacagtaaccatga

SEQ ID NO: 20404 - DNA, 20 bp, Unknown
  RNA secondary structure sequence
gacgacgataagtcggcttt

SEQ ID NO: 20405 - DNA, 20 bp, Unknown
  RNA secondary structure sequence
aatgggcaaacccgagttct

SEQ ID NO: 20406 - DNA, 20 bp, Unknown
  RNA secondary structure sequence
agcagtttctttcgcctttc

SEQ ID NO: 20407 - DNA, 20 bp, Unknown
  RNA secondary structure sequence
ctcagtgcacttgtcatttc

SEQ ID NO: 20408 - DNA, 20 bp, Unknown
  RNA secondary structure sequence
tatatagaagaagaaatacc

SEQ ID NO: 20409 - DNA, 20 bp, Unknown
  RNA secondary structure sequence
tcaaaactcaccgccgagtc

SEQ ID NO: 20410 - DNA, 20 bp, Unknown
  RNA secondary structure sequence
ccatatcgttctttttgggt

SEQ ID NO: 20411 - DNA, 20 bp, Unknown
  RNA secondary structure sequence
cgtgtagcatttcaataaaa

SEQ ID NO: 20412 - DNA, 20 bp, Unknown
  RNA secondary structure sequence
tatgtcgaatgcgctgtaaa

SEQ ID NO: 20413 - DNA, 20 bp, Unknown
  RNA secondary structure sequence
tgcgacaaaaaaataaacgc

SEQ ID NO: 20414 - DNA, 20 bp, Unknown
  RNA secondary structure sequence
aaaaatccaaacaagcaaat

SEQ ID NO: 20415 - DNA, 20 bp, Unknown
  RNA secondary structure sequence
gtgtgggatttgccagactt

SEQ ID NO: 20416 - DNA, 20 bp, Unknown
  RNA secondary structure sequence
tgccttaatgtatgcaccct

SEQ ID NO: 20417 - DNA, 20 bp, Unknown
  RNA secondary structure sequence
aatgtcaccacgggtaaact

SEQ ID NO: 20418 - DNA, 20 bp, Unknown
  RNA secondary structure sequence
ataacacaggacatcgccgg

SEQ ID NO: 20419 - DNA, 20 bp, Unknown
  RNA secondary structure sequence
ccaacccgctgccccaccca

SEQ ID NO: 20420 - DNA, 20 bp, Unknown
  RNA secondary structure sequence
tctctctacatttctccgcc

SEQ ID NO: 20421 - DNA, 20 bp, Unknown
  RNA secondary structure sequence
taaatttcaagtttttcacc

SEQ ID NO: 20422 - DNA, 20 bp, Unknown
  RNA secondary structure sequence
tcagtctgttccacactacg

SEQ ID NO: 20423 - DNA, 20 bp, Unknown
  RNA secondary structure sequence
tttccgtgtcacggcgcgcg

SEQ ID NO: 20424 - DNA, 20 bp, Unknown
  RNA secondary structure sequence
gaggagtgcgtaatcgcaag

SEQ ID NO: 20425 - DNA, 20 bp, Unknown
  RNA secondary structure sequence
tgtccaacattcgcaggaaa

SEQ ID NO: 20426 - DNA, 20 bp, Unknown
  RNA secondary structure sequence
gtttttagtggcgcttcgag

SEQ ID NO: 20427 - DNA, 20 bp, Unknown
  RNA secondary structure sequence
cgcaaacgggatcgactgcg

SEQ ID NO: 20428 - DNA, 20 bp, Unknown
  RNA secondary structure sequence
tttaatagtcctttttttac

SEQ ID NO: 20429 - DNA, 20 bp, Unknown
  RNA secondary structure sequence
cggagagctgccgagctgag

SEQ ID NO: 20430 - DNA, 20 bp, Unknown
  RNA secondary structure sequence
cagattttttggaagaaatt

SEQ ID NO: 20431 - DNA, 20 bp, Unknown
  RNA secondary structure sequence
aaatcaatcggtgatggagt

SEQ ID NO: 20432 - DNA, 20 bp, Unknown
  RNA secondary structure sequence
atgcaaagacttgcagatga

SEQ ID NO: 20433 - DNA, 20 bp, Unknown
  RNA secondary structure sequence
aaggaacatacactctcgta

SEQ ID NO: 20434 - DNA, 20 bp, Unknown
  RNA secondary structure sequence
caatataaaataaccaacta

SEQ ID NO: 20435 - DNA, 20 bp, Unknown
  RNA secondary structure sequence
cggctagtaatgattctggg

SEQ ID NO: 20436 - DNA, 20 bp, Unknown
  RNA secondary structure sequence
taagcccgtgaatgttttct

SEQ ID NO: 20437 - DNA, 20 bp, Unknown
  RNA secondary structure sequence
gcttgtttcacacggttctg

SEQ ID NO: 20438 - DNA, 20 bp, Unknown
  RNA secondary structure sequence
tatctgtcaaggttgtcaga

SEQ ID NO: 20439 - DNA, 20 bp, Unknown
  RNA secondary structure sequence
ggttgcgattgtcagcatct

SEQ ID NO: 20440 - DNA, 20 bp, Unknown
  RNA secondary structure sequence
gctcatacaaaagttcaaga

SEQ ID NO: 20441 - DNA, 20 bp, Unknown
  RNA secondary structure sequence
aggatcaggtatagaggtta

SEQ ID NO: 20442 - DNA, 20 bp, Unknown
  RNA secondary structure sequence
cgaaacggatgagccgatga

SEQ ID NO: 20443 - DNA, 20 bp, Unknown
  RNA secondary structure sequence
agggcatttaaagccaaatt

SEQ ID NO: 20444 - DNA, 20 bp, Unknown
  RNA secondary structure sequence
gagctcgtttgtctctgtag

SEQ ID NO: 20445 - DNA, 20 bp, Unknown
  RNA secondary structure sequence
tagccagggcattcacaatc

SEQ ID NO: 20446 - DNA, 20 bp, Unknown
  RNA secondary structure sequence
tcaaagaatagcagaaccct

SEQ ID NO: 20447 - DNA, 20 bp, Unknown
  RNA secondary structure sequence
tttgtggaacgttgttcccg

SEQ ID NO: 20448 - DNA, 20 bp, Unknown
  RNA secondary structure sequence
tgatcccgccctcgtctgtt

SEQ ID NO: 20449 - DNA, 20 bp, Unknown
  RNA secondary structure sequence
attgtgagaacagcgcataa

SEQ ID NO: 20450 - DNA, 20 bp, Unknown
  RNA secondary structure sequence
tttaggtaaaatttcggtcg

SEQ ID NO: 20451 - DNA, 20 bp, Unknown
  RNA secondary structure sequence
acaaaaaaatacacacataa

SEQ ID NO: 20452 - DNA, 20 bp, Unknown
  RNA secondary structure sequence
tggagggatataggggtgtg

SEQ ID NO: 20453 - DNA, 20 bp, Unknown
  RNA secondary structure sequence
aaatatgcggtcgagggggg

SEQ ID NO: 20454 - DNA, 20 bp, Unknown
  RNA secondary structure sequence
cgagagcgtttggaaaactc

SEQ ID NO: 20455 - DNA, 20 bp, Unknown
  RNA secondary structure sequence
ggtctgccgtgtttggatat

SEQ ID NO: 20456 - DNA, 20 bp, Unknown
  RNA secondary structure sequence
ccattttacccaagtagcct

SEQ ID NO: 20457 - DNA, 20 bp, Unknown
  RNA secondary structure sequence
agcgtcgagtcggttttaag

SEQ ID NO: 20458 - DNA, 20 bp, Unknown
  RNA secondary structure sequence
atacaatggtttggctcgtg

SEQ ID NO: 20459 - DNA, 20 bp, Unknown
  RNA secondary structure sequence
ccccattacaacaaggataa

SEQ ID NO: 20460 - DNA, 20 bp, Unknown
  RNA secondary structure sequence
cgaattgcgtggttttaagt

SEQ ID NO: 20461 - DNA, 20 bp, Unknown
  RNA secondary structure sequence
gaacgtttcctagccacacc

SEQ ID NO: 20462 - DNA, 20 bp, Unknown
  RNA secondary structure sequence
ttaacaaaacccgcgccttt

SEQ ID NO: 20463 - DNA, 20 bp, Unknown
  RNA secondary structure sequence
ttacatatgattactttttc

SEQ ID NO: 20464 - DNA, 20 bp, Unknown
  RNA secondary structure sequence
gctgtgaaacctttcacaag

SEQ ID NO: 20465 - DNA, 20 bp, Unknown
  RNA secondary structure sequence
aagatacaggcaactgcaaa

SEQ ID NO: 20466 - DNA, 20 bp, Unknown
  RNA secondary structure sequence
ctgttgttgctagtattttc

SEQ ID NO: 20467 - DNA, 20 bp, Unknown
  RNA secondary structure sequence
aaccgtgtgatactacatcg

SEQ ID NO: 20468 - DNA, 20 bp, Unknown
  RNA secondary structure sequence
atgcttaatacatggggaaa

SEQ ID NO: 20469 - DNA, 20 bp, Unknown
  RNA secondary structure sequence
cagggcggctccttgggggt

SEQ ID NO: 20470 - DNA, 20 bp, Unknown
  RNA secondary structure sequence
tttaatttattaataaaaat

SEQ ID NO: 20471 - DNA, 20 bp, Unknown
  RNA secondary structure sequence
ctgttccgcatttaaaggtt

SEQ ID NO: 20472 - DNA, 20 bp, Unknown
  RNA secondary structure sequence
gcctccacaccgtgagtatt

SEQ ID NO: 20473 - DNA, 20 bp, Unknown
  RNA secondary structure sequence
gtaccggtttatattcacgc

SEQ ID NO: 20474 - DNA, 20 bp, Unknown
  RNA secondary structure sequence
ggttgtttttccaattccat

SEQ ID NO: 20475 - DNA, 20 bp, Unknown
  RNA secondary structure sequence
ctttttgagtacatcgtaaa

SEQ ID NO: 20476 - DNA, 20 bp, Unknown
  RNA secondary structure sequence
agttccgtcccagaagataa

SEQ ID NO: 20477 - DNA, 20 bp, Unknown
  RNA secondary structure sequence
tcacgggacggcaagttcga

SEQ ID NO: 20478 - DNA, 20 bp, Unknown
  RNA secondary structure sequence
caccccaagcccgcgtctcg

SEQ ID NO: 20479 - DNA, 20 bp, Unknown
  RNA secondary structure sequence
tatttataattaccgccccc

SEQ ID NO: 20480 - DNA, 20 bp, Unknown
  RNA secondary structure sequence
cttcctcttccgcgataatt

SEQ ID NO: 20481 - DNA, 20 bp, Unknown
  RNA secondary structure sequence
gcctgacatgaccaaagtga

SEQ ID NO: 20482 - DNA, 20 bp, Unknown
  RNA secondary structure sequence
cgtacatatttctttttttt

SEQ ID NO: 20483 - DNA, 20 bp, Unknown
  RNA secondary structure sequence
accagaatctcttcatatgt

SEQ ID NO: 20484 - DNA, 20 bp, Unknown
  RNA secondary structure sequence
caatgacatttaacatcaat

SEQ ID NO: 20485 - DNA, 20 bp, Unknown
  RNA secondary structure sequence
aaagacacaggaaacaacgc

SEQ ID NO: 20486 - DNA, 20 bp, Unknown
  RNA secondary structure sequence
ccaattgcagttccaggcta

SEQ ID NO: 20487 - DNA, 20 bp, Unknown
  RNA secondary structure sequence
tactggacgcatagacggcg

SEQ ID NO: 20488 - DNA, 20 bp, Unknown
  RNA secondary structure sequence
cgtacggcgagactttttca

SEQ ID NO: 20489 - DNA, 20 bp, Unknown
  RNA secondary structure sequence
aacggggcggtaaattttga

SEQ ID NO: 20490 - DNA, 20 bp, Unknown
  RNA secondary structure sequence
cgcagaaattagcgatcaca

SEQ ID NO: 20491 - DNA, 20 bp, Unknown
  RNA secondary structure sequence
tcgccattgtcccgtgttcc

SEQ ID NO: 20492 - DNA, 20 bp, Unknown
  RNA secondary structure sequence
tggtgtacgtgttaactatg

SEQ ID NO: 20493 - DNA, 20 bp, Unknown
  RNA secondary structure sequence
ggtggtaactacctgctgta

SEQ ID NO: 20494 - DNA, 20 bp, Unknown
  RNA secondary structure sequence
acacacacacagtatataag

SEQ ID NO: 20495 - DNA, 20 bp, Unknown
  RNA secondary structure sequence
ggcgtcacctaaatctaaaa

SEQ ID NO: 20496 - DNA, 20 bp, Unknown
  RNA secondary structure sequence
ggtcggggcgctttttttgt

SEQ ID NO: 20497 - DNA, 20 bp, Unknown
  RNA secondary structure sequence
tgtttcgcgcacacgcagaa

SEQ ID NO: 20498 - DNA, 20 bp, Unknown
  RNA secondary structure sequence
tgaattgcaggaaatagatt

SEQ ID NO: 20499 - DNA, 20 bp, Unknown
  RNA secondary structure sequence
aaaaaacgcaaacgtgttta

SEQ ID NO: 20500 - DNA, 20 bp, Unknown
  RNA secondary structure sequence
gtgcatagaattggcgggat

SEQ ID NO: 20501 - DNA, 20 bp, Unknown
  RNA secondary structure sequence
agagagtcagtgtccatttt

SEQ ID NO: 20502 - DNA, 20 bp, Unknown
  RNA secondary structure sequence
ggtcaacagtcaccttgacc

SEQ ID NO: 20503 - DNA, 20 bp, Unknown
  RNA secondary structure sequence
atcatacgatttgtatgcgt

SEQ ID NO: 20504 - DNA, 20 bp, Unknown
  RNA secondary structure sequence
cacgcctgtgtcgagcagaa

SEQ ID NO: 20505 - DNA, 20 bp, Unknown
  RNA secondary structure sequence
aacggttcaaccgaaaacgg

SEQ ID NO: 20506 - DNA, 20 bp, Unknown
  RNA secondary structure sequence
aacagtttttagatgttgta

SEQ ID NO: 20507 - DNA, 20 bp, Unknown
  RNA secondary structure sequence
tactgtcccgcattgtatat

SEQ ID NO: 20508 - DNA, 20 bp, Unknown
  RNA secondary structure sequence
agagtaaaccgttttttata

SEQ ID NO: 20509 - DNA, 20 bp, Unknown
  RNA secondary structure sequence
aagctaaattgtacgtggaa

SEQ ID NO: 20510 - DNA, 20 bp, Unknown
  RNA secondary structure sequence
gtattttgcacgtaaacgcc

SEQ ID NO: 20511 - DNA, 20 bp, Unknown
  RNA secondary structure sequence
acactaaacatagtgtgtcc

SEQ ID NO: 20512 - DNA, 20 bp, Unknown
  RNA secondary structure sequence
agaagtaagcctataaaata

SEQ ID NO: 20513 - DNA, 20 bp, Unknown
  RNA secondary structure sequence
ttcccctcctacccccacat

SEQ ID NO: 20514 - DNA, 20 bp, Unknown
  RNA secondary structure sequence
ggattttgagttacatccta

SEQ ID NO: 20515 - DNA, 20 bp, Unknown
  RNA secondary structure sequence
ttcctgtgcctattgcgaga

SEQ ID NO: 20516 - DNA, 20 bp, Unknown
  RNA secondary structure sequence
atctttgaacatcgtgtgcc

SEQ ID NO: 20517 - DNA, 20 bp, Unknown
  RNA secondary structure sequence
agggaggagagcgaaggagg

SEQ ID NO: 20518 - DNA, 20 bp, Unknown
  RNA secondary structure sequence
caatcagtcacaaacttaca

SEQ ID NO: 20519 - DNA, 20 bp, Unknown
  RNA secondary structure sequence
ggtcttggttttctcttttt

SEQ ID NO: 20520 - DNA, 20 bp, Unknown
  RNA secondary structure sequence
acaaccacgccgacgcggag

SEQ ID NO: 20521 - DNA, 20 bp, Unknown
  RNA secondary structure sequence
ggttgaggaacctgttaaga

SEQ ID NO: 20522 - DNA, 20 bp, Unknown
  RNA secondary structure sequence
gaaccggaaaggcgggccag

SEQ ID NO: 20523 - DNA, 20 bp, Unknown
  RNA secondary structure sequence
acgcagggtctccattttga

SEQ ID NO: 20524 - DNA, 20 bp, Unknown
  RNA secondary structure sequence
ccaattctgatgcgccggtg

SEQ ID NO: 20525 - DNA, 20 bp, Unknown
  RNA secondary structure sequence
tgagcagtccaccccaggcg

SEQ ID NO: 20526 - DNA, 20 bp, Unknown
  RNA secondary structure sequence
gtataggtctctacatcgta

SEQ ID NO: 20527 - DNA, 20 bp, Unknown
  RNA secondary structure sequence
cagatatgctcttgcatagg

SEQ ID NO: 20528 - DNA, 20 bp, Unknown
  RNA secondary structure sequence
gcgtaccactgtggccaggc

SEQ ID NO: 20529 - DNA, 20 bp, Unknown
  RNA secondary structure sequence
cgagacgggtctttggagcg

SEQ ID NO: 20530 - DNA, 20 bp, Unknown
  RNA secondary structure sequence
cccgacgaccaccccaggca

SEQ ID NO: 20531 - DNA, 20 bp, Unknown
  RNA secondary structure sequence
aaacaaaaaattgaaaagtg

SEQ ID NO: 20532 - DNA, 20 bp, Unknown
  RNA secondary structure sequence
tctgttggtacccgttagga

SEQ ID NO: 20533 - DNA, 20 bp, Unknown
  RNA secondary structure sequence
tggaggaaagccaattggct

SEQ ID NO: 20534 - DNA, 20 bp, Unknown
  RNA secondary structure sequence
tcggcgccctctagcggcca

SEQ ID NO: 20535 - DNA, 20 bp, Unknown
  RNA secondary structure sequence
gacccaccccctcggcggcg

SEQ ID NO: 20536 - DNA, 20 bp, Unknown
  RNA secondary structure sequence
cccggccctagtcgaagcct

SEQ ID NO: 20537 - DNA, 20 bp, Unknown
  RNA secondary structure sequence
atgcccaaagaacgacggtc

SEQ ID NO: 20538 - DNA, 20 bp, Unknown
  RNA secondary structure sequence
ctactgctattgagcaggct

SEQ ID NO: 20539 - DNA, 20 bp, Unknown
  RNA secondary structure sequence
tcaatcctgtgtcgggtgga

SEQ ID NO: 20540 - DNA, 20 bp, Unknown
  RNA secondary structure sequence
ggtggaatgaataacatgtc

SEQ ID NO: 20541 - DNA, 20 bp, Unknown
  RNA secondary structure sequence
cgaacagggacctgagaggg

SEQ ID NO: 20542 - DNA, 20 bp, Unknown
  RNA secondary structure sequence
aagtcttctggaggtgttcc

SEQ ID NO: 20543 - DNA, 20 bp, Unknown
  RNA secondary structure sequence
gtaattagggaagcacagat

SEQ ID NO: 20544 - DNA, 20 bp, Unknown
  RNA secondary structure sequence
cctggatctccagatacgga

SEQ ID NO: 20545 - DNA, 20 bp, Unknown
  RNA secondary structure sequence
ggacgaagactgagtttccc

SEQ ID NO: 20546 - DNA, 20 bp, Unknown
  RNA secondary structure sequence
gtccgccgccgctcaaggcg

SEQ ID NO: 20547 - DNA, 20 bp, Unknown
  RNA secondary structure sequence
taccaccctagcattctcgt

SEQ ID NO: 20548 - DNA, 20 bp, Unknown
  RNA secondary structure sequence
gttgattcccatcatcgccg

SEQ ID NO: 20549 - DNA, 20 bp, Unknown
  RNA secondary structure sequence
cgtacgccgttctcggccgg

SEQ ID NO: 20550 - DNA, 20 bp, Unknown
  RNA secondary structure sequence
ctccacttgctcattttcct

SEQ ID NO: 20551 - DNA, 20 bp, Unknown
  RNA secondary structure sequence
ctaaacacccgcgctttttt

SEQ ID NO: 20552 - DNA, 20 bp, Unknown
  RNA secondary structure sequence
tgtggacggctacgactgaa

SEQ ID NO: 20553 - DNA, 20 bp, Unknown
  RNA secondary structure sequence
ctccttccccttactactta

SEQ ID NO: 20554 - DNA, 20 bp, Unknown
  RNA secondary structure sequence
actgccatctgcagcattgc

SEQ ID NO: 20555 - DNA, 20 bp, Unknown
  RNA secondary structure sequence
gcagcgcgctccatcagtta

SEQ ID NO: 20556 - DNA, 20 bp, Unknown
  RNA secondary structure sequence
agacggggttgaagtcgtct

SEQ ID NO: 20557 - DNA, 20 bp, Unknown
  RNA secondary structure sequence
acagtgggtatgcttttacg

SEQ ID NO: 20558 - DNA, 20 bp, Unknown
  RNA secondary structure sequence
cttcgtgacttgcactttgg

SEQ ID NO: 20559 - DNA, 20 bp, Unknown
  RNA secondary structure sequence
ctgtttccatcacgctttcg

SEQ ID NO: 20560 - DNA, 20 bp, Unknown
  RNA secondary structure sequence
ccagctttttccttataaaa

SEQ ID NO: 20561 - DNA, 20 bp, Unknown
  RNA secondary structure sequence
tgaggtaatctatgatgagg

SEQ ID NO: 20562 - DNA, 20 bp, Unknown
  RNA secondary structure sequence
gggtaccatagcgaggaacc

SEQ ID NO: 20563 - DNA, 20 bp, Unknown
  RNA secondary structure sequence
gacccccagacacggagagg

SEQ ID NO: 20564 - DNA, 20 bp, Unknown
  RNA secondary structure sequence
gatgacgaagaccagtacga

SEQ ID NO: 20565 - DNA, 20 bp, Unknown
  RNA secondary structure sequence
attccacttattgctgcggc

SEQ ID NO: 20566 - DNA, 20 bp, Unknown
  RNA secondary structure sequence
ggcgggtaacgctaccacct

SEQ ID NO: 20567 - DNA, 20 bp, Unknown
  RNA secondary structure sequence
gtgcgtcttggggtatgagt

SEQ ID NO: 20568 - DNA, 20 bp, Unknown
  RNA secondary structure sequence
cctgtggctccagatccatc

SEQ ID NO: 20569 - DNA, 20 bp, Unknown
  RNA secondary structure sequence
gttcttcttcgctttcggaa

SEQ ID NO: 20570 - DNA, 20 bp, Unknown
  RNA secondary structure sequence
atacccaactttgacgcagt

SEQ ID NO: 20571 - DNA, 20 bp, Unknown
  RNA secondary structure sequence
tgtcagaataacagttgaaa

SEQ ID NO: 20572 - DNA, 20 bp, Unknown
  RNA secondary structure sequence
aggaataattggcttcagca

SEQ ID NO: 20573 - DNA, 20 bp, Unknown
  RNA secondary structure sequence
gaagaagtaaaagggggtgt

SEQ ID NO: 20574 - DNA, 20 bp, Unknown
  RNA secondary structure sequence
tctgtttcttcagcatactg

SEQ ID NO: 20575 - DNA, 20 bp, Unknown
  RNA secondary structure sequence
gcgagagtggttgtactttg

SEQ ID NO: 20576 - DNA, 20 bp, Unknown
  RNA secondary structure sequence
ctgttgttgaacatttggaa

SEQ ID NO: 20577 - DNA, 20 bp, Unknown
  RNA secondary structure sequence
tcattccgacgtgttttgcg

SEQ ID NO: 20578 - DNA, 20 bp, Unknown
  RNA secondary structure sequence
ttaccctgtcttgcctgcgg

SEQ ID NO: 20579 - DNA, 20 bp, Unknown
  RNA secondary structure sequence
gctaaaggccacgctacaga

SEQ ID NO: 20580 - DNA, 20 bp, Unknown
  RNA secondary structure sequence
tagggtggcgccgctgccat

SEQ ID NO: 20581 - DNA, 20 bp, Unknown
  RNA secondary structure sequence
cagaggcccactgtattgct

SEQ ID NO: 20582 - DNA, 20 bp, Unknown
  RNA secondary structure sequence
tgtgtttcaagtattgccat

SEQ ID NO: 20583 - DNA, 20 bp, Unknown
  RNA secondary structure sequence
gagacacataaggagagttc

SEQ ID NO: 20584 - DNA, 20 bp, Unknown
  RNA secondary structure sequence
gacggctccccccggtggat

SEQ ID NO: 20585 - DNA, 20 bp, Unknown
  RNA secondary structure sequence
tatgccacgatccagtggtt

SEQ ID NO: 20586 - DNA, 20 bp, Unknown
  RNA secondary structure sequence
cctaatttgtgcccacgctg

SEQ ID NO: 20587 - DNA, 20 bp, Unknown
  RNA secondary structure sequence
ccggtttcgggaaactgggt

SEQ ID NO: 20588 - DNA, 20 bp, Unknown
  RNA secondary structure sequence
gcgcccaacgtggggctcga

SEQ ID NO: 20589 - DNA, 20 bp, Unknown
  RNA secondary structure sequence
ccagcgtttttggggagaac

SEQ ID NO: 20590 - DNA, 20 bp, Unknown
  RNA secondary structure sequence
cacacagccgccagccaacc

SEQ ID NO: 20591 - DNA, 20 bp, Unknown
  RNA secondary structure sequence
gccgaggaccagaacaacat

SEQ ID NO: 20592 - DNA, 20 bp, Unknown
  RNA secondary structure sequence
aacgatatcggtagttaatt

SEQ ID NO: 20593 - DNA, 20 bp, Unknown
  RNA secondary structure sequence
tagacatcagaattaagaaa

SEQ ID NO: 20594 - DNA, 20 bp, Unknown
  RNA secondary structure sequence
gtcttcatcccctctcctgc

SEQ ID NO: 20595 - DNA, 20 bp, Unknown
  RNA secondary structure sequence
gagcatttcaaaggtctgca

SEQ ID NO: 20596 - DNA, 20 bp, Unknown
  RNA secondary structure sequence
acactccttatgaccctgag

SEQ ID NO: 20597 - DNA, 20 bp, Unknown
  RNA secondary structure sequence
gtaaaagcggcgacaacccc

SEQ ID NO: 20598 - DNA, 20 bp, Unknown
  RNA secondary structure sequence
ttctgtgttgtctctgtctg

SEQ ID NO: 20599 - DNA, 20 bp, Unknown
  RNA secondary structure sequence
cacgtgaaggctgccgaccc

SEQ ID NO: 20600 - DNA, 20 bp, Unknown
  RNA secondary structure sequence
tctggcggcagcctaccaag

SEQ ID NO: 20601 - DNA, 20 bp, Unknown
  RNA secondary structure sequence
tccatcgagccagtgtagag

SEQ ID NO: 20602 - DNA, 20 bp, Unknown
  RNA secondary structure sequence
atttctactattttgtgttc

SEQ ID NO: 20603 - DNA, 20 bp, Unknown
  RNA secondary structure sequence
gcagtctcgcctacagagaa

SEQ ID NO: 20604 - DNA, 20 bp, Unknown
  RNA secondary structure sequence
tataggtgttggagccctgc

SEQ ID NO: 20605 - DNA, 20 bp, Unknown
  RNA secondary structure sequence
cttgcaaaatggcgttactg

SEQ ID NO: 20606 - DNA, 20 bp, Unknown
  RNA secondary structure sequence
tttgtcatttgtctggttcg

SEQ ID NO: 20607 - DNA, 20 bp, Unknown
  RNA secondary structure sequence
aaggcgctgctgggggacag

SEQ ID NO: 20608 - DNA, 20 bp, Unknown
  RNA secondary structure sequence
aaggcagcgctagtaagaaa

SEQ ID NO: 20609 - DNA, 20 bp, Unknown
  RNA secondary structure sequence
ccttggtctatacaggattg

SEQ ID NO: 20610 - DNA, 20 bp, Unknown
  RNA secondary structure sequence
caggtagctggcgtctttta

SEQ ID NO: 20611 - DNA, 20 bp, Unknown
  RNA secondary structure sequence
tggctccctgagcgactaat

SEQ ID NO: 20612 - DNA, 20 bp, Unknown
  RNA secondary structure sequence
ccaaaaggctcgccctgagg

SEQ ID NO: 20613 - DNA, 20 bp, Unknown
  RNA secondary structure sequence
gtaaccggttccctgcacgg

SEQ ID NO: 20614 - DNA, 20 bp, Unknown
  RNA secondary structure sequence
gttcgttcctcatttcgacg

SEQ ID NO: 20615 - DNA, 20 bp, Unknown
  RNA secondary structure sequence
gacgtggtccagattaagtt

SEQ ID NO: 20616 - DNA, 20 bp, Unknown
  RNA secondary structure sequence
atatagtaaaaataaagtat

SEQ ID NO: 20617 - DNA, 20 bp, Unknown
  RNA secondary structure sequence
tttgttgcaagtgtgactct

SEQ ID NO: 20618 - DNA, 20 bp, Unknown
  RNA secondary structure sequence
tgctgacgatgcgaaaagat

SEQ ID NO: 20619 - DNA, 20 bp, Unknown
  RNA secondary structure sequence
acaaacaccacccccgcgac

SEQ ID NO: 20620 - DNA, 20 bp, Unknown
  RNA secondary structure sequence
gaggaacgcctggaagggaa

SEQ ID NO: 20621 - DNA, 20 bp, Unknown
  RNA secondary structure sequence
cggagatctgcagctcctgt

SEQ ID NO: 20622 - DNA, 20 bp, Unknown
  RNA secondary structure sequence
catgactcacagggaggagc

SEQ ID NO: 20623 - DNA, 20 bp, Unknown
  RNA secondary structure sequence
aaagactcctaggtaagtaa

SEQ ID NO: 20624 - DNA, 20 bp, Unknown
  RNA secondary structure sequence
ctggggctattgctgggttt

SEQ ID NO: 20625 - DNA, 20 bp, Unknown
  RNA secondary structure sequence
gatgtcctaaagtcaacatg

SEQ ID NO: 20626 - DNA, 20 bp, Unknown
  RNA secondary structure sequence
tcacaatcatctcgtgtttc

SEQ ID NO: 20627 - DNA, 20 bp, Unknown
  RNA secondary structure sequence
tcagaagaacaactggcaac

SEQ ID NO: 20628 - DNA, 20 bp, Unknown
  RNA secondary structure sequence
tattgcaaaaaatgctgtta

SEQ ID NO: 20629 - DNA, 20 bp, Unknown
  RNA secondary structure sequence
cctgaccctcctcatattca

SEQ ID NO: 20630 - DNA, 20 bp, Unknown
  RNA secondary structure sequence
tcaggtagggtgagagccta

SEQ ID NO: 20631 - DNA, 20 bp, Unknown
  RNA secondary structure sequence
tatgtggtagcctgtacgga

SEQ ID NO: 20632 - DNA, 20 bp, Unknown
  RNA secondary structure sequence
ttctttttctatttttgttt

SEQ ID NO: 20633 - DNA, 20 bp, Unknown
  RNA secondary structure sequence
aaaatatcagggtactggag

SEQ ID NO: 20634 - DNA, 20 bp, Unknown
  RNA secondary structure sequence
aaatgtaacaattccctttg

SEQ ID NO: 20635 - DNA, 20 bp, Unknown
  RNA secondary structure sequence
atatgtgcccctgtcacctg

SEQ ID NO: 20636 - DNA, 20 bp, Unknown
  RNA secondary structure sequence
cttctcccgacatcgtcgcc

SEQ ID NO: 20637 - DNA, 20 bp, Unknown
  RNA secondary structure sequence
tactaggcacattgaagctc

SEQ ID NO: 20638 - DNA, 20 bp, Unknown
  RNA secondary structure sequence
tactgtaatggtaattgcta

SEQ ID NO: 20639 - DNA, 20 bp, Unknown
  RNA secondary structure sequence
acaatgttgtatgtgtaata

SEQ ID NO: 20640 - DNA, 20 bp, Unknown
  RNA secondary structure sequence
gtctccgccctttattagta

SEQ ID NO: 20641 - DNA, 20 bp, Unknown
  RNA secondary structure sequence
ggttgtacacagtgtggacg

SEQ ID NO: 20642 - DNA, 20 bp, Unknown
  RNA secondary structure sequence
acactgggcattgtgtgtcc

SEQ ID NO: 20643 - DNA, 20 bp, Unknown
  RNA secondary structure sequence
ttttaccccaactgtacctg

SEQ ID NO: 20644 - DNA, 20 bp, Unknown
  RNA secondary structure sequence
aataggtttaggaccgaaaa

SEQ ID NO: 20645 - DNA, 20 bp, Unknown
  RNA secondary structure sequence
cgaaaacggtacatataaaa

SEQ ID NO: 20646 - DNA, 20 bp, Unknown
  RNA secondary structure sequence
aacatagtgtgtgtagcaga

SEQ ID NO: 20647 - DNA, 20 bp, Unknown
  RNA secondary structure sequence
gacatggtccagattagatt

SEQ ID NO: 20648 - DNA, 20 bp, Unknown
  RNA secondary structure sequence
cataaccacatttacactat

SEQ ID NO: 20649 - DNA, 20 bp, Unknown
  RNA secondary structure sequence
ataaatcacagtttttttgt

SEQ ID NO: 20650 - DNA, 20 bp, Unknown
  RNA secondary structure sequence
ttttttgaaacgtaggcgtc

SEQ ID NO: 20651 - DNA, 20 bp, Unknown
  RNA secondary structure sequence
ctgacatgctggagacacac

SEQ ID NO: 20652 - DNA, 20 bp, Unknown
  RNA secondary structure sequence
cagtgttgtaggtgtgagtc

SEQ ID NO: 20653 - DNA, 20 bp, Unknown
  RNA secondary structure sequence
agggtccgaccgaaaacggt

SEQ ID NO: 20654 - DNA, 20 bp, Unknown
  RNA secondary structure sequence
tcctgcaggtacaccatatt

SEQ ID NO: 20655 - DNA, 20 bp, Unknown
  RNA secondary structure sequence
tgcatactatttcagaaaac

SEQ ID NO: 20656 - DNA, 20 bp, Unknown
  RNA secondary structure sequence
cattgtgtattttgtcactg

SEQ ID NO: 20657 - DNA, 20 bp, Unknown
  RNA secondary structure sequence
ggcattgctactaacccata

SEQ ID NO: 20658 - DNA, 20 bp, Unknown
  RNA secondary structure sequence
cgtagctggctgtggttgcg

SEQ ID NO: 20659 - DNA, 20 bp, Unknown
  RNA secondary structure sequence
cgttgcctttcagtacagtc

SEQ ID NO: 20660 - DNA, 20 bp, Unknown
  RNA secondary structure sequence
gaatatattctcatatcact

SEQ ID NO: 20661 - DNA, 20 bp, Unknown
  RNA secondary structure sequence
tgcccataatccaatgggtt

SEQ ID NO: 20662 - DNA, 20 bp, Unknown
  RNA secondary structure sequence
ctcctcgcttcggtctcccc

SEQ ID NO: 20663 - DNA, 20 bp, Unknown
  RNA secondary structure sequence
cttagtctgtaagttttggg

SEQ ID NO: 20664 - DNA, 20 bp, Unknown
  RNA secondary structure sequence
cgtaaattaatggtgtctac

SEQ ID NO: 20665 - DNA, 20 bp, Unknown
  RNA secondary structure sequence
cagcgaaccgattttcgatt

SEQ ID NO: 20666 - DNA, 20 bp, Unknown
  RNA secondary structure sequence
tgcacagagcatcagcaaat

SEQ ID NO: 20667 - DNA, 20 bp, Unknown
  RNA secondary structure sequence
ggatttatatgggaatattc

SEQ ID NO: 20668 - DNA, 20 bp, Unknown
  RNA secondary structure sequence
aagatgttgttcccgtcgtg

SEQ ID NO: 20669 - DNA, 20 bp, Unknown
  RNA secondary structure sequence
aacaaaaatgcaaacaagga

SEQ ID NO: 20670 - DNA, 20 bp, Unknown
  RNA secondary structure sequence
cttattttccgtatacaact

SEQ ID NO: 20671 - DNA, 20 bp, Unknown
  RNA secondary structure sequence
cactaatcctcgcatccgca

SEQ ID NO: 20672 - DNA, 20 bp, Unknown
  RNA secondary structure sequence
gccccgcttgtttctacact

SEQ ID NO: 20673 - DNA, 20 bp, Unknown
  RNA secondary structure sequence
tcgacatcgcgggcggcaaa

SEQ ID NO: 20674 - DNA, 20 bp, Unknown
  RNA secondary structure sequence
gttccggcttctgtattgca

SEQ ID NO: 20675 - DNA, 20 bp, Unknown
  RNA secondary structure sequence
gtttgctttggatccgttgt

SEQ ID NO: 20676 - DNA, 20 bp, Unknown
  RNA secondary structure sequence
tcattttgtgtaattggtat

SEQ ID NO: 20677 - DNA, 20 bp, Unknown
  RNA secondary structure sequence
aaaataaccaactacatggt

SEQ ID NO: 20678 - DNA, 20 bp, Unknown
  RNA secondary structure sequence
tcggggttagtcgattaata

SEQ ID NO: 20679 - DNA, 20 bp, Unknown
  RNA secondary structure sequence
cgatagatatatattttctc

SEQ ID NO: 20680 - DNA, 20 bp, Unknown
  RNA secondary structure sequence
acaggagagtataaagcagt

SEQ ID NO: 20681 - DNA, 20 bp, Unknown
  RNA secondary structure sequence
cgatgctccggtctatgact

SEQ ID NO: 20682 - DNA, 20 bp, Unknown
  RNA secondary structure sequence
gacttctacataggatacta

SEQ ID NO: 20683 - DNA, 20 bp, Unknown
  RNA secondary structure sequence
agaatgtaaaagaggcagag

SEQ ID NO: 20684 - DNA, 20 bp, Unknown
  RNA secondary structure sequence
agaatgtgtgactaaaatag

SEQ ID NO: 20685 - DNA, 20 bp, Unknown
  RNA secondary structure sequence
cctaacagtcgtagtatcct

SEQ ID NO: 20686 - DNA, 20 bp, Unknown
  RNA secondary structure sequence
ttgttttccatttttaattt

SEQ ID NO: 20687 - DNA, 20 bp, Unknown
  RNA secondary structure sequence
cagtatttaaaaagggagat

SEQ ID NO: 20688 - DNA, 20 bp, Unknown
  RNA secondary structure sequence
tcctaatgtgcagtcaggtg

SEQ ID NO: 20689 - DNA, 20 bp, Unknown
  RNA secondary structure sequence
tcagaaggtacctaaccaag

SEQ ID NO: 20690 - DNA, 20 bp, Unknown
  RNA secondary structure sequence
gaaagttaactggtaagttt

SEQ ID NO: 20691 - DNA, 20 bp, Unknown
  RNA secondary structure sequence
tagcagcggttggtttgaaa

SEQ ID NO: 20692 - DNA, 20 bp, Unknown
  RNA secondary structure sequence
agagctttgtttattttgtc

SEQ ID NO: 20693 - DNA, 20 bp, Unknown
  RNA secondary structure sequence
tgaaatcgcaattcgctgtg

SEQ ID NO: 20694 - DNA, 20 bp, Unknown
  RNA secondary structure sequence
tacgtgtaagcattgtcatt

SEQ ID NO: 20695 - DNA, 20 bp, Unknown
  RNA secondary structure sequence
cgaaatgggattgttattaa

SEQ ID NO: 20696 - DNA, 20 bp, Unknown
  RNA secondary structure sequence
acatttggaacattaaactc

SEQ ID NO: 20697 - DNA, 20 bp, Unknown
  RNA secondary structure sequence
tctctttctgtacgctgttt

SEQ ID NO: 20698 - DNA, 20 bp, Unknown
  RNA secondary structure sequence
taggcgacgcaaacgaaaac

SEQ ID NO: 20699 - DNA, 20 bp, Unknown
  RNA secondary structure sequence
agaagtgttcctgacctgtt

SEQ ID NO: 20700 - DNA, 20 bp, Unknown
  RNA secondary structure sequence
tgtgcaatctggtgaattta

SEQ ID NO: 20701 - DNA, 20 bp, Unknown
  RNA secondary structure sequence
ccagccaagcatgagctcat

SEQ ID NO: 20702 - DNA, 20 bp, Unknown
  RNA secondary structure sequence
actgggatcataaagtttca

SEQ ID NO: 20703 - DNA, 20 bp, Unknown
  RNA secondary structure sequence
cacgccgctcacgtaaaggc

SEQ ID NO: 20704 - DNA, 20 bp, Unknown
  RNA secondary structure sequence
tggagagggactccaagtcc

SEQ ID NO: 20705 - DNA, 20 bp, Unknown
  RNA secondary structure sequence
aaagcgcaaaggaaaaatgc

SEQ ID NO: 20706 - DNA, 20 bp, Unknown
  RNA secondary structure sequence
ataattgatcattttgaagc

SEQ ID NO: 20707 - DNA, 20 bp, Unknown
  RNA secondary structure sequence
caatctgaaaacctacaaag

SEQ ID NO: 20708 - DNA, 20 bp, Unknown
  RNA secondary structure sequence
ccattccgaagcgagttttc

SEQ ID NO: 20709 - DNA, 20 bp, Unknown
  RNA secondary structure sequence
ggcaacattaataaaaagcc

SEQ ID NO: 20710 - DNA, 20 bp, Unknown
  RNA secondary structure sequence
taggaactcatcaacattga

SEQ ID NO: 20711 - DNA, 20 bp, Unknown
  RNA secondary structure sequence
acttttcgtcttagaaacaa

SEQ ID NO: 20712 - DNA, 20 bp, Unknown
  RNA secondary structure sequence
cctgcgcgcgcgggaactgt

SEQ ID NO: 20713 - DNA, 20 bp, Unknown
  RNA secondary structure sequence
actcacccttccatctcttc

SEQ ID NO: 20714 - DNA, 20 bp, Unknown
  RNA secondary structure sequence
caaatacaaccacaaccaaa

SEQ ID NO: 20715 - DNA, 20 bp, Unknown
  RNA secondary structure sequence
tcataccaggattttttgga

SEQ ID NO: 20716 - DNA, 20 bp, Unknown
  RNA secondary structure sequence
aacctagtcacaactgctgt

SEQ ID NO: 20717 - DNA, 20 bp, Unknown
  RNA secondary structure sequence
aatttcttcggggtatgtat

SEQ ID NO: 20718 - DNA, 20 bp, Unknown
  RNA secondary structure sequence
atgttcgatatgggggtacg

SEQ ID NO: 20719 - DNA, 20 bp, Unknown
  RNA secondary structure sequence
aagattgttggaaagggatt

SEQ ID NO: 20720 - DNA, 20 bp, Unknown
  RNA secondary structure sequence
tactatgcatgtatttcagt

SEQ ID NO: 20721 - DNA, 20 bp, Unknown
  RNA secondary structure sequence
taatattctttgtggttttt

SEQ ID NO: 20722 - DNA, 20 bp, Unknown
  RNA secondary structure sequence
gttctgagttcatagaaaag

SEQ ID NO: 20723 - DNA, 20 bp, Unknown
  RNA secondary structure sequence
atttcaggtttcaaaattaa

SEQ ID NO: 20724 - DNA, 20 bp, Unknown
  RNA secondary structure sequence
aatataaaaggccgtttatg

SEQ ID NO: 20725 - DNA, 20 bp, Unknown
  RNA secondary structure sequence
ttcactagggttcttacata

SEQ ID NO: 20726 - DNA, 20 bp, Unknown
  RNA secondary structure sequence
atggaatattcaaaccattt

SEQ ID NO: 20727 - DNA, 20 bp, Unknown
  RNA secondary structure sequence
gtacgatttgctcgacaacg

SEQ ID NO: 20728 - DNA, 20 bp, Unknown
  RNA secondary structure sequence
tttccctacgaacaaataca

SEQ ID NO: 20729 - DNA, 20 bp, Unknown
  RNA secondary structure sequence
ccttacacaagaaaaaacgt

SEQ ID NO: 20730 - DNA, 20 bp, Unknown
  RNA secondary structure sequence
tttacgttttattgtagaaa

SEQ ID NO: 20731 - DNA, 20 bp, Unknown
  RNA secondary structure sequence
tgatccccgcttgctaattg

SEQ ID NO: 20732 - DNA, 20 bp, Unknown
  RNA secondary structure sequence
gactcgcctcttgatcgggc

SEQ ID NO: 20733 - DNA, 20 bp, Unknown
  RNA secondary structure sequence
aagcgtcaaccccggggaga

SEQ ID NO: 20734 - DNA, 20 bp, Unknown
  RNA secondary structure sequence
cgtaggacgatcggctgaag

SEQ ID NO: 20735 - DNA, 20 bp, Unknown
  RNA secondary structure sequence
acaaccatttataccgccaa

SEQ ID NO: 20736 - DNA, 20 bp, Unknown
  RNA secondary structure sequence
aacactaaatcaacacatca

SEQ ID NO: 20737 - DNA, 20 bp, Unknown
  RNA secondary structure sequence
gacaaaaggaaaatataaaa

SEQ ID NO: 20738 - DNA, 20 bp, Unknown
  RNA secondary structure sequence
ccggttcctaccccccgctc

SEQ ID NO: 20739 - DNA, 20 bp, Unknown
  RNA secondary structure sequence
tccgtctgcggggagggcgt

SEQ ID NO: 20740 - DNA, 20 bp, Unknown
  RNA secondary structure sequence
ggcgattcccttcgcgaggg

SEQ ID NO: 20741 - DNA, 20 bp, Unknown
  RNA secondary structure sequence
caggccctcgctgctctccc

SEQ ID NO: 20742 - DNA, 20 bp, Unknown
  RNA secondary structure sequence
gcaccacccagcggcccagt

SEQ ID NO: 20743 - DNA, 20 bp, Unknown
  RNA secondary structure sequence
gggtggggtgggggaaagcc

SEQ ID NO: 20744 - DNA, 20 bp, Unknown
  RNA secondary structure sequence
ctgcgccggctttcccccac

SEQ ID NO: 20745 - DNA, 20 bp, Unknown
  RNA secondary structure sequence
ttgggacgtgccagcatttc

SEQ ID NO: 20746 - DNA, 20 bp, Unknown
  RNA secondary structure sequence
ccaggaactcacggcagacg

SEQ ID NO: 20747 - DNA, 20 bp, Unknown
  RNA secondary structure sequence
cacggggacctcggttgggc

SEQ ID NO: 20748 - DNA, 20 bp, Unknown
  RNA secondary structure sequence
gcgatgacgtcattagcgag

SEQ ID NO: 20749 - DNA, 20 bp, Unknown
  RNA secondary structure sequence
tgcgcacgccagccgggacg

SEQ ID NO: 20750 - DNA, 20 bp, Unknown
  RNA secondary structure sequence
cgtggacgggacaccggtgt

SEQ ID NO: 20751 - DNA, 20 bp, Unknown
  RNA secondary structure sequence
ggcccgtcgctcggggtgct

SEQ ID NO: 20752 - DNA, 20 bp, Unknown
  RNA secondary structure sequence
ttgcgaacgactagtcgccg

SEQ ID NO: 20753 - DNA, 20 bp, Unknown
  RNA secondary structure sequence
ctacccccacccaaccagcg

SEQ ID NO: 20754 - DNA, 20 bp, Unknown
  RNA secondary structure sequence
gttggaccccgtgcatggac

SEQ ID NO: 20755 - DNA, 20 bp, Unknown
  RNA secondary structure sequence
catcattctcgaggcggctc

SEQ ID NO: 20756 - DNA, 20 bp, Unknown
  RNA secondary structure sequence
ctggggccgcgctcgttcga

SEQ ID NO: 20757 - DNA, 20 bp, Unknown
  RNA secondary structure sequence
cggctacacccccgcgcacc

SEQ ID NO: 20758 - DNA, 20 bp, Unknown
  RNA secondary structure sequence
acacagaggccagcaccagg

SEQ ID NO: 20759 - DNA, 20 bp, Unknown
  RNA secondary structure sequence
ccgcattcgcaccccggcac

SEQ ID NO: 20760 - DNA, 20 bp, Unknown
  RNA secondary structure sequence
gtcggtgtcgctgccgcccg

SEQ ID NO: 20761 - DNA, 20 bp, Unknown
  RNA secondary structure sequence
ccacgccccttccggcaccg

SEQ ID NO: 20762 - DNA, 20 bp, Unknown
  RNA secondary structure sequence
tgctgctgagccctgccccg

SEQ ID NO: 20763 - DNA, 20 bp, Unknown
  RNA secondary structure sequence
gtcgggttgccccttggggt

SEQ ID NO: 20764 - DNA, 20 bp, Unknown
  RNA secondary structure sequence
ttcccgagctcggcttgatg

SEQ ID NO: 20765 - DNA, 20 bp, Unknown
  RNA secondary structure sequence
tgtgtgtagaacccgcgcgg

SEQ ID NO: 20766 - DNA, 20 bp, Unknown
  RNA secondary structure sequence
cagcactactttcggttttg

SEQ ID NO: 20767 - DNA, 20 bp, Unknown
  RNA secondary structure sequence
ccaccccactattccccccc

SEQ ID NO: 20768 - DNA, 20 bp, Unknown
  RNA secondary structure sequence
tcaccccaccccatcctttg

SEQ ID NO: 20769 - DNA, 20 bp, Unknown
  RNA secondary structure sequence
agcgtgggcagctccggatc

SEQ ID NO: 20770 - DNA, 20 bp, Unknown
  RNA secondary structure sequence
acagcccctgggtgtcgacc

SEQ ID NO: 20771 - DNA, 20 bp, Unknown
  RNA secondary structure sequence
ccccccccaaaccttaacta

SEQ ID NO: 20772 - DNA, 20 bp, Unknown
  RNA secondary structure sequence
catctacaccttcaagacgt

SEQ ID NO: 20773 - DNA, 20 bp, Unknown
  RNA secondary structure sequence
tacataacagtagggggtgg

SEQ ID NO: 20774 - DNA, 20 bp, Unknown
  RNA secondary structure sequence
acgcgataccgggtgtgtgg

SEQ ID NO: 20775 - DNA, 20 bp, Unknown
  RNA secondary structure sequence
tcgacagattgttggcgact

SEQ ID NO: 20776 - DNA, 20 bp, Unknown
  RNA secondary structure sequence
ccgctgtttccgttcatcgc

SEQ ID NO: 20777 - DNA, 20 bp, Unknown
  RNA secondary structure sequence
agcgctccgatcggggtcag

SEQ ID NO: 20778 - DNA, 20 bp, Unknown
  RNA secondary structure sequence
tatacagctctgtagagaga

SEQ ID NO: 20779 - DNA, 20 bp, Unknown
  RNA secondary structure sequence
ggtcccccggcccccctaac

SEQ ID NO: 20780 - DNA, 20 bp, Unknown
  RNA secondary structure sequence
ttttatgcgggaacaagggg

SEQ ID NO: 20781 - DNA, 20 bp, Unknown
  RNA secondary structure sequence
taggttgggaggtggcacaa

SEQ ID NO: 20782 - DNA, 20 bp, Unknown
  RNA secondary structure sequence
tccggaagagagcgccccgc

SEQ ID NO: 20783 - DNA, 20 bp, Unknown
  RNA secondary structure sequence
gcctgccaacaccacgtcaa

SEQ ID NO: 20784 - DNA, 20 bp, Unknown
  RNA secondary structure sequence
ggtgagtacgccaaaaattt

SEQ ID NO: 20785 - DNA, 20 bp, Unknown
  RNA secondary structure sequence
tgacataaaagtagtgccaa

SEQ ID NO: 20786 - DNA, 20 bp, Unknown
  RNA secondary structure sequence
gttagccctaggtgtgaata

SEQ ID NO: 20787 - DNA, 20 bp, Unknown
  RNA secondary structure sequence
aagataaagccacctttgcc

SEQ ID NO: 20788 - DNA, 20 bp, Unknown
  RNA secondary structure sequence
gccagtagatcctagactag

SEQ ID NO: 20789 - DNA, 20 bp, Unknown
  RNA secondary structure sequence
catacctagaagaataagac

SEQ ID NO: 20790 - DNA, 20 bp, Unknown
  RNA secondary structure sequence
cattgttcatcagatctagt

SEQ ID NO: 20791 - DNA, 20 bp, Unknown
  RNA secondary structure sequence
ttcaaaattttctacaacat

SEQ ID NO: 20792 - DNA, 20 bp, Unknown
  RNA secondary structure sequence
ccggccccgtcgctcccgtc

SEQ ID NO: 20793 - DNA, 20 bp, Unknown
  RNA secondary structure sequence
ccaggcctaattgtccgcgc

SEQ ID NO: 20794 - DNA, 20 bp, Unknown
  RNA secondary structure sequence
ggttcagttgcacgactccg

SEQ ID NO: 20795 - DNA, 20 bp, Unknown
  RNA secondary structure sequence
catcgcgcccgccctcctcg

SEQ ID NO: 20796 - DNA, 20 bp, Unknown
  RNA secondary structure sequence
tcctgccccattgcgtccgc

SEQ ID NO: 20797 - DNA, 20 bp, Unknown
  RNA secondary structure sequence
agagaagccatcgcgggcgg

SEQ ID NO: 20798 - DNA, 20 bp, Unknown
  RNA secondary structure sequence
catttcctcgtggcgaaccg

SEQ ID NO: 20799 - DNA, 20 bp, Unknown
  RNA secondary structure sequence
gacagcaaccgcctgcacac

SEQ ID NO: 20800 - DNA, 20 bp, Unknown
  RNA secondary structure sequence
tgtgcagccgtgttccaacc

SEQ ID NO: 20801 - DNA, 20 bp, Unknown
  RNA secondary structure sequence
acaaaatccgccggggtgcc

SEQ ID NO: 20802 - DNA, 20 bp, Unknown
  RNA secondary structure sequence
tttaaagcggtggcggcggg

SEQ ID NO: 20803 - DNA, 20 bp, Unknown
  RNA secondary structure sequence
agttccgcgtcgacggcggg

SEQ ID NO: 20804 - DNA, 20 bp, Unknown
  RNA secondary structure sequence
aaatctgcaagtgccccaaa

SEQ ID NO: 20805 - DNA, 20 bp, Unknown
  RNA secondary structure sequence
cgcgcttcgccccagcgccg

SEQ ID NO: 20806 - DNA, 20 bp, Unknown
  RNA secondary structure sequence
gttggcacaaaaagaccccg

SEQ ID NO: 20807 - DNA, 20 bp, Unknown
  RNA secondary structure sequence
aaatacatgcccgggaccca

SEQ ID NO: 20808 - DNA, 20 bp, Unknown
  RNA secondary structure sequence
tggctatccggagaaacagc

SEQ ID NO: 20809 - DNA, 20 bp, Unknown
  RNA secondary structure sequence
cgatcatcagttatccttaa

SEQ ID NO: 20810 - DNA, 20 bp, Unknown
  RNA secondary structure sequence
ttcaggaagccggggagagg

SEQ ID NO: 20811 - DNA, 20 bp, Unknown
  RNA secondary structure sequence
ttgttgggctcccattttac

SEQ ID NO: 20812 - DNA, 20 bp, Unknown
  RNA secondary structure sequence
tgtgggattgcgtggtatgt

SEQ ID NO: 20813 - DNA, 20 bp, Unknown
  RNA secondary structure sequence
cttgggtgtggcacatcgaa

SEQ ID NO: 20814 - DNA, 20 bp, Unknown
  RNA secondary structure sequence
cacccgagtctctgggcgga

SEQ ID NO: 20815 - DNA, 20 bp, Unknown
  RNA secondary structure sequence
cggcggcgaccgttgcgtgg

SEQ ID NO: 20816 - DNA, 20 bp, Unknown
  RNA secondary structure sequence
ggcagcatgggacccacaga

SEQ ID NO: 20817 - DNA, 20 bp, Unknown
  RNA secondary structure sequence
ctcggcactcggagcgagac

SEQ ID NO: 20818 - DNA, 20 bp, Unknown
  RNA secondary structure sequence
agcaaggcgtccattctccc

SEQ ID NO: 20819 - DNA, 20 bp, Unknown
  RNA secondary structure sequence
atccagcgaagcagccgcct

SEQ ID NO: 20820 - DNA, 20 bp, Unknown
  RNA secondary structure sequence
cgagcttaagcctctcctgg

SEQ ID NO: 20821 - DNA, 20 bp, Unknown
  RNA secondary structure sequence
cacccggcggcgcgctcaac

SEQ ID NO: 20822 - DNA, 20 bp, Unknown
  RNA secondary structure sequence
acgcgagactatcagagcac

SEQ ID NO: 20823 - DNA, 20 bp, Unknown
  RNA secondary structure sequence
cgtgatcggggtacttcgcc

SEQ ID NO: 20824 - DNA, 20 bp, Unknown
  RNA secondary structure sequence
ggttttgtcgcaaggtgtcg

SEQ ID NO: 20825 - DNA, 20 bp, Unknown
  RNA secondary structure sequence
actcgggggacccgcatcgc

SEQ ID NO: 20826 - DNA, 20 bp, Unknown
  RNA secondary structure sequence
tttgggtccgggcccgtcgt

SEQ ID NO: 20827 - DNA, 20 bp, Unknown
  RNA secondary structure sequence
ctccccgggccaatatcgct

SEQ ID NO: 20828 - DNA, 20 bp, Unknown
  RNA secondary structure sequence
tatcaaaacactcgcctccg

SEQ ID NO: 20829 - DNA, 20 bp, Unknown
  RNA secondary structure sequence
aagcgaccctttgcggtttc

SEQ ID NO: 20830 - DNA, 20 bp, Unknown
  RNA secondary structure sequence
cgcacgaggacgagtccgcg

SEQ ID NO: 20831 - DNA, 20 bp, Unknown
  RNA secondary structure sequence
acatccaccgtagggggcct

SEQ ID NO: 20832 - DNA, 20 bp, Unknown
  RNA secondary structure sequence
caatacgcccgcgtttcttc

SEQ ID NO: 20833 - DNA, 20 bp, Unknown
  RNA secondary structure sequence
agccctgccatagccacggg

SEQ ID NO: 20834 - DNA, 20 bp, Unknown
  RNA secondary structure sequence
gcgtgaaactcccgcacctc

SEQ ID NO: 20835 - DNA, 20 bp, Unknown
  RNA secondary structure sequence
gccagacgcgggtccgctgt

SEQ ID NO: 20836 - DNA, 20 bp, Unknown
  RNA secondary structure sequence
ccggcggttggcgtgaacgc

SEQ ID NO: 20837 - DNA, 20 bp, Unknown
  RNA secondary structure sequence
caaccccggtctccaaccct

SEQ ID NO: 20838 - DNA, 20 bp, Unknown
  RNA secondary structure sequence
cgtcgtgccgggattacctc

SEQ ID NO: 20839 - DNA, 20 bp, Unknown
  RNA secondary structure sequence
gagcctcgttaagagccagg

SEQ ID NO: 20840 - DNA, 20 bp, Unknown
  RNA secondary structure sequence
ccctttggtgggtttacgcg

SEQ ID NO: 20841 - DNA, 20 bp, Unknown
  RNA secondary structure sequence
gccctcccgaccgacacccc

SEQ ID NO: 20842 - DNA, 20 bp, Unknown
  RNA secondary structure sequence
ctcgcaacgcctgcgggggt

SEQ ID NO: 20843 - DNA, 20 bp, Unknown
  RNA secondary structure sequence
tctcgtcgttggtctacgct

SEQ ID NO: 20844 - DNA, 20 bp, Unknown
  RNA secondary structure sequence
ctgctctcgcctactcttct

SEQ ID NO: 20845 - DNA, 20 bp, Unknown
  RNA secondary structure sequence
gccgacgtcccctctcgagc

SEQ ID NO: 20846 - DNA, 20 bp, Unknown
  RNA secondary structure sequence
aggcccgccgccactgtcgt

SEQ ID NO: 20847 - DNA, 20 bp, Unknown
  RNA secondary structure sequence
ctaacggattattgtcctct

SEQ ID NO: 20848 - DNA, 20 bp, Unknown
  RNA secondary structure sequence
ccaaccacgccttagttagg

SEQ ID NO: 20849 - DNA, 20 bp, Unknown
  RNA secondary structure sequence
cctggctgccatcaaaaccc

SEQ ID NO: 20850 - DNA, 20 bp, Unknown
  RNA secondary structure sequence
accgaagcccacctcgtcac

SEQ ID NO: 20851 - DNA, 20 bp, Unknown
  RNA secondary structure sequence
ctatcccgcccaccgctggg

SEQ ID NO: 20852 - DNA, 20 bp, Unknown
  RNA secondary structure sequence
ggagcaaaacgcctccccct

SEQ ID NO: 20853 - DNA, 20 bp, Unknown
  RNA secondary structure sequence
acctaccaacggaacgtctg

SEQ ID NO: 20854 - DNA, 20 bp, Unknown
  RNA secondary structure sequence
tacaaactccctggtcttac

SEQ ID NO: 20855 - DNA, 20 bp, Unknown
  RNA secondary structure sequence
aacaagtgggggctcgtccg

SEQ ID NO: 20856 - DNA, 20 bp, Unknown
  RNA secondary structure sequence
ttctgtgttgtctctgtttg

SEQ ID NO: 20857 - DNA, 20 bp, Unknown
  RNA secondary structure sequence
caacctcgtcacggagaatc

SEQ ID NO: 20858 - DNA, 20 bp, Unknown
  RNA secondary structure sequence
tacttccggtattaagccct

SEQ ID NO: 20859 - DNA, 20 bp, Unknown
  RNA secondary structure sequence
actaaagattggagaaggtc

SEQ ID NO: 20860 - DNA, 20 bp, Unknown
  RNA secondary structure sequence
aaggctcttgcttactatcc

SEQ ID NO: 20861 - DNA, 20 bp, Unknown
  RNA secondary structure sequence
cagccggggtcccgcccccg

SEQ ID NO: 20862 - DNA, 20 bp, Unknown
  RNA secondary structure sequence
ccacagtgtgagattaacat

SEQ ID NO: 20863 - DNA, 20 bp, Unknown
  RNA secondary structure sequence
tcgttgtgggcatcgttgga

SEQ ID NO: 20864 - DNA, 20 bp, Unknown
  RNA secondary structure sequence
gggataatacttatcatttt

SEQ ID NO: 20865 - DNA, 20 bp, Unknown
  RNA secondary structure sequence
agcaagggagaaacacgtgg

SEQ ID NO: 20866 - DNA, 20 bp, Unknown
  RNA secondary structure sequence
tagggatggccgaaaggcag

SEQ ID NO: 20867 - DNA, 20 bp, Unknown
  RNA secondary structure sequence
tactattgagttcgcccgct

SEQ ID NO: 20868 - DNA, 20 bp, Unknown
  RNA secondary structure sequence
cattcactttgcagtttgtt

SEQ ID NO: 20869 - DNA, 20 bp, Unknown
  RNA secondary structure sequence
acgagtgaggtcgacgtcat

SEQ ID NO: 20870 - DNA, 20 bp, Unknown
  RNA secondary structure sequence
acaagcctccccccaggccc

SEQ ID NO: 20871 - DNA, 20 bp, Unknown
  RNA secondary structure sequence
atcctcctctctacaccaac

SEQ ID NO: 20872 - DNA, 20 bp, Unknown
  RNA secondary structure sequence
attaaggcctaagtggagga

SEQ ID NO: 20873 - DNA, 20 bp, Unknown
  RNA secondary structure sequence
gaaatctgtgagtattgaca

SEQ ID NO: 20874 - DNA, 20 bp, Unknown
  RNA secondary structure sequence
tacgtcacaggagagcatac

SEQ ID NO: 20875 - DNA, 20 bp, Unknown
  RNA secondary structure sequence
agacacctagggatggaaga

SEQ ID NO: 20876 - DNA, 20 bp, Unknown
  RNA secondary structure sequence
taccgtaacaatccctcacc

SEQ ID NO: 20877 - DNA, 20 bp, Unknown
  RNA secondary structure sequence
ttctggaaagcctctgtgtc

SEQ ID NO: 20878 - DNA, 20 bp, Unknown
  RNA secondary structure sequence
acagtgacaattggtcttgg

SEQ ID NO: 20879 - DNA, 20 bp, Unknown
  RNA secondary structure sequence
attaaacagtgtctcaggtt

SEQ ID NO: 20880 - DNA, 20 bp, Unknown
  RNA secondary structure sequence
agacaatcattcagccccgt

SEQ ID NO: 20881 - DNA, 20 bp, Unknown
  RNA secondary structure sequence
ctgaaagtggtcaggattga

SEQ ID NO: 20882 - DNA, 20 bp, Unknown
  RNA secondary structure sequence
taattgtctacgggtagttt

SEQ ID NO: 20883 - DNA, 20 bp, Unknown
  RNA secondary structure sequence
gtcctcctgaccacccccac

SEQ ID NO: 20884 - DNA, 20 bp, Unknown
  RNA secondary structure sequence
accaatcaagacctctcgga

SEQ ID NO: 20885 - DNA, 20 bp, Unknown
  RNA secondary structure sequence
ctggccggcgaccatacctg

SEQ ID NO: 20886 - DNA, 20 bp, Unknown
  RNA secondary structure sequence
cctcggattgtggacaggag

SEQ ID NO: 20887 - DNA, 20 bp, Unknown
  RNA secondary structure sequence
gctagcagtgaaaatgctaa

SEQ ID NO: 20888 - DNA, 20 bp, Unknown
  RNA secondary structure sequence
ggggctagctcgggtccaca

SEQ ID NO: 20889 - DNA, 20 bp, Unknown
  RNA secondary structure sequence
aaacctactggtcctgttat

SEQ ID NO: 20890 - DNA, 20 bp, Unknown
  RNA secondary structure sequence
tgctataagcacaactttcc

SEQ ID NO: 20891 - DNA, 20 bp, Unknown
  RNA secondary structure sequence
atcgagttgctaggcaataa

SEQ ID NO: 20892 - DNA, 20 bp, Unknown
  RNA secondary structure sequence
atgcccacggcacatcttaa

SEQ ID NO: 20893 - DNA, 20 bp, Unknown
  RNA secondary structure sequence
gaggacgtatcggaaactct

SEQ ID NO: 20894 - DNA, 20 bp, Unknown
  RNA secondary structure sequence
cgagcaggatctccattttg

SEQ ID NO: 20895 - DNA, 20 bp, Unknown
  RNA secondary structure sequence
cctcacctttcattgtcgat

SEQ ID NO: 20896 - DNA, 20 bp, Unknown
  RNA secondary structure sequence
acatcataagaagcgccata

SEQ ID NO: 20897 - DNA, 20 bp, Unknown
  RNA secondary structure sequence
cacagaaccccagctgctat

SEQ ID NO: 20898 - DNA, 20 bp, Unknown
  RNA secondary structure sequence
agcgaccgaacggaccatat

SEQ ID NO: 20899 - DNA, 20 bp, Unknown
  RNA secondary structure sequence
ggcatagttgttatcgttct

SEQ ID NO: 20900 - DNA, 20 bp, Unknown
  RNA secondary structure sequence
acacaattgcctacctgctt

SEQ ID NO: 20901 - DNA, 20 bp, Unknown
  RNA secondary structure sequence
ctcgaagcttattgtcttca

SEQ ID NO: 20902 - DNA, 20 bp, Unknown
  RNA secondary structure sequence
agattaagccgacagtgagc

SEQ ID NO: 20903 - DNA, 20 bp, Unknown
  RNA secondary structure sequence
taaccaaaataaactccact

SEQ ID NO: 20904 - DNA, 20 bp, Unknown
  RNA secondary structure sequence
gggaaagaagcctttttatt

SEQ ID NO: 20905 - DNA, 20 bp, Unknown
  RNA secondary structure sequence
gtgtggaagcaaagttctgt

SEQ ID NO: 20906 - DNA, 20 bp, Unknown
  RNA secondary structure sequence
acaaacacttttggtcttgg

SEQ ID NO: 20907 - DNA, 20 bp, Unknown
  RNA secondary structure sequence
tactatatgtgtctcctata

SEQ ID NO: 20908 - DNA, 20 bp, Unknown
  RNA secondary structure sequence
ttctccagttacggagcgag

SEQ ID NO: 20909 - DNA, 20 bp, Unknown
  RNA secondary structure sequence
atgggcgcggacctgcactg

SEQ ID NO: 20910 - DNA, 20 bp, Unknown
  RNA secondary structure sequence
gagggcgagtacctggaaga

SEQ ID NO: 20911 - DNA, 20 bp, Unknown
  RNA secondary structure sequence
gtggtggtggtaacccgttc

SEQ ID NO: 20912 - DNA, 20 bp, Unknown
  RNA secondary structure sequence
ggccatggcgaccagcgtgc

SEQ ID NO: 20913 - DNA, 20 bp, Unknown
  RNA secondary structure sequence
aggtgatgtcagtatttata

SEQ ID NO: 20914 - DNA, 20 bp, Unknown
  RNA secondary structure sequence
agatgttcacttcgcgatgt

SEQ ID NO: 20915 - DNA, 20 bp, Unknown
  RNA secondary structure sequence
ctaccacccgagcattacca

SEQ ID NO: 20916 - DNA, 20 bp, Unknown
  RNA secondary structure sequence
gaatggactctgacgctcct

SEQ ID NO: 20917 - DNA, 20 bp, Unknown
  RNA secondary structure sequence
gagtgtgaagcgccgccgct

SEQ ID NO: 20918 - DNA, 20 bp, Unknown
  RNA secondary structure sequence
tgtccagaaggaggagtgaa

SEQ ID NO: 20919 - DNA, 20 bp, Unknown
  RNA secondary structure sequence
tcagccggtaacgccaccac

SEQ ID NO: 20920 - DNA, 20 bp, Unknown
  RNA secondary structure sequence
ttcctccgcggccggccatt

SEQ ID NO: 20921 - DNA, 20 bp, Unknown
  RNA secondary structure sequence
cagcgcacgcttgaggacgc

SEQ ID NO: 20922 - DNA, 20 bp, Unknown
  RNA secondary structure sequence
tcccgaacttcgatgccatc

SEQ ID NO: 20923 - DNA, 20 bp, Unknown
  RNA secondary structure sequence
agtgcggatcgtcgtcgaag

SEQ ID NO: 20924 - DNA, 20 bp, Unknown
  RNA secondary structure sequence
cgtcggtgtgctttgtgggt

SEQ ID NO: 20925 - DNA, 20 bp, Unknown
  RNA secondary structure sequence
ttcatcttctgccgccgcat

SEQ ID NO: 20926 - DNA, 20 bp, Unknown
  RNA secondary structure sequence
ggtctaaggaatcttctctt

SEQ ID NO: 20927 - DNA, 20 bp, Unknown
  RNA secondary structure sequence
taccgcgaccaaagagtggc

SEQ ID NO: 20928 - DNA, 20 bp, Unknown
  RNA secondary structure sequence
ggaatccatctgaagagacg

SEQ ID NO: 20929 - DNA, 20 bp, Unknown
  RNA secondary structure sequence
catcatccacccgcgcgcgc

SEQ ID NO: 20930 - DNA, 20 bp, Unknown
  RNA secondary structure sequence
tgtcaaattcctcctgtccc

SEQ ID NO: 20931 - DNA, 20 bp, Unknown
  RNA secondary structure sequence
gacctgcattttgaagtgtt

SEQ ID NO: 20932 - DNA, 20 bp, Unknown
  RNA secondary structure sequence
aggggcagaatgattaaaat

SEQ ID NO: 20933 - DNA, 20 bp, Unknown
  RNA secondary structure sequence
aaaaatttcggagaagatat

SEQ ID NO: 20934 - DNA, 20 bp, Unknown
  RNA secondary structure sequence
cgtgttggcgggtattttta

SEQ ID NO: 20935 - DNA, 20 bp, Unknown
  RNA secondary structure sequence
agctcagctttttctctgac

SEQ ID NO: 20936 - DNA, 20 bp, Unknown
  RNA secondary structure sequence
acggggacacggacagcctc

SEQ ID NO: 20937 - DNA, 20 bp, Unknown
  RNA secondary structure sequence
agggcgagctcaacgagccg

SEQ ID NO: 20938 - DNA, 20 bp, Unknown
  RNA secondary structure sequence
gtgtaggtttccacatcgta

SEQ ID NO: 20939 - DNA, 20 bp, Unknown
  RNA secondary structure sequence
ggtggaagccatctctggat

SEQ ID NO: 20940 - DNA, 20 bp, Unknown
  RNA secondary structure sequence
gagattacccagctcggagt

SEQ ID NO: 20941 - DNA, 20 bp, Unknown
  RNA secondary structure sequence
tccgggatcgatcacctctc

SEQ ID NO: 20942 - DNA, 20 bp, Unknown
  RNA secondary structure sequence
gatcattctctatctctatt

SEQ ID NO: 20943 - DNA, 20 bp, Unknown
  RNA secondary structure sequence
agacagatcccaaaatcata

SEQ ID NO: 20944 - DNA, 20 bp, Unknown
  RNA secondary structure sequence
actaaacgttccacaataaa

SEQ ID NO: 20945 - DNA, 20 bp, Unknown
  RNA secondary structure sequence
cagtggatacctcagcatcc

SEQ ID NO: 20946 - DNA, 20 bp, Unknown
  RNA secondary structure sequence
tcctgaagccgaaggagagg

SEQ ID NO: 20947 - DNA, 20 bp, Unknown
  RNA secondary structure sequence
gtacattgtagcatacatac

SEQ ID NO: 20948 - DNA, 20 bp, Unknown
  RNA secondary structure sequence
ccagtcgttttgacagttgg

SEQ ID NO: 20949 - DNA, 20 bp, Unknown
  RNA secondary structure sequence
cccaaaggagaccacctcag

SEQ ID NO: 20950 - DNA, 20 bp, Unknown
  RNA secondary structure sequence
gaggcccacgaataggctag

SEQ ID NO: 20951 - DNA, 20 bp, Unknown
  RNA secondary structure sequence
tgtgttgagaaaaagacagc

SEQ ID NO: 20952 - DNA, 20 bp, Unknown
  RNA secondary structure sequence
cgtgaacgtgttgagaaaaa

SEQ ID NO: 20953 - DNA, 20 bp, Unknown
  RNA secondary structure sequence
aactagtctatgaccagacg

SEQ ID NO: 20954 - DNA, 20 bp, Unknown
  RNA secondary structure sequence
agtatgaaagctactctcag

SEQ ID NO: 20955 - DNA, 20 bp, Unknown
  RNA secondary structure sequence
gatctggggtatcacattcc

SEQ ID NO: 20956 - DNA, 20 bp, Unknown
  RNA secondary structure sequence
taagcgactatggatctgat

SEQ ID NO: 20957 - DNA, 20 bp, Unknown
  RNA secondary structure sequence
ccccccacagggatgtgggg

SEQ ID NO: 20958 - DNA, 20 bp, Unknown
  RNA secondary structure sequence
ggaacctttgtggctcctct

SEQ ID NO: 20959 - DNA, 20 bp, Unknown
  RNA secondary structure sequence
aggggcctatattttcctgc

SEQ ID NO: 20960 - DNA, 20 bp, Unknown
  RNA secondary structure sequence
tttgtactaggaggctgtag

SEQ ID NO: 20961 - DNA, 20 bp, Unknown
  RNA secondary structure sequence
tgcagttaatcattacttca

SEQ ID NO: 20962 - DNA, 20 bp, Unknown
  RNA secondary structure sequence
tggggtggagccctcaggct

SEQ ID NO: 20963 - DNA, 20 bp, Unknown
  RNA secondary structure sequence
gaagaatgtcctgaaggcaa

SEQ ID NO: 20964 - DNA, 20 bp, Unknown
  RNA secondary structure sequence
aagcagcagcagaaacgcgg

SEQ ID NO: 20965 - DNA, 20 bp, Unknown
  RNA secondary structure sequence
tcgacgcggggtcaaaaact

SEQ ID NO: 20966 - DNA, 20 bp, Unknown
  RNA secondary structure sequence
ttgcatatccctaggcacct

SEQ ID NO: 20967 - DNA, 20 bp, Unknown
  RNA secondary structure sequence
gtcgcggctggccgcctgta

SEQ ID NO: 20968 - DNA, 20 bp, Unknown
  RNA secondary structure sequence
tacctttcctaatgcatttc

SEQ ID NO: 20969 - DNA, 20 bp, Unknown
  RNA secondary structure sequence
tggccatgtggaccatgcag

SEQ ID NO: 20970 - DNA, 20 bp, Unknown
  RNA secondary structure sequence
tgggaacactggcacctggg

SEQ ID NO: 20971 - DNA, 20 bp, Unknown
  RNA secondary structure sequence
gggtttgtgggtgtcataca

SEQ ID NO: 20972 - DNA, 20 bp, Unknown
  RNA secondary structure sequence
tttgtatttttcattttttt

SEQ ID NO: 20973 - DNA, 20 bp, Unknown
  RNA secondary structure sequence
aggtttgctacctaaaaaac

SEQ ID NO: 20974 - DNA, 20 bp, Unknown
  RNA secondary structure sequence
gtggtaacaagttgttgtag

SEQ ID NO: 20975 - DNA, 20 bp, Unknown
  RNA secondary structure sequence
agttgaaaccttggtttccg

SEQ ID NO: 20976 - DNA, 20 bp, Unknown
  RNA secondary structure sequence
gacagtcaaaatgattatga

SEQ ID NO: 20977 - DNA, 20 bp, Unknown
  RNA secondary structure sequence
ctcaagaaaagaaactgggc

SEQ ID NO: 20978 - DNA, 20 bp, Unknown
  RNA secondary structure sequence
ccaataatatcgtacatctt

SEQ ID NO: 20979 - DNA, 20 bp, Unknown
  RNA secondary structure sequence
attaaggcgacaacgagccg

SEQ ID NO: 20980 - DNA, 20 bp, Unknown
  RNA secondary structure sequence
gagattgtaggtagaaagga

SEQ ID NO: 20981 - DNA, 20 bp, Unknown
  RNA secondary structure sequence
aagatggatcctgtatctgt

SEQ ID NO: 20982 - DNA, 20 bp, Unknown
  RNA secondary structure sequence
gtttaagagttgacaaggtc

SEQ ID NO: 20983 - DNA, 20 bp, Unknown
  RNA secondary structure sequence
gcaagcgtatagttcgggat

SEQ ID NO: 20984 - DNA, 20 bp, Unknown
  RNA secondary structure sequence
ttgtaaaaaatgtgcttacc

SEQ ID NO: 20985 - DNA, 20 bp, Unknown
  RNA secondary structure sequence
aaaatgaaacagggtttcaa

SEQ ID NO: 20986 - DNA, 20 bp, Unknown
  RNA secondary structure sequence
tactactttagttcaatatg

SEQ ID NO: 20987 - DNA, 20 bp, Unknown
  RNA secondary structure sequence
tgtctttaattgcctcttgt

SEQ ID NO: 20988 - DNA, 20 bp, Unknown
  RNA secondary structure sequence
tccgaatgtcctattttgat

SEQ ID NO: 20989 - DNA, 20 bp, Unknown
  RNA secondary structure sequence
aagctcctttggttgttcgc

SEQ ID NO: 20990 - DNA, 20 bp, Unknown
  RNA secondary structure sequence
gaaatcacagagtatcattt

SEQ ID NO: 20991 - DNA, 20 bp, Unknown
  RNA secondary structure sequence
tgtggagatctaggacacat

SEQ ID NO: 20992 - DNA, 20 bp, Unknown
  RNA secondary structure sequence
agctatgcaaagtatagata

SEQ ID NO: 20993 - DNA, 20 bp, Unknown
  RNA secondary structure sequence
tgagtttgtaaataagtttc

SEQ ID NO: 20994 - DNA, 20 bp, Unknown
  RNA secondary structure sequence
tgagggacatttggactatc

SEQ ID NO: 20995 - DNA, 20 bp, Unknown
  RNA secondary structure sequence
agagttagaggagcttggaa

SEQ ID NO: 20996 - DNA, 20 bp, Unknown
  RNA secondary structure sequence
ctacaagatagtttcctcgt

SEQ ID NO: 20997 - DNA, 20 bp, Unknown
  RNA secondary structure sequence
ttattaacctctatatttct

SEQ ID NO: 20998 - DNA, 20 bp, Unknown
  RNA secondary structure sequence
tggcgtcgcaaggcaccaaa

SEQ ID NO: 20999 - DNA, 20 bp, Unknown
  RNA secondary structure sequence
tctaaccgaggtcgaaacgt

SEQ ID NO: 21000 - DNA, 20 bp, Unknown
  RNA secondary structure sequence
caacctggccatcgggctgc

SEQ ID NO: 21001 - DNA, 20 bp, Unknown
  RNA secondary structure sequence
gcaggtggcgcccaacgtgg

SEQ ID NO: 21002 - DNA, 20 bp, Unknown
  RNA secondary structure sequence
agtaaaatgggtgtctattt

SEQ ID NO: 21003 - DNA, 20 bp, Unknown
  RNA secondary structure sequence
ggtaaacagcatcaaggtat

SEQ ID NO: 21004 - DNA, 20 bp, Unknown
  RNA secondary structure sequence
caatctgtggtatggaccag

SEQ ID NO: 21005 - DNA, 20 bp, Unknown
  RNA secondary structure sequence
gctaaccaatttaatttggt

SEQ ID NO: 21006 - DNA, 20 bp, Unknown
  RNA secondary structure sequence
ctaaccaatttaatttggtg

SEQ ID NO: 21007 - DNA, 20 bp, Unknown
  RNA secondary structure sequence
tgagtaaaattttaaacaca

SEQ ID NO: 21008 - DNA, 20 bp, Unknown
  RNA secondary structure sequence
cagtaaatgaaataaaaagc

SEQ ID NO: 21009 - DNA, 20 bp, Unknown
  RNA secondary structure sequence
agacttgctgctagaagaac

SEQ ID NO: 21010 - DNA, 20 bp, Unknown
  RNA secondary structure sequence
atacacatcctggcagttca

SEQ ID NO: 21011 - DNA, 20 bp, Unknown
  RNA secondary structure sequence
gaagttatatacactgagcc

SEQ ID NO: 21012 - DNA, 20 bp, Unknown
  RNA secondary structure sequence
gtggataatgttactaggct

SEQ ID NO: 21013 - DNA, 20 bp, Unknown
  RNA secondary structure sequence
aaaccaccagtccttgatgt

SEQ ID NO: 21014 - DNA, 20 bp, Unknown
  RNA secondary structure sequence
ttgacaggataagcgatact

SEQ ID NO: 21015 - DNA, 20 bp, Unknown
  RNA secondary structure sequence
aataatggtcgttttggtgg

SEQ ID NO: 21016 - DNA, 20 bp, Unknown
  RNA secondary structure sequence
aagtgttgtattttctgtgt

SEQ ID NO: 21017 - DNA, 20 bp, Unknown
  RNA secondary structure sequence
gatctgtctgctgagggtag

SEQ ID NO: 21018 - DNA, 20 bp, Unknown
  RNA secondary structure sequence
cgcgagacctggtgtttgac

SEQ ID NO: 21019 - DNA, 20 bp, Unknown
  RNA secondary structure sequence
gagtcgattcggtcggttaa

SEQ ID NO: 21020 - DNA, 20 bp, Unknown
  RNA secondary structure sequence
cgggagactaggtcgtcttg

SEQ ID NO: 21021 - DNA, 20 bp, Unknown
  RNA secondary structure sequence
aaccaaaccacaaggcagac

SEQ ID NO: 21022 - DNA, 20 bp, Unknown
  RNA secondary structure sequence
aaccaccacctggatcacgc

SEQ ID NO: 21023 - DNA, 20 bp, Unknown
  RNA secondary structure sequence
agtctggagcgtagtgccta

SEQ ID NO: 21024 - DNA, 20 bp, Unknown
  RNA secondary structure sequence
cgacttgtgtaccgattctg

SEQ ID NO: 21025 - DNA, 20 bp, Unknown
  RNA secondary structure sequence
tcggagagggtatattcgtt

SEQ ID NO: 21026 - DNA, 20 bp, Unknown
  RNA secondary structure sequence
cctcttcgtccccgtcgcct

SEQ ID NO: 21027 - DNA, 20 bp, Unknown
  RNA secondary structure sequence
gacacgcaacttttggccgc

SEQ ID NO: 21028 - DNA, 20 bp, Unknown
  RNA secondary structure sequence
gttcacctttgcgcatcccc

SEQ ID NO: 21029 - DNA, 20 bp, Unknown
  RNA secondary structure sequence
acactcaataatccgcggtt

SEQ ID NO: 21030 - DNA, 20 bp, Unknown
  RNA secondary structure sequence
accgcaggttagcggcgagt

SEQ ID NO: 21031 - DNA, 20 bp, Unknown
  RNA secondary structure sequence
gttcgtctccgcttctcctc

SEQ ID NO: 21032 - DNA, 20 bp, Unknown
  RNA secondary structure sequence
gctgctttccccgagctccg

SEQ ID NO: 21033 - DNA, 20 bp, Unknown
  RNA secondary structure sequence
gccacatcgggcctgtgttc

SEQ ID NO: 21034 - DNA, 20 bp, Unknown
  RNA secondary structure sequence
gacggcagttctgaacccac

SEQ ID NO: 21035 - DNA, 20 bp, Unknown
  RNA secondary structure sequence
cgcccgtcccacaagccacg

SEQ ID NO: 21036 - DNA, 20 bp, Unknown
  RNA secondary structure sequence
gtggagtgcgtcaacgacat

SEQ ID NO: 21037 - DNA, 20 bp, Unknown
  RNA secondary structure sequence
ccactatcagtgcaatattt

SEQ ID NO: 21038 - DNA, 20 bp, Unknown
  RNA secondary structure sequence
tcatctggtagcgcttgcgg

SEQ ID NO: 21039 - DNA, 20 bp, Unknown
  RNA secondary structure sequence
aggaccttgacggtgactgc

SEQ ID NO: 21040 - DNA, 20 bp, Unknown
  RNA secondary structure sequence
ttccactgcgaccacatccc

SEQ ID NO: 21041 - DNA, 20 bp, Unknown
  RNA secondary structure sequence
ttagaccgttggagtcgcga

SEQ ID NO: 21042 - DNA, 20 bp, Unknown
  RNA secondary structure sequence
ccgcgcgcccccatcgcctc

SEQ ID NO: 21043 - DNA, 20 bp, Unknown
  RNA secondary structure sequence
gccgatgacgacaggctcgc

SEQ ID NO: 21044 - DNA, 20 bp, Unknown
  RNA secondary structure sequence
ctatcaacgtcttgtcgcta

SEQ ID NO: 21045 - DNA, 20 bp, Unknown
  RNA secondary structure sequence
agtctgaaacggggtgggag

SEQ ID NO: 21046 - DNA, 20 bp, Unknown
  RNA secondary structure sequence
ggcagacgaggagcggcgcg

SEQ ID NO: 21047 - DNA, 20 bp, Unknown
  RNA secondary structure sequence
gcacgcgcgtgccgccggcc

SEQ ID NO: 21048 - DNA, 20 bp, Unknown
  RNA secondary structure sequence
tgcacactccgtagagcagc

SEQ ID NO: 21049 - DNA, 20 bp, Unknown
  RNA secondary structure sequence
cctgggacgcgcagttgggc

SEQ ID NO: 21050 - DNA, 20 bp, Unknown
  RNA secondary structure sequence
gggtgttgctaggcgggctg

SEQ ID NO: 21051 - DNA, 20 bp, Unknown
  RNA secondary structure sequence
gcccgagctgaagcagacgc

SEQ ID NO: 21052 - DNA, 20 bp, Unknown
  RNA secondary structure sequence
cgccaactggctccttaccg

SEQ ID NO: 21053 - DNA, 20 bp, Unknown
  RNA secondary structure sequence
accctgtgcgcttccatcgt

SEQ ID NO: 21054 - DNA, 20 bp, Unknown
  RNA secondary structure sequence
cacttgccgctgtacaacga

SEQ ID NO: 21055 - DNA, 20 bp, Unknown
  RNA secondary structure sequence
tcagcctctgtgttcccaac

SEQ ID NO: 21056 - DNA, 20 bp, Unknown
  RNA secondary structure sequence
tcctgccacatatagctcgt

SEQ ID NO: 21057 - DNA, 20 bp, Unknown
  RNA secondary structure sequence
gtttaataaaagtagctttt

SEQ ID NO: 21058 - DNA, 20 bp, Unknown
  RNA secondary structure sequence
agacgtcagaaccgtcgcgg

SEQ ID NO: 21059 - DNA, 20 bp, Unknown
  RNA secondary structure sequence
gatggcggcgatatgggctc

SEQ ID NO: 21060 - DNA, 20 bp, Unknown
  RNA secondary structure sequence
cgtcgttcgcggacatagca

SEQ ID NO: 21061 - DNA, 20 bp, Unknown
  RNA secondary structure sequence
atgagtcgggcggtggccgg

SEQ ID NO: 21062 - DNA, 20 bp, Unknown
  RNA secondary structure sequence
gaacaacgcatttacgacgt

SEQ ID NO: 21063 - DNA, 20 bp, Unknown
  RNA secondary structure sequence
atgttaatgtaacaagacaa

SEQ ID NO: 21064 - DNA, 20 bp, Unknown
  RNA secondary structure sequence
ataagagcccggtgctatcg

SEQ ID NO: 21065 - DNA, 20 bp, Unknown
  RNA secondary structure sequence
cgtaggtggactttgtagta

SEQ ID NO: 21066 - DNA, 20 bp, Unknown
  RNA secondary structure sequence
gacaccgttcggccccatga

SEQ ID NO: 21067 - DNA, 20 bp, Unknown
  RNA secondary structure sequence
gttgcgggcatcccgggcga

SEQ ID NO: 21068 - DNA, 20 bp, Unknown
  RNA secondary structure sequence
gaacaggcgggcagcgtctc

SEQ ID NO: 21069 - DNA, 20 bp, Unknown
  RNA secondary structure sequence
acagtccctacggaacctga

SEQ ID NO: 21070 - DNA, 20 bp, Unknown
  RNA secondary structure sequence
tgcagagcgtcatgaaggac

SEQ ID NO: 21071 - DNA, 20 bp, Unknown
  RNA secondary structure sequence
acacgccttccctctttttc

SEQ ID NO: 21072 - DNA, 20 bp, Unknown
  RNA secondary structure sequence
tctccttcctcagtgtttgg

SEQ ID NO: 21073 - DNA, 20 bp, Unknown
  RNA secondary structure sequence
tttaagtcacggaggaagtt

SEQ ID NO: 21074 - DNA, 20 bp, Unknown
  RNA secondary structure sequence
tagacccacgcagatagcca

SEQ ID NO: 21075 - DNA, 20 bp, Unknown
  RNA secondary structure sequence
ctttcgcggcggacacgggg

SEQ ID NO: 21076 - DNA, 20 bp, Unknown
  RNA secondary structure sequence
ttaacgtcttcatccccccg

SEQ ID NO: 21077 - DNA, 20 bp, Unknown
  RNA secondary structure sequence
tcaacagcagacgttgtggg

SEQ ID NO: 21078 - DNA, 20 bp, Unknown
  RNA secondary structure sequence
tttgtgttgcttttagcagc

SEQ ID NO: 21079 - DNA, 20 bp, Unknown
  RNA secondary structure sequence
cgcgggtttgcttcctatat

SEQ ID NO: 21080 - DNA, 20 bp, Unknown
  RNA secondary structure sequence
tgattcccttcataaagctg

SEQ ID NO: 21081 - DNA, 20 bp, Unknown
  RNA secondary structure sequence
tgcggccttagcggctcggg

SEQ ID NO: 21082 - DNA, 20 bp, Unknown
  RNA secondary structure sequence
aggaggtgacctggctgctt

SEQ ID NO: 21083 - DNA, 20 bp, Unknown
  RNA secondary structure sequence
gtaggggaaacaacgtcacc

SEQ ID NO: 21084 - DNA, 20 bp, Unknown
  RNA secondary structure sequence
gaaaaacacgacgaaagcgt

SEQ ID NO: 21085 - DNA, 20 bp, Unknown
  RNA secondary structure sequence
atataatcgccgtttcgtaa

SEQ ID NO: 21086 - DNA, 20 bp, Unknown
  RNA secondary structure sequence
tgtatgtgaaaggttggctg

SEQ ID NO: 21087 - DNA, 20 bp, Unknown
  RNA secondary structure sequence
agtcgctcggaaacgactca

SEQ ID NO: 21088 - DNA, 20 bp, Unknown
  RNA secondary structure sequence
cagcttttgagtctagacag

SEQ ID NO: 21089 - DNA, 20 bp, Unknown
  RNA secondary structure sequence
gaccgtctttgccgccttca

SEQ ID NO: 21090 - DNA, 20 bp, Unknown
  RNA secondary structure sequence
gacaacggcacgctcagcgt

SEQ ID NO: 21091 - DNA, 20 bp, Unknown
  RNA secondary structure sequence
actccaccgagacgctcacc

SEQ ID NO: 21092 - DNA, 20 bp, Unknown
  RNA secondary structure sequence
ctcagcctggttttcactct

SEQ ID NO: 21093 - DNA, 20 bp, Unknown
  RNA secondary structure sequence
tagcttcgagaccttgcgga

SEQ ID NO: 21094 - DNA, 20 bp, Unknown
  RNA secondary structure sequence
aactggttttcggacagagc

SEQ ID NO: 21095 - DNA, 20 bp, Unknown
  RNA secondary structure sequence
tcaacaataaagctttttca

SEQ ID NO: 21096 - DNA, 20 bp, Unknown
  RNA secondary structure sequence
cgggtcggatacagggtgcc

SEQ ID NO: 21097 - DNA, 20 bp, Unknown
  RNA secondary structure sequence
atgcctataaaaccgcgccc

SEQ ID NO: 21098 - DNA, 20 bp, Unknown
  RNA secondary structure sequence
agcggcgtcgccccagttcg

SEQ ID NO: 21099 - DNA, 20 bp, Unknown
  RNA secondary structure sequence
cgcgcagcgcgctttatccg

SEQ ID NO: 21100 - DNA, 20 bp, Unknown
  RNA secondary structure sequence
tttctctgcttcttttctgg

SEQ ID NO: 21101 - DNA, 20 bp, Unknown
  RNA secondary structure sequence
cgtcgatgtcagtcttttcg

SEQ ID NO: 21102 - DNA, 20 bp, Unknown
  RNA secondary structure sequence
ccgaatcgtaccggcgtctg

SEQ ID NO: 21103 - DNA, 20 bp, Unknown
  RNA secondary structure sequence
acaaaccccgtgtccgcccc

SEQ ID NO: 21104 - DNA, 20 bp, Unknown
  RNA secondary structure sequence
cctgggtacttatggggagc

SEQ ID NO: 21105 - DNA, 20 bp, Unknown
  RNA secondary structure sequence
catcggtgacacagcttcag

SEQ ID NO: 21106 - DNA, 20 bp, Unknown
  RNA secondary structure sequence
ctgtgtttccgcctgtataa

SEQ ID NO: 21107 - DNA, 20 bp, Unknown
  RNA secondary structure sequence
ggggtgaacaacactaatcg

SEQ ID NO: 21108 - DNA, 20 bp, Unknown
  RNA secondary structure sequence
cgtcggcacttggcttcaga

SEQ ID NO: 21109 - DNA, 20 bp, Unknown
  RNA secondary structure sequence
taccagcggttacgcaccga

SEQ ID NO: 21110 - DNA, 20 bp, Unknown
  RNA secondary structure sequence
atgaccatcagcagtgtcct

SEQ ID NO: 21111 - DNA, 20 bp, Unknown
  RNA secondary structure sequence
ctacgtaacctggcctttgc

SEQ ID NO: 21112 - DNA, 20 bp, Unknown
  RNA secondary structure sequence
catgcagcgtgcggcgcctc

SEQ ID NO: 21113 - DNA, 20 bp, Unknown
  RNA secondary structure sequence
acacagccagacgcgttcgt

SEQ ID NO: 21114 - DNA, 20 bp, Unknown
  RNA secondary structure sequence
cggcgtgtcctcgttgctcg

SEQ ID NO: 21115 - DNA, 20 bp, Unknown
  RNA secondary structure sequence
gtatgcaggtaagcaactga

SEQ ID NO: 21116 - DNA, 20 bp, Unknown
  RNA secondary structure sequence
cggcgcgttataagcaccgt

SEQ ID NO: 21117 - DNA, 20 bp, Unknown
  RNA secondary structure sequence
ccgtcgctccgcgtcgcttc

SEQ ID NO: 21118 - DNA, 20 bp, Unknown
  RNA secondary structure sequence
ccgagcgcgccggggagaag

SEQ ID NO: 21119 - DNA, 20 bp, Unknown
  RNA secondary structure sequence
gacgcggtttatatacaccg

SEQ ID NO: 21120 - DNA, 20 bp, Unknown
  RNA secondary structure sequence
ttaaactaccccccctccct

SEQ ID NO: 21121 - DNA, 20 bp, Unknown
  RNA secondary structure sequence
gcgcagtccggggcgacgac

SEQ ID NO: 21122 - DNA, 20 bp, Unknown
  RNA secondary structure sequence
aagcgtcgtcgccccggact

SEQ ID NO: 21123 - DNA, 20 bp, Unknown
  RNA secondary structure sequence
aaaacgacgtcccccgtcga

SEQ ID NO: 21124 - DNA, 20 bp, Unknown
  RNA secondary structure sequence
ctgctcgcacggacctatac

SEQ ID NO: 21125 - DNA, 20 bp, Unknown
  RNA secondary structure sequence
acgtcaacgctgatagtgtc

SEQ ID NO: 21126 - DNA, 20 bp, Unknown
  RNA secondary structure sequence
tcggctgctgcagcacaacg

SEQ ID NO: 21127 - DNA, 20 bp, Unknown
  RNA secondary structure sequence
ggtttcgctgtagctgtggt

SEQ ID NO: 21128 - DNA, 20 bp, Unknown
  RNA secondary structure sequence
gctacgacctggcctgtggt

SEQ ID NO: 21129 - DNA, 20 bp, Unknown
  RNA secondary structure sequence
gtaccgtctccaccacagtt

SEQ ID NO: 21130 - DNA, 20 bp, Unknown
  RNA secondary structure sequence
cttcaacgacgcgaaagagg

SEQ ID NO: 21131 - DNA, 20 bp, Unknown
  RNA secondary structure sequence
cgctcgctcgcgcccgctcc

SEQ ID NO: 21132 - DNA, 20 bp, Unknown
  RNA secondary structure sequence
gacagcatacggggaggaga

SEQ ID NO: 21133 - DNA, 20 bp, Unknown
  RNA secondary structure sequence
ctttattgaaatctacctga

SEQ ID NO: 21134 - DNA, 20 bp, Unknown
  RNA secondary structure sequence
tggcaacattccattgtggg

SEQ ID NO: 21135 - DNA, 20 bp, Unknown
  RNA secondary structure sequence
gcgcctggtgatcggcgtgg

SEQ ID NO: 21136 - DNA, 20 bp, Unknown
  RNA secondary structure sequence
gacccgcccgccggctcgac

SEQ ID NO: 21137 - DNA, 20 bp, Unknown
  RNA secondary structure sequence
agacggcgccccgctgtgtc

SEQ ID NO: 21138 - DNA, 20 bp, Unknown
  RNA secondary structure sequence
accgtcatcgtggtggcgag

SEQ ID NO: 21139 - DNA, 20 bp, Unknown
  RNA secondary structure sequence
gctggtgctggctcttctgc

SEQ ID NO: 21140 - DNA, 20 bp, Unknown
  RNA secondary structure sequence
gtcacggagagatcctccgt

SEQ ID NO: 21141 - DNA, 20 bp, Unknown
  RNA secondary structure sequence
aagacgagccggcgccgggt

SEQ ID NO: 21142 - DNA, 20 bp, Unknown
  RNA secondary structure sequence
tcggattcatggcgatcggc

SEQ ID NO: 21143 - DNA, 20 bp, Unknown
  RNA secondary structure sequence
gcgtcggcaccggagaatcc

SEQ ID NO: 21144 - DNA, 20 bp, Unknown
  RNA secondary structure sequence
cttcaaggcctttcagatta

SEQ ID NO: 21145 - DNA, 20 bp, Unknown
  RNA secondary structure sequence
gcctgcatgatcatcgtcat

SEQ ID NO: 21146 - DNA, 20 bp, Unknown
  RNA secondary structure sequence
acggtaattttcctttcttc

SEQ ID NO: 21147 - DNA, 20 bp, Unknown
  RNA secondary structure sequence
cagggagcgggaccgacctt

SEQ ID NO: 21148 - DNA, 20 bp, Unknown
  RNA secondary structure sequence
cactgtccatctccctgtct

SEQ ID NO: 21149 - DNA, 20 bp, Unknown
  RNA secondary structure sequence
cgggaaggattgacgtgtgc

SEQ ID NO: 21150 - DNA, 20 bp, Unknown
  RNA secondary structure sequence
gcaaccgcagccagaccgca

SEQ ID NO: 21151 - DNA, 20 bp, Unknown
  RNA secondary structure sequence
aaaattcactcagtggcggc

SEQ ID NO: 21152 - DNA, 20 bp, Unknown
  RNA secondary structure sequence
catctacgaacggattccat

SEQ ID NO: 21153 - DNA, 20 bp, Unknown
  RNA secondary structure sequence
cgaggacgacgacgtctgat

SEQ ID NO: 21154 - DNA, 20 bp, Unknown
  RNA secondary structure sequence
tgatctttgttggtgcactg

SEQ ID NO: 21155 - DNA, 20 bp, Unknown
  RNA secondary structure sequence
ccgacgcgcccatgccgccg

SEQ ID NO: 21156 - DNA, 20 bp, Unknown
  RNA secondary structure sequence
tatgccaagatgctaaggca

SEQ ID NO: 21157 - DNA, 20 bp, Unknown
  RNA secondary structure sequence
cccacttggaaaaagcaata

SEQ ID NO: 21158 - DNA, 20 bp, Unknown
  RNA secondary structure sequence
ggcagtcatgcaagaccccc

SEQ ID NO: 21159 - DNA, 20 bp, Unknown
  RNA secondary structure sequence
tgaaccacctcactggagca

SEQ ID NO: 21160 - DNA, 20 bp, Unknown
  RNA secondary structure sequence
tgataagggtacacttgcca

SEQ ID NO: 21161 - DNA, 20 bp, Unknown
  RNA secondary structure sequence
catttccaagaccacagata

SEQ ID NO: 21162 - DNA, 20 bp, Unknown
  RNA secondary structure sequence
gatgattagaatctcttgtc

SEQ ID NO: 21163 - DNA, 20 bp, Unknown
  RNA secondary structure sequence
tatttcccatagtaataatt

SEQ ID NO: 21164 - DNA, 20 bp, Unknown
  RNA secondary structure sequence
atcagcttctgaatttattg

SEQ ID NO: 21165 - DNA, 20 bp, Unknown
  RNA secondary structure sequence
tagtggttttgctgtttttg

SEQ ID NO: 21166 - DNA, 20 bp, Unknown
  RNA secondary structure sequence
cgaaacaagaggggacgtca

SEQ ID NO: 21167 - DNA, 20 bp, Unknown
  RNA secondary structure sequence
gcaagtggcgcccaacgtgg

SEQ ID NO: 21168 - DNA, 20 bp, Unknown
  RNA secondary structure sequence
aatagtttatcacaacttaa

SEQ ID NO: 21169 - DNA, 20 bp, Unknown
  RNA secondary structure sequence
ttatcacaacttaaaagtga

SEQ ID NO: 21170 - DNA, 20 bp, Unknown
  RNA secondary structure sequence
ataacgattggctctgtttc

SEQ ID NO: 21171 - DNA, 20 bp, Unknown
  RNA secondary structure sequence
tgccataagcaccacattcc

SEQ ID NO: 21172 - DNA, 20 bp, Unknown
  RNA secondary structure sequence
aaactgatggggaacgccag

SEQ ID NO: 21173 - DNA, 20 bp, Unknown
  RNA secondary structure sequence
tactattactttctttaaca

SEQ ID NO: 21174 - DNA, 20 bp, Unknown
  RNA secondary structure sequence
gataactgacgaggaaatgc

SEQ ID NO: 21175 - DNA, 20 bp, Unknown
  RNA secondary structure sequence
ccatggccgagctagcctgt

SEQ ID NO: 21176 - DNA, 20 bp, Unknown
  RNA secondary structure sequence
cttgatgccatttgcgacaa

SEQ ID NO: 21177 - DNA, 20 bp, Unknown
  RNA secondary structure sequence
gggtccctatcctcctgact

SEQ ID NO: 21178 - DNA, 20 bp, Unknown
  RNA secondary structure sequence
ggacctcggtcgaaaatact

SEQ ID NO: 21179 - DNA, 20 bp, Unknown
  RNA secondary structure sequence
ttgcctaattctaacgggag

SEQ ID NO: 21180 - DNA, 20 bp, Unknown
  RNA secondary structure sequence
ctaccccacgtatgatctgg

SEQ ID NO: 21181 - DNA, 20 bp, Unknown
  RNA secondary structure sequence
cccacctgtctgacttggcc

SEQ ID NO: 21182 - DNA, 20 bp, Unknown
  RNA secondary structure sequence
tggaactgacgggcactgcg

SEQ ID NO: 21183 - DNA, 20 bp, Unknown
  RNA secondary structure sequence
gtcgtgttgaccggctcagg

SEQ ID NO: 21184 - DNA, 20 bp, Unknown
  RNA secondary structure sequence
gagactagctataaaagagg

SEQ ID NO: 21185 - DNA, 20 bp, Unknown
  RNA secondary structure sequence
atcacgcatgcgtgtgatga

SEQ ID NO: 21186 - DNA, 20 bp, Unknown
  RNA secondary structure sequence
tcgatgagtttatgtctgtc

SEQ ID NO: 21187 - DNA, 20 bp, Unknown
  RNA secondary structure sequence
tattaaagtttggaaataag

SEQ ID NO: 21188 - DNA, 20 bp, Unknown
  RNA secondary structure sequence
ccaaccatttgattagaagg

SEQ ID NO: 21189 - DNA, 20 bp, Unknown
  RNA secondary structure sequence
aagagaagccctcgagacct

SEQ ID NO: 21190 - DNA, 20 bp, Unknown
  RNA secondary structure sequence
tggcatccttgcccaccagc

SEQ ID NO: 21191 - DNA, 20 bp, Unknown
  RNA secondary structure sequence
ccgtcagataggggaagggt

SEQ ID NO: 21192 - DNA, 20 bp, Unknown
  RNA secondary structure sequence
ctgctgtctcaggaggggcc

SEQ ID NO: 21193 - DNA, 20 bp, Unknown
  RNA secondary structure sequence
ggacgatttacctggatgct

SEQ ID NO: 21194 - DNA, 20 bp, Unknown
  RNA secondary structure sequence
agctcttaagagagagcagc

SEQ ID NO: 21195 - DNA, 20 bp, Unknown
  RNA secondary structure sequence
ttcgccagccgccgggcggg

SEQ ID NO: 21196 - DNA, 20 bp, Unknown
  RNA secondary structure sequence
ggaagtcttggcggcgttgg

SEQ ID NO: 21197 - DNA, 20 bp, Unknown
  RNA secondary structure sequence
ccccacctccaccaccggcc

SEQ ID NO: 21198 - DNA, 20 bp, Unknown
  RNA secondary structure sequence
agggcttcttcagagggagc

SEQ ID NO: 21199 - DNA, 20 bp, Unknown
  RNA secondary structure sequence
aaaacctgagctcgtcctcg

SEQ ID NO: 21200 - DNA, 20 bp, Unknown
  RNA secondary structure sequence
gcgcgtcatccccgcgcacc

SEQ ID NO: 21201 - DNA, 20 bp, Unknown
  RNA secondary structure sequence
acaaggcacttcagagccca

SEQ ID NO: 21202 - DNA, 20 bp, Unknown
  RNA secondary structure sequence
ttaaggtattgcacagagac

SEQ ID NO: 21203 - DNA, 20 bp, Unknown
  RNA secondary structure sequence
ttctggccggccgagcgaag

SEQ ID NO: 21204 - DNA, 20 bp, Unknown
  RNA secondary structure sequence
gtcgcccgccccccgactct

SEQ ID NO: 21205 - DNA, 20 bp, Unknown
  RNA secondary structure sequence
gccagatacttcagaagggt

SEQ ID NO: 21206 - DNA, 20 bp, Unknown
  RNA secondary structure sequence
gccgggacgctagtgctgca

SEQ ID NO: 21207 - DNA, 20 bp, Unknown
  RNA secondary structure sequence
tggacacgcaagggcgaatg

SEQ ID NO: 21208 - DNA, 20 bp, Unknown
  RNA secondary structure sequence
ttcctcttttgctgcagaca

SEQ ID NO: 21209 - DNA, 20 bp, Unknown
  RNA secondary structure sequence
gagaccgccgccgcactgct

SEQ ID NO: 21210 - DNA, 20 bp, Unknown
  RNA secondary structure sequence
cggccaggccctgcccccgg

SEQ ID NO: 21211 - DNA, 20 bp, Unknown
  RNA secondary structure sequence
atttaaggatctatatgccc

SEQ ID NO: 21212 - DNA, 20 bp, Unknown
  RNA secondary structure sequence
gccaccgttctccccggact

SEQ ID NO: 21213 - DNA, 20 bp, Unknown
  RNA secondary structure sequence
agggcctggccggggctgac

SEQ ID NO: 21214 - DNA, 20 bp, Unknown
  RNA secondary structure sequence
gcctcgcgcagcgcccggca

SEQ ID NO: 21215 - DNA, 20 bp, Unknown
  RNA secondary structure sequence
ccgtgacgtgggccctggcc

SEQ ID NO: 21216 - DNA, 20 bp, Unknown
  RNA secondary structure sequence
taacatttaatgtgggactg

SEQ ID NO: 21217 - DNA, 20 bp, Unknown
  RNA secondary structure sequence
ccaacaggaggagctgagcg

SEQ ID NO: 21218 - DNA, 20 bp, Unknown
  RNA secondary structure sequence
caaacacagaatctgtagac

SEQ ID NO: 21219 - DNA, 20 bp, Unknown
  RNA secondary structure sequence
aattggggtgatcctgtagc

SEQ ID NO: 21220 - DNA, 20 bp, Unknown
  RNA secondary structure sequence
gtgtcctgtttggactttta

SEQ ID NO: 21221 - DNA, 20 bp, Unknown
  RNA secondary structure sequence
cttcagaagagaccttctct

SEQ ID NO: 21222 - DNA, 20 bp, Unknown
  RNA secondary structure sequence
tttcccttactcttccttct

SEQ ID NO: 21223 - DNA, 20 bp, Unknown
  RNA secondary structure sequence
ctgccgctactgctgctact

SEQ ID NO: 21224 - DNA, 20 bp, Unknown
  RNA secondary structure sequence
aaccttctaagcacccgcgc

SEQ ID NO: 21225 - DNA, 20 bp, Unknown
  RNA secondary structure sequence
ggggcgcgctgggccgcggc

SEQ ID NO: 21226 - DNA, 20 bp, Unknown
  RNA secondary structure sequence
gttaacctgatagcatagcc

SEQ ID NO: 21227 - DNA, 20 bp, Unknown
  RNA secondary structure sequence
ttctagttccctcttaatta

SEQ ID NO: 21228 - DNA, 20 bp, Unknown
  RNA secondary structure sequence
tacagtcctatcaaacttcc

SEQ ID NO: 21229 - DNA, 20 bp, Unknown
  RNA secondary structure sequence
ccggtattaaaaacccagaa

SEQ ID NO: 21230 - DNA, 20 bp, Unknown
  RNA secondary structure sequence
ttccggtcagggggtttggc

SEQ ID NO: 21231 - DNA, 20 bp, Unknown
  RNA secondary structure sequence
gcgccgtggaagaaggaact

SEQ ID NO: 21232 - DNA, 20 bp, Unknown
  RNA secondary structure sequence
gtggaacacgtgccccccga

SEQ ID NO: 21233 - DNA, 20 bp, Unknown
  RNA secondary structure sequence
cgtttgctccatctgtcagc

SEQ ID NO: 21234 - DNA, 20 bp, Unknown
  RNA secondary structure sequence
gaccagaaggggggcgacaa

SEQ ID NO: 21235 - DNA, 20 bp, Unknown
  RNA secondary structure sequence
cccgttctctttcttagtat

SEQ ID NO: 21236 - DNA, 20 bp, Unknown
  RNA secondary structure sequence
gttcctcaaccagcccacga

SEQ ID NO: 21237 - DNA, 20 bp, Unknown
  RNA secondary structure sequence
gggcagcggggtcgtcccca

SEQ ID NO: 21238 - DNA, 20 bp, Unknown
  RNA secondary structure sequence
cccgtggtggagattgacag

SEQ ID NO: 21239 - DNA, 20 bp, Unknown
  RNA secondary structure sequence
gggggacaagagcacaaaag

SEQ ID NO: 21240 - DNA, 20 bp, Unknown
  RNA secondary structure sequence
gttttactgaacgagcctgt

SEQ ID NO: 21241 - DNA, 20 bp, Unknown
  RNA secondary structure sequence
aagagagttccgattacacc

SEQ ID NO: 21242 - DNA, 20 bp, Unknown
  RNA secondary structure sequence
ccactccagcaacaccgcac

SEQ ID NO: 21243 - DNA, 20 bp, Unknown
  RNA secondary structure sequence
gcaccccaagaaagtgaagc

SEQ ID NO: 21244 - DNA, 20 bp, Unknown
  RNA secondary structure sequence
cgccggtcgctgtggggcca

SEQ ID NO: 21245 - DNA, 20 bp, Unknown
  RNA secondary structure sequence
gccatcgttctgtttagccc

SEQ ID NO: 21246 - DNA, 20 bp, Unknown
  RNA secondary structure sequence
tcgtcaggccgcgagaggat

SEQ ID NO: 21247 - DNA, 20 bp, Unknown
  RNA secondary structure sequence
gacattatttaagaccggga

SEQ ID NO: 21248 - DNA, 20 bp, Unknown
  RNA secondary structure sequence
cagttcaaacccagagacac

SEQ ID NO: 21249 - DNA, 20 bp, Unknown
  RNA secondary structure sequence
acgatgagtgatttcgccca

SEQ ID NO: 21250 - DNA, 20 bp, Unknown
  RNA secondary structure sequence
tgacaattttagatgaggta

SEQ ID NO: 21251 - DNA, 20 bp, Unknown
  RNA secondary structure sequence
acacctaaatttagcacgtc

SEQ ID NO: 21252 - DNA, 20 bp, Unknown
  RNA secondary structure sequence
cactaaacattgcaccttgc

SEQ ID NO: 21253 - DNA, 20 bp, Unknown
  RNA secondary structure sequence
gagtaatctccacactcccg

SEQ ID NO: 21254 - DNA, 20 bp, Unknown
  RNA secondary structure sequence
ttctactttaaaaaggccgg

SEQ ID NO: 21255 - DNA, 20 bp, Unknown
  RNA secondary structure sequence
aacccgaaacagtgtttccc

SEQ ID NO: 21256 - DNA, 20 bp, Unknown
  RNA secondary structure sequence
ttctttatctccatcctgaa

SEQ ID NO: 21257 - DNA, 20 bp, Unknown
  RNA secondary structure sequence
cctggcccagaacagcaccc

SEQ ID NO: 21258 - DNA, 20 bp, Unknown
  RNA secondary structure sequence
cattaagcagtgaagtaaag

SEQ ID NO: 21259 - DNA, 20 bp, Unknown
  RNA secondary structure sequence
aatcaggcgcaccttggcac

SEQ ID NO: 21260 - DNA, 20 bp, Unknown
  RNA secondary structure sequence
tcgcctccaatttggctata

SEQ ID NO: 21261 - DNA, 20 bp, Unknown
  RNA secondary structure sequence
agtaaaatatggacaaaaag

SEQ ID NO: 21262 - DNA, 20 bp, Unknown
  RNA secondary structure sequence
tgcagatgaggcaacacaat

SEQ ID NO: 21263 - DNA, 20 bp, Unknown
  RNA secondary structure sequence
ccccccacggagcgacccga

SEQ ID NO: 21264 - DNA, 20 bp, Unknown
  RNA secondary structure sequence
ggtccctcctttggttcgtg

SEQ ID NO: 21265 - DNA, 20 bp, Unknown
  RNA secondary structure sequence
ttctgtgccttctgtacatc

SEQ ID NO: 21266 - DNA, 20 bp, Unknown
  RNA secondary structure sequence
agtgagcttctgttaagttg

SEQ ID NO: 21267 - DNA, 20 bp, Unknown
  RNA secondary structure sequence
ttgaataatttctactgaaa

SEQ ID NO: 21268 - DNA, 20 bp, Unknown
  RNA secondary structure sequence
gtcgaggtgccctatttagg

SEQ ID NO: 21269 - DNA, 20 bp, Unknown
  RNA secondary structure sequence
agagggcaggcaccggcagt

SEQ ID NO: 21270 - DNA, 20 bp, Unknown
  RNA secondary structure sequence
tggtaagcttttcaagagcg

SEQ ID NO: 21271 - DNA, 20 bp, Unknown
  RNA secondary structure sequence
aatcccgcacccccctggca

SEQ ID NO: 21272 - DNA, 20 bp, Unknown
  RNA secondary structure sequence
ccactgacgctggcaggcct

SEQ ID NO: 21273 - DNA, 20 bp, Unknown
  RNA secondary structure sequence
tttttgtggcggcccttgtg

SEQ ID NO: 21274 - DNA, 20 bp, Unknown
  RNA secondary structure sequence
gcctttcagtggagcttagg

SEQ ID NO: 21275 - DNA, 20 bp, Unknown
  RNA secondary structure sequence
cgggtgtcgcgctttggggg

SEQ ID NO: 21276 - DNA, 20 bp, Unknown
  RNA secondary structure sequence
aaaaccacctcactagacat

SEQ ID NO: 21277 - DNA, 20 bp, Unknown
  RNA secondary structure sequence
ggaacctggtgccctcctcc

SEQ ID NO: 21278 - DNA, 20 bp, Unknown
  RNA secondary structure sequence
gatcctaacatctgtttcgg

SEQ ID NO: 21279 - DNA, 20 bp, Unknown
  RNA secondary structure sequence
tcctttgtttttccacatcg

SEQ ID NO: 21280 - DNA, 20 bp, Unknown
  RNA secondary structure sequence
cagcctgctactgtgtgtaa

SEQ ID NO: 21281 - DNA, 20 bp, Unknown
  RNA secondary structure sequence
taaaaactgaagaaggcgtg

SEQ ID NO: 21282 - DNA, 20 bp, Unknown
  RNA secondary structure sequence
agacgttggtgtgttgaagg

SEQ ID NO: 21283 - DNA, 20 bp, Unknown
  RNA secondary structure sequence
ggcaagcagtggagcaagac

SEQ ID NO: 21284 - DNA, 20 bp, Unknown
  RNA secondary structure sequence
aaagaagagagctggcacgt

SEQ ID NO: 21285 - DNA, 20 bp, Unknown
  RNA secondary structure sequence
gtttgcttgggggtggctat

SEQ ID NO: 21286 - DNA, 20 bp, Unknown
  RNA secondary structure sequence
taagagcacactgtgtggtt

SEQ ID NO: 21287 - DNA, 20 bp, Unknown
  RNA secondary structure sequence
gttgcaggggttaatgccat

SEQ ID NO: 21288 - DNA, 20 bp, Unknown
  RNA secondary structure sequence
atcctggagtttacaggtag

SEQ ID NO: 21289 - DNA, 20 bp, Unknown
  RNA secondary structure sequence
ctggtctttatcgtcgcgtt

SEQ ID NO: 21290 - DNA, 20 bp, Unknown
  RNA secondary structure sequence
gtggcgtccgtgaatacgtt

SEQ ID NO: 21291 - DNA, 20 bp, Unknown
  RNA secondary structure sequence
gctcacctcccctttccctt

SEQ ID NO: 21292 - DNA, 20 bp, Unknown
  RNA secondary structure sequence
ataaaggggcgtggcttcca

SEQ ID NO: 21293 - DNA, 20 bp, Unknown
  RNA secondary structure sequence
cacccttggtgctgtgcgcg

SEQ ID NO: 21294 - DNA, 20 bp, Unknown
  RNA secondary structure sequence
atgccagcttcatacgggac

SEQ ID NO: 21295 - DNA, 20 bp, Unknown
  RNA secondary structure sequence
gccaattcccggtcggcatc

SEQ ID NO: 21296 - DNA, 20 bp, Unknown
  RNA secondary structure sequence
gtgaccacgcactatagtgc

SEQ ID NO: 21297 - DNA, 20 bp, Unknown
  RNA secondary structure sequence
gccattatacacacgggttt

SEQ ID NO: 21298 - DNA, 20 bp, Unknown
  RNA secondary structure sequence
ggcaggacacaacatctaca

SEQ ID NO: 21299 - DNA, 20 bp, Unknown
  RNA secondary structure sequence
cgtccatatccgtgctggtt

SEQ ID NO: 21300 - DNA, 20 bp, Unknown
  RNA secondary structure sequence
tttctccgccgcgccccacc

SEQ ID NO: 21301 - DNA, 20 bp, Unknown
  RNA secondary structure sequence
cgccagccgatccccgcgta

SEQ ID NO: 21302 - DNA, 20 bp, Unknown
  RNA secondary structure sequence
cttctctggcgtccttgccg

SEQ ID NO: 21303 - DNA, 20 bp, Unknown
  RNA secondary structure sequence
cctccgtggcgaggtacggg

SEQ ID NO: 21304 - DNA, 20 bp, Unknown
  RNA secondary structure sequence
cggaaacaaggtggtgtatt

SEQ ID NO: 21305 - DNA, 20 bp, Unknown
  RNA secondary structure sequence
ttctcctatcttcagagtct

SEQ ID NO: 21306 - DNA, 20 bp, Unknown
  RNA secondary structure sequence
tcctgttggtattccccacg

SEQ ID NO: 21307 - DNA, 20 bp, Unknown
  RNA secondary structure sequence
gcgggggtcagggcactcga

SEQ ID NO: 21308 - DNA, 20 bp, Unknown
  RNA secondary structure sequence
tacgccctggtctgtagcat

SEQ ID NO: 21309 - DNA, 20 bp, Unknown
  RNA secondary structure sequence
agtcagcgggagtcttgtgg

SEQ ID NO: 21310 - DNA, 20 bp, Unknown
  RNA secondary structure sequence
aagggtgcgccatccgtgcc

SEQ ID NO: 21311 - DNA, 20 bp, Unknown
  RNA secondary structure sequence
tctcctgcaggttggcggca

SEQ ID NO: 21312 - DNA, 20 bp, Unknown
  RNA secondary structure sequence
gggccagaggtttgaggcgc

SEQ ID NO: 21313 - DNA, 20 bp, Unknown
  RNA secondary structure sequence
ggtcgacgccgtcgcggacc

SEQ ID NO: 21314 - DNA, 20 bp, Unknown
  RNA secondary structure sequence
gacccgcacgtggagattcc

SEQ ID NO: 21315 - DNA, 20 bp, Unknown
  RNA secondary structure sequence
tctcccgccgcagcgccgcc

SEQ ID NO: 21316 - DNA, 20 bp, Unknown
  RNA secondary structure sequence
aaccgacgtgggacagaaat

SEQ ID NO: 21317 - DNA, 20 bp, Unknown
  RNA secondary structure sequence
acggcagaaaggggccttcg

SEQ ID NO: 21318 - DNA, 20 bp, Unknown
  RNA secondary structure sequence
acctgtcaatctgttccact

SEQ ID NO: 21319 - DNA, 20 bp, Unknown
  RNA secondary structure sequence
tacagttggccaatgcattc

SEQ ID NO: 21320 - DNA, 20 bp, Unknown
  RNA secondary structure sequence
gacctctgacataagaatac

SEQ ID NO: 21321 - DNA, 20 bp, Unknown
  RNA secondary structure sequence
ttgccttatccaaggacagt

SEQ ID NO: 21322 - DNA, 20 bp, Unknown
  RNA secondary structure sequence
tgtgctttgtaaatttccgc

SEQ ID NO: 21323 - DNA, 20 bp, Unknown
  RNA secondary structure sequence
atttcagtaattgtcctcat

SEQ ID NO: 21324 - DNA, 20 bp, Unknown
  RNA secondary structure sequence
ttgccacccagctactggtt

SEQ ID NO: 21325 - DNA, 20 bp, Unknown
  RNA secondary structure sequence
tcctatgggggttgggtggg

SEQ ID NO: 21326 - DNA, 20 bp, Unknown
  RNA secondary structure sequence
ctccgttgtcgactataacc

SEQ ID NO: 21327 - DNA, 20 bp, Unknown
  RNA secondary structure sequence
ttctaaatttgcttgtttcg

SEQ ID NO: 21328 - DNA, 20 bp, Unknown
  RNA secondary structure sequence
acgcggaacgttggatagac

SEQ ID NO: 21329 - DNA, 20 bp, Unknown
  RNA secondary structure sequence
gttgccgcgtccaaaaaggt

SEQ ID NO: 21330 - DNA, 20 bp, Unknown
  RNA secondary structure sequence
cactaatatgtcagccacct

SEQ ID NO: 21331 - DNA, 20 bp, Unknown
  RNA secondary structure sequence
tgcttaccactggacattgc

SEQ ID NO: 21332 - DNA, 20 bp, Unknown
  RNA secondary structure sequence
gggactgtgcctcaaagacg

SEQ ID NO: 21333 - DNA, 20 bp, Unknown
  RNA secondary structure sequence
agacctgtacgcccttctgt

SEQ ID NO: 21334 - DNA, 20 bp, Unknown
  RNA secondary structure sequence
tgtctaatacaggcaatgct

SEQ ID NO: 21335 - DNA, 20 bp, Unknown
  RNA secondary structure sequence
gttgaggtggggtaatgctc

SEQ ID NO: 21336 - DNA, 20 bp, Unknown
  RNA secondary structure sequence
gtcgcccacggaaaaggtgt

SEQ ID NO: 21337 - DNA, 20 bp, Unknown
  RNA secondary structure sequence
tcgtgggaaggtgcccaaaa

SEQ ID NO: 21338 - DNA, 20 bp, Unknown
  RNA secondary structure sequence
tacgctgggcacagttccct

SEQ ID NO: 21339 - DNA, 20 bp, Unknown
  RNA secondary structure sequence
gcaaggggggtgcggtgttg

SEQ ID NO: 21340 - DNA, 20 bp, Unknown
  RNA secondary structure sequence
gaatgatgagtgatttcaac

SEQ ID NO: 21341 - DNA, 20 bp, Unknown
  RNA secondary structure sequence
gttccaggtcggggaccaag

SEQ ID NO: 21342 - DNA, 20 bp, Unknown
  RNA secondary structure sequence
tcggcggcggcggaacgagt

SEQ ID NO: 21343 - DNA, 20 bp, Unknown
  RNA secondary structure sequence
cgggaggtaagctggccagc

SEQ ID NO: 21344 - DNA, 20 bp, Unknown
  RNA secondary structure sequence
tagagaggcgcgctctgcca

SEQ ID NO: 21345 - DNA, 20 bp, Unknown
  RNA secondary structure sequence
actgggtgttccagactagt

SEQ ID NO: 21346 - DNA, 20 bp, Unknown
  RNA secondary structure sequence
cggctggtcgagtcccatac

SEQ ID NO: 21347 - DNA, 20 bp, Unknown
  RNA secondary structure sequence
ccactctatgcccggccatt

SEQ ID NO: 21348 - DNA, 20 bp, Unknown
  RNA secondary structure sequence
aaagtgctaaagactctcaa

SEQ ID NO: 21349 - DNA, 20 bp, Unknown
  RNA secondary structure sequence
tgaatactggccgcggctcc

SEQ ID NO: 21350 - DNA, 20 bp, Unknown
  RNA secondary structure sequence
gtaagtgtgctggtgtggac

SEQ ID NO: 21351 - DNA, 20 bp, Unknown
  RNA secondary structure sequence
ggtacggcacgtagcattgc

SEQ ID NO: 21352 - DNA, 20 bp, Unknown
  RNA secondary structure sequence
ctccttttttgccactatgc

SEQ ID NO: 21353 - DNA, 20 bp, Unknown
  RNA secondary structure sequence
ccaaagggtacaacctacgc

SEQ ID NO: 21354 - DNA, 20 bp, Unknown
  RNA secondary structure sequence
cttgtgagaaacacttggag

SEQ ID NO: 21355 - DNA, 20 bp, Unknown
  RNA secondary structure sequence
cgcttatggttacaactaat

SEQ ID NO: 21356 - DNA, 20 bp, Unknown
  RNA secondary structure sequence
ttgtgtttatttgtgtaatt

SEQ ID NO: 21357 - DNA, 20 bp, Unknown
  RNA secondary structure sequence
agacacttgtgtttgtgagt

SEQ ID NO: 21358 - DNA, 20 bp, Unknown
  RNA secondary structure sequence
tacacaatattccacgacaa

SEQ ID NO: 21359 - DNA, 20 bp, Unknown
  RNA secondary structure sequence
acgtactgtaagtgttgaca

SEQ ID NO: 21360 - DNA, 20 bp, Unknown
  RNA secondary structure sequence
ggaataggagttatactgct

SEQ ID NO: 21361 - DNA, 20 bp, Unknown
  RNA secondary structure sequence
ggtcaataccccgaggtgtg

SEQ ID NO: 21362 - DNA, 20 bp, Unknown
  RNA secondary structure sequence
ggcggacctgcattggcagc

SEQ ID NO: 21363 - DNA, 20 bp, Unknown
  RNA secondary structure sequence
ggatgcacccgctgcggggt

SEQ ID NO: 21364 - DNA, 20 bp, Unknown
  RNA secondary structure sequence
accgctgcgcagcagtatcc

SEQ ID NO: 21365 - DNA, 20 bp, Unknown
  RNA secondary structure sequence
cctcctcgtccctgatctaa

SEQ ID NO: 21366 - DNA, 20 bp, Unknown
  RNA secondary structure sequence
atgtgtaaataaagttgtac

SEQ ID NO: 21367 - DNA, 20 bp, Unknown
  RNA secondary structure sequence
caccccagcatcctttaatt

SEQ ID NO: 21368 - DNA, 20 bp, Unknown
  RNA secondary structure sequence
gggagagcttaacttgtatg

SEQ ID NO: 21369 - DNA, 20 bp, Unknown
  RNA secondary structure sequence
atggatgagcccaccctcct

SEQ ID NO: 21370 - DNA, 20 bp, Unknown
  RNA secondary structure sequence
gtctacctgcgcacgccctt

SEQ ID NO: 21371 - DNA, 20 bp, Unknown
  RNA secondary structure sequence
accggcgcacgtcctgactg

SEQ ID NO: 21372 - DNA, 20 bp, Unknown
  RNA secondary structure sequence
catcacccagggcgcgatcc

SEQ ID NO: 21373 - DNA, 20 bp, Unknown
  RNA secondary structure sequence
aacgcgcgcccacccggaaa

SEQ ID NO: 21374 - DNA, 20 bp, Unknown
  RNA secondary structure sequence
gcttttgtgatcatggcctg

SEQ ID NO: 21375 - DNA, 20 bp, Unknown
  RNA secondary structure sequence
gaggagaaggaaaaattgct

SEQ ID NO: 21376 - DNA, 20 bp, Unknown
  RNA secondary structure sequence
gcgggctttgtaactctgat

SEQ ID NO: 21377 - DNA, 20 bp, Unknown
  RNA secondary structure sequence
ctactcagcttctcttactg

SEQ ID NO: 21378 - DNA, 20 bp, Unknown
  RNA secondary structure sequence
gtctgcagcattgtctgcgt

SEQ ID NO: 21379 - DNA, 20 bp, Unknown
  RNA secondary structure sequence
gaatacagggacgagaacgt

SEQ ID NO: 21380 - DNA, 20 bp, Unknown
  RNA secondary structure sequence
tccccggcccccttccactg

SEQ ID NO: 21381 - DNA, 20 bp, Unknown
  RNA secondary structure sequence
aagtcatcttccacccggag

SEQ ID NO: 21382 - DNA, 20 bp, Unknown
  RNA secondary structure sequence
tagttgttcagcagcacctc

SEQ ID NO: 21383 - DNA, 20 bp, Unknown
  RNA secondary structure sequence
gttttgaacacgctgcaggt

SEQ ID NO: 21384 - DNA, 20 bp, Unknown
  RNA secondary structure sequence
cgtaggagccatataccgcg

SEQ ID NO: 21385 - DNA, 20 bp, Unknown
  RNA secondary structure sequence
gtcaaagtccggtgtttatg

SEQ ID NO: 21386 - DNA, 20 bp, Unknown
  RNA secondary structure sequence
ggagccgcggctaacgtggt

SEQ ID NO: 21387 - DNA, 20 bp, Unknown
  RNA secondary structure sequence
gtcgcaccgcgcgtcctttc

SEQ ID NO: 21388 - DNA, 20 bp, Unknown
  RNA secondary structure sequence
tggcccaatcgcgaagaggc

SEQ ID NO: 21389 - DNA, 20 bp, Unknown
  RNA secondary structure sequence
atatttgtgtgacagtgcaa

SEQ ID NO: 21390 - DNA, 20 bp, Unknown
  RNA secondary structure sequence
gtagaagcagacctgtgtgg

SEQ ID NO: 21391 - DNA, 20 bp, Unknown
  RNA secondary structure sequence
aagcaaaccgactcccggcg

SEQ ID NO: 21392 - DNA, 20 bp, Unknown
  RNA secondary structure sequence
gaggaaaaaaggaagaggtc

SEQ ID NO: 21393 - DNA, 20 bp, Unknown
  RNA secondary structure sequence
ggtagaactgctgctgctgt

SEQ ID NO: 21394 - DNA, 20 bp, Unknown
  RNA secondary structure sequence
ggactgggcggtggaatgct

SEQ ID NO: 21395 - DNA, 20 bp, Unknown
  RNA secondary structure sequence
aatggctgagtttccatgtc

SEQ ID NO: 21396 - DNA, 20 bp, Unknown
  RNA secondary structure sequence
tgatcatccacaagacccag

SEQ ID NO: 21397 - DNA, 20 bp, Unknown
  RNA secondary structure sequence
agccagcattcttttgacca

SEQ ID NO: 21398 - DNA, 20 bp, Unknown
  RNA secondary structure sequence
ggtttggcgggattttttac

SEQ ID NO: 21399 - DNA, 20 bp, Unknown
  RNA secondary structure sequence
attgcccgcactggagcaga

SEQ ID NO: 21400 - DNA, 20 bp, Unknown
  RNA secondary structure sequence
gatggacagattgagtaaaa

SEQ ID NO: 21401 - DNA, 20 bp, Unknown
  RNA secondary structure sequence
aacggcgggaatcacgtcac

SEQ ID NO: 21402 - DNA, 20 bp, Unknown
  RNA secondary structure sequence
atctaagatctttttttttt

SEQ ID NO: 21403 - DNA, 20 bp, Unknown
  RNA secondary structure sequence
gtatttttttttcactttac

SEQ ID NO: 21404 - DNA, 20 bp, Unknown
  RNA secondary structure sequence
taggcgatgttgacgagccg

SEQ ID NO: 21405 - DNA, 20 bp, Unknown
  RNA secondary structure sequence
agggcgacggcctagtcgtg

SEQ ID NO: 21406 - DNA, 20 bp, Unknown
  RNA secondary structure sequence
tgacgagtcttccttctatt

SEQ ID NO: 21407 - DNA, 20 bp, Unknown
  RNA secondary structure sequence
tgtcagaatatctatcattt

SEQ ID NO: 21408 - DNA, 20 bp, Unknown
  RNA secondary structure sequence
ggtgtaaacatgaaagtact

SEQ ID NO: 21409 - DNA, 20 bp, Unknown
  RNA secondary structure sequence
gtaaccttaccatcatgctt

SEQ ID NO: 21410 - DNA, 20 bp, Unknown
  RNA secondary structure sequence
cggagacagcgtaaccaccg

SEQ ID NO: 21411 - DNA, 20 bp, Unknown
  RNA secondary structure sequence
aaggataagaccaaagttct

SEQ ID NO: 21412 - DNA, 20 bp, Unknown
  RNA secondary structure sequence
gacaccaagaatgagtggac

SEQ ID NO: 21413 - DNA, 20 bp, Unknown
  RNA secondary structure sequence
agcaggagcagctctccttc

SEQ ID NO: 21414 - DNA, 20 bp, Unknown
  RNA secondary structure sequence
cgacgaccccgaacccgcag

SEQ ID NO: 21415 - DNA, 20 bp, Unknown
  RNA secondary structure sequence
ggctcgtccgggatctgttc

SEQ ID NO: 21416 - DNA, 20 bp, Unknown
  RNA secondary structure sequence
atgtgtcccttccccaaaat

SEQ ID NO: 21417 - DNA, 20 bp, Unknown
  RNA secondary structure sequence
ccgggtggtgacagaatgtg

SEQ ID NO: 21418 - DNA, 20 bp, Unknown
  RNA secondary structure sequence
acgtatgtcagccaatcagc

SEQ ID NO: 21419 - DNA, 20 bp, Unknown
  RNA secondary structure sequence
gagtgaacatctctgggaag

SEQ ID NO: 21420 - DNA, 20 bp, Unknown
  RNA secondary structure sequence
tacttctgccttctttgata

SEQ ID NO: 21421 - DNA, 20 bp, Unknown
  RNA secondary structure sequence
agaagcatcggaagtggatt

SEQ ID NO: 21422 - DNA, 20 bp, Unknown
  RNA secondary structure sequence
tgaataatttctactgaaag

SEQ ID NO: 21423 - DNA, 20 bp, Unknown
  RNA secondary structure sequence
tccggtgctttacaccggag

SEQ ID NO: 21424 - DNA, 20 bp, Unknown
  RNA secondary structure sequence
ctcgctcagcacgagatctg

SEQ ID NO: 21425 - DNA, 20 bp, Unknown
  RNA secondary structure sequence
cggtgtatcttaacccaggc

SEQ ID NO: 21426 - DNA, 20 bp, Unknown
  RNA secondary structure sequence
gttcgcagacggccgcggcg

SEQ ID NO: 21427 - DNA, 20 bp, Unknown
  RNA secondary structure sequence
aataaaactcaccaaggcca

SEQ ID NO: 21428 - DNA, 20 bp, Unknown
  RNA secondary structure sequence
tgggcatagtcgcgccgcgc

SEQ ID NO: 21429 - DNA, 20 bp, Unknown
  RNA secondary structure sequence
caccccagcatcctttaatc

SEQ ID NO: 21430 - DNA, 20 bp, Unknown
  RNA secondary structure sequence
tgctattaagagaggaaaga

SEQ ID NO: 21431 - DNA, 20 bp, Unknown
  RNA secondary structure sequence
cctgtgggggttctagacga

SEQ ID NO: 21432 - DNA, 20 bp, Unknown
  RNA secondary structure sequence
acaaaaacgaagatcagctg

SEQ ID NO: 21433 - DNA, 20 bp, Unknown
  RNA secondary structure sequence
gcgcgcccacccggaaaaaa

SEQ ID NO: 21434 - DNA, 20 bp, Unknown
  RNA secondary structure sequence
taccgaacttcgacgcagtt

SEQ ID NO: 21435 - DNA, 20 bp, Unknown
  RNA secondary structure sequence
ttagcccatacaaggtggtc

SEQ ID NO: 21436 - DNA, 20 bp, Unknown
  RNA secondary structure sequence
ggggtctaaggaatcttctt

SEQ ID NO: 21437 - DNA, 20 bp, Unknown
  RNA secondary structure sequence
acctgcgtctgcagcattgt

SEQ ID NO: 21438 - DNA, 20 bp, Unknown
  RNA secondary structure sequence
atacacactacaaaacagtt

SEQ ID NO: 21439 - DNA, 20 bp, Unknown
  RNA secondary structure sequence
tggcctgtaccgggaccgag

SEQ ID NO: 21440 - DNA, 20 bp, Unknown
  RNA secondary structure sequence
taaaagcgcaccgcggcacg

SEQ ID NO: 21441 - DNA, 20 bp, Unknown
  RNA secondary structure sequence
aaggtcttagaaactctcaa

SEQ ID NO: 21442 - DNA, 20 bp, Unknown
  RNA secondary structure sequence
tttgtgaacttctttaaatc

SEQ ID NO: 21443 - DNA, 20 bp, Unknown
  RNA secondary structure sequence
aggggcacttgttctttgtc

SEQ ID NO: 21444 - DNA, 20 bp, Unknown
  RNA secondary structure sequence
agattaaggcaaccagtggt

SEQ ID NO: 21445 - DNA, 20 bp, Unknown
  RNA secondary structure sequence
caacaaccccctaacctccc

SEQ ID NO: 21446 - DNA, 20 bp, Unknown
  RNA secondary structure sequence
cccgcaccatcgtcgagcgt

SEQ ID NO: 21447 - DNA, 20 bp, Unknown
  RNA secondary structure sequence
tcactgcgaattgtgtggat

SEQ ID NO: 21448 - DNA, 20 bp, Unknown
  RNA secondary structure sequence
ggaaaacggggtcattttgc

SEQ ID NO: 21449 - DNA, 20 bp, Unknown
  RNA secondary structure sequence
aaactcatgatgtgtagtcc

SEQ ID NO: 21450 - DNA, 20 bp, Unknown
  RNA secondary structure sequence
ggggcttggatacgagggaa

SEQ ID NO: 21451 - DNA, 20 bp, Unknown
  RNA secondary structure sequence
tgggacggaaccgactactt

SEQ ID NO: 21452 - DNA, 20 bp, Unknown
  RNA secondary structure sequence
atgaaccattgagatttctc

SEQ ID NO: 21453 - DNA, 20 bp, Unknown
  RNA secondary structure sequence
tcgcggctggccgaccatga

SEQ ID NO: 21454 - DNA, 20 bp, Unknown
  RNA secondary structure sequence
tgaagtattgagatttctct

SEQ ID NO: 21455 - DNA, 20 bp, Unknown
  RNA secondary structure sequence
cgcggctggccgaccataac

SEQ ID NO: 21456 - DNA, 20 bp, Unknown
  RNA secondary structure sequence
gatcatgttttacaacagta

SEQ ID NO: 21457 - DNA, 20 bp, Unknown
  RNA secondary structure sequence
ccgaagtcgggcatcccaaa

SEQ ID NO: 21458 - DNA, 20 bp, Unknown
  RNA secondary structure sequence
cctcgcctagtcccaacaca

SEQ ID NO: 21459 - DNA, 20 bp, Unknown
  RNA secondary structure sequence
acacccgacgggacacaaat

SEQ ID NO: 21460 - DNA, 20 bp, Unknown
  RNA secondary structure sequence
ctccacaggccatccctctc

SEQ ID NO: 21461 - DNA, 20 bp, Unknown
  RNA secondary structure sequence
aaatcaagagaggctgagtt

SEQ ID NO: 21462 - DNA, 20 bp, Unknown
  RNA secondary structure sequence
ttcccagtacttcttatata

SEQ ID NO: 21463 - DNA, 20 bp, Unknown
  RNA secondary structure sequence
gaaacaaggtagcctagctt

SEQ ID NO: 21464 - DNA, 20 bp, Unknown
  RNA secondary structure sequence
cttaggtggtattgagaaac

SEQ ID NO: 21465 - DNA, 20 bp, Unknown
  RNA secondary structure sequence
agcctgccggcggatgcctg

SEQ ID NO: 21466 - DNA, 20 bp, Unknown
  RNA secondary structure sequence
tatcccattgccatcccaac

SEQ ID NO: 21467 - DNA, 20 bp, Unknown
  RNA secondary structure sequence
taagacttgttgtgtggaga

SEQ ID NO: 21468 - DNA, 20 bp, Unknown
  RNA secondary structure sequence
gaatgcgtatccggaacgcc

SEQ ID NO: 21469 - DNA, 20 bp, Unknown
  RNA secondary structure sequence
caagacacaccttaacctgg

SEQ ID NO: 21470 - DNA, 20 bp, Unknown
  RNA secondary structure sequence
agcacccctgggtcacgccc

SEQ ID NO: 21471 - DNA, 20 bp, Unknown
  RNA secondary structure sequence
cctggtactacgagcttggg

SEQ ID NO: 21472 - DNA, 20 bp, Unknown
  RNA secondary structure sequence
gagactggccgaaaggcagc

SEQ ID NO: 21473 - DNA, 20 bp, Unknown
  RNA secondary structure sequence
tagggtgacggtatttacat

SEQ ID NO: 21474 - DNA, 20 bp, Unknown
  RNA secondary structure sequence
tgttacagtaccattaacat

SEQ ID NO: 21475 - DNA, 20 bp, Unknown
  RNA secondary structure sequence
tagtacatctcctaccaatg

SEQ ID NO: 21476 - DNA, 20 bp, Unknown
  RNA secondary structure sequence
ctcacgcgctgtcaataccg

SEQ ID NO: 21477 - DNA, 20 bp, Unknown
  RNA secondary structure sequence
ttctttgagacctcgttggc

SEQ ID NO: 21478 - DNA, 20 bp, Unknown
  RNA secondary structure sequence
gacagtccctgcattgcact

SEQ ID NO: 21479 - DNA, 20 bp, Unknown
  RNA secondary structure sequence
acgttaaagggaggtaacca

SEQ ID NO: 21480 - DNA, 20 bp, Unknown
  RNA secondary structure sequence
aggtaacacgcgacactcgg

SEQ ID NO: 21481 - DNA, 20 bp, Unknown
  RNA secondary structure sequence
aagggtggaaggccagcgtt

SEQ ID NO: 21482 - DNA, 20 bp, Unknown
  RNA secondary structure sequence
tgcacaaggttgttctgccc

SEQ ID NO: 21483 - DNA, 20 bp, Unknown
  RNA secondary structure sequence
cccaacagatcaaagtgtat

SEQ ID NO: 21484 - DNA, 20 bp, Unknown
  RNA secondary structure sequence
tgaactccaagttcacgttt

SEQ ID NO: 21485 - DNA, 20 bp, Unknown
  RNA secondary structure sequence
ttgagctccggctacctgtg

SEQ ID NO: 21486 - DNA, 20 bp, Unknown
  RNA secondary structure sequence
ctgcctaccacaagggcccg

SEQ ID NO: 21487 - DNA, 20 bp, Unknown
  RNA secondary structure sequence
cagttaaagcagaaacaatc

SEQ ID NO: 21488 - DNA, 20 bp, Unknown
  RNA secondary structure sequence
tcgatgaggccaaaccctgg

SEQ ID NO: 21489 - DNA, 20 bp, Unknown
  RNA secondary structure sequence
ccagtctctttcacgtgccg

SEQ ID NO: 21490 - DNA, 20 bp, Unknown
  RNA secondary structure sequence
gcgagtggctggtcaagctg

SEQ ID NO: 21491 - DNA, 20 bp, Unknown
  RNA secondary structure sequence
ccggcaggaccgattctgtt

SEQ ID NO: 21492 - DNA, 20 bp, Unknown
  RNA secondary structure sequence
tcaaagcacttgaagacacc

SEQ ID NO: 21493 - DNA, 20 bp, Unknown
  RNA secondary structure sequence
catttgtgaaacgtgctttt

SEQ ID NO: 21494 - DNA, 20 bp, Unknown
  RNA secondary structure sequence
gtcagagacctctgaaagtg

SEQ ID NO: 21495 - DNA, 20 bp, Unknown
  RNA secondary structure sequence
tgattgtcactgagagtggt

SEQ ID NO: 21496 - DNA, 20 bp, Unknown
  RNA secondary structure sequence
aggacggagctgacaccttc

SEQ ID NO: 21497 - DNA, 20 bp, Unknown
  RNA secondary structure sequence
taatgcgcaaaaccaagctt

SEQ ID NO: 21498 - DNA, 20 bp, Unknown
  RNA secondary structure sequence
tgttccgccgctgcgctgct

SEQ ID NO: 21499 - DNA, 20 bp, Unknown
  RNA secondary structure sequence
tttacctgcgttgggtgaac

SEQ ID NO: 21500 - DNA, 20 bp, Unknown
  RNA secondary structure sequence
tcctggagcaccccccctag

SEQ ID NO: 21501 - DNA, 20 bp, Unknown
  RNA secondary structure sequence
gcaaagcgcaaagtccagcg

SEQ ID NO: 21502 - DNA, 20 bp, Unknown
  RNA secondary structure sequence
attggtgatgttacaactca

SEQ ID NO: 21503 - DNA, 20 bp, Unknown
  RNA secondary structure sequence
ctcccatcccagtcgtatct

SEQ ID NO: 21504 - DNA, 20 bp, Unknown
  RNA secondary structure sequence
gcagctgctgcccaaccaga

SEQ ID NO: 21505 - DNA, 20 bp, Unknown
  RNA secondary structure sequence
gagataattggagggctgac

SEQ ID NO: 21506 - DNA, 20 bp, Unknown
  RNA secondary structure sequence
gttcttaagtttttcctctt

SEQ ID NO: 21507 - DNA, 20 bp, Unknown
  RNA secondary structure sequence
ggggacacggttgatggttt

SEQ ID NO: 21508 - DNA, 20 bp, Unknown
  RNA secondary structure sequence
caaccaccatgtggagctgg

SEQ ID NO: 21509 - DNA, 20 bp, Unknown
  RNA secondary structure sequence
ctgtgctcctccgggcatgt

SEQ ID NO: 21510 - DNA, 20 bp, Unknown
  RNA secondary structure sequence
gtgaccagataccaaatgtg

SEQ ID NO: 21511 - DNA, 20 bp, Unknown
  RNA secondary structure sequence
gttgacgaagaagaaatcgt

SEQ ID NO: 21512 - DNA, 20 bp, Unknown
  RNA secondary structure sequence
attctggaggcatctacccc

SEQ ID NO: 21513 - DNA, 20 bp, Unknown
  RNA secondary structure sequence
aacattcctggttgtccttt

SEQ ID NO: 21514 - DNA, 20 bp, Unknown
  RNA secondary structure sequence
accttgagagctgcagtggc

SEQ ID NO: 21515 - DNA, 20 bp, Unknown
  RNA secondary structure sequence
ttgcgtgatgcacttgagac

SEQ ID NO: 21516 - DNA, 20 bp, Unknown
  RNA secondary structure sequence
ggtttcctcaaacaaagatc

SEQ ID NO: 21517 - DNA, 20 bp, Unknown
  RNA secondary structure sequence
cgtctgttgtcgatgtggtc

SEQ ID NO: 21518 - DNA, 20 bp, Unknown
  RNA secondary structure sequence
ggaggaccgatgatcgctta

SEQ ID NO: 21519 - DNA, 20 bp, Unknown
  RNA secondary structure sequence
accgtaatttggaaaagcgc

SEQ ID NO: 21520 - DNA, 20 bp, Unknown
  RNA secondary structure sequence
aagccttactactttcttac

SEQ ID NO: 21521 - DNA, 20 bp, Unknown
  RNA secondary structure sequence
gacaaacttcccgagactgt

SEQ ID NO: 21522 - DNA, 20 bp, Unknown
  RNA secondary structure sequence
tgggcgctagcactctggta

SEQ ID NO: 21523 - DNA, 20 bp, Unknown
  RNA secondary structure sequence
gtaaaagatatcatgattaa

SEQ ID NO: 21524 - DNA, 20 bp, Unknown
  RNA secondary structure sequence
agatccaatgaaggatctgg

SEQ ID NO: 21525 - DNA, 20 bp, Unknown
  RNA secondary structure sequence
gccgctatagggagagttgc

SEQ ID NO: 21526 - DNA, 20 bp, Unknown
  RNA secondary structure sequence
cagccctcaaccacacagaa

SEQ ID NO: 21527 - DNA, 20 bp, Unknown
  RNA secondary structure sequence
ttgagcattggcaacgccta

SEQ ID NO: 21528 - DNA, 20 bp, Unknown
  RNA secondary structure sequence
aacaatagctggcttaagaa

SEQ ID NO: 21529 - DNA, 20 bp, Unknown
  RNA secondary structure sequence
cagatcgccacaatcgagca

SEQ ID NO: 21530 - DNA, 20 bp, Unknown
  RNA secondary structure sequence
ttcagagacatcagaggctt

SEQ ID NO: 21531 - DNA, 20 bp, Unknown
  RNA secondary structure sequence
cccacaagagcaggccagtg

SEQ ID NO: 21532 - DNA, 20 bp, Unknown
  RNA secondary structure sequence
attaggacactaatgctaaa

SEQ ID NO: 21533 - DNA, 20 bp, Unknown
  RNA secondary structure sequence
gcttggcataacggggagca

SEQ ID NO: 21534 - DNA, 20 bp, Unknown
  RNA secondary structure sequence
caactctacgcaggaagtgg

SEQ ID NO: 21535 - DNA, 20 bp, Unknown
  RNA secondary structure sequence
cctgtcaaagacatcttcac

SEQ ID NO: 21536 - DNA, 20 bp, Unknown
  RNA secondary structure sequence
tctgatgctactgcagtgga

SEQ ID NO: 21537 - DNA, 20 bp, Unknown
  RNA secondary structure sequence
ggaggccccttacccaagga

SEQ ID NO: 21538 - DNA, 20 bp, Unknown
  RNA secondary structure sequence
tggtaccagacgaattatgt

SEQ ID NO: 21539 - DNA, 20 bp, Unknown
  RNA secondary structure sequence
ggggacagcgtgagcagagc

SEQ ID NO: 21540 - DNA, 20 bp, Unknown
  RNA secondary structure sequence
aattcacatagcacagctga

SEQ ID NO: 21541 - DNA, 20 bp, Unknown
  RNA secondary structure sequence
tgcccattggtgatcaggat

SEQ ID NO: 21542 - DNA, 20 bp, Unknown
  RNA secondary structure sequence
cagtccggagctatctacgt

SEQ ID NO: 21543 - DNA, 20 bp, Unknown
  RNA secondary structure sequence
gggatagtttccaccggggg

SEQ ID NO: 21544 - DNA, 20 bp, Unknown
  RNA secondary structure sequence
gcatcaattttgggcatacc

SEQ ID NO: 21545 - DNA, 20 bp, Unknown
  RNA secondary structure sequence
ctaggcatcaagaaaaagga

SEQ ID NO: 21546 - DNA, 20 bp, Unknown
  RNA secondary structure sequence
atgacccctgccgacaagtc

SEQ ID NO: 21547 - DNA, 20 bp, Unknown
  RNA secondary structure sequence
gtggcggctagtacactggt

SEQ ID NO: 21548 - DNA, 20 bp, Unknown
  RNA secondary structure sequence
aagtggccgatccgttatcc

SEQ ID NO: 21549 - DNA, 20 bp, Unknown
  RNA secondary structure sequence
ctaaaggacgtgctcataaa

SEQ ID NO: 21550 - DNA, 20 bp, Unknown
  RNA secondary structure sequence
gaagcaaacccggtggacca

SEQ ID NO: 21551 - DNA, 20 bp, Unknown
  RNA secondary structure sequence
atggacatgtacagagttac

SEQ ID NO: 21552 - DNA, 20 bp, Unknown
  RNA secondary structure sequence
ggtattgaagatttgatttc

SEQ ID NO: 21553 - DNA, 20 bp, Unknown
  RNA secondary structure sequence
accgactcaatagcaaggtg

SEQ ID NO: 21554 - DNA, 20 bp, Unknown
  RNA secondary structure sequence
ttgtacgcacttgaggccaa

SEQ ID NO: 21555 - DNA, 20 bp, Unknown
  RNA secondary structure sequence
aacacctccacctactcgct

SEQ ID NO: 21556 - DNA, 20 bp, Unknown
  RNA secondary structure sequence
gggtttgactatgcagtggc

SEQ ID NO: 21557 - DNA, 20 bp, Unknown
  RNA secondary structure sequence
gccctcgaagatcaggcagg

SEQ ID NO: 21558 - DNA, 20 bp, Unknown
  RNA secondary structure sequence
tcatacttcactcagagcca

SEQ ID NO: 21559 - DNA, 20 bp, Unknown
  RNA secondary structure sequence
acagactttgaagaagcaat

SEQ ID NO: 21560 - DNA, 20 bp, Unknown
  RNA secondary structure sequence
gtggaacagggaaaatccag

SEQ ID NO: 21561 - DNA, 20 bp, Unknown
  RNA secondary structure sequence
gaagaaaagctatttgcctt

SEQ ID NO: 21562 - DNA, 20 bp, Unknown
  RNA secondary structure sequence
ggcggcatgccatctggctg

SEQ ID NO: 21563 - DNA, 20 bp, Unknown
  RNA secondary structure sequence
aaccggacagcggcgtgctg

SEQ ID NO: 21564 - DNA, 20 bp, Unknown
  RNA secondary structure sequence
cgccttttgggatgcaggaa

SEQ ID NO: 21565 - DNA, 20 bp, Unknown
  RNA secondary structure sequence
attgtctaagcagcagcagg

SEQ ID NO: 21566 - DNA, 20 bp, Unknown
  RNA secondary structure sequence
acaagcgagggttggatctg

SEQ ID NO: 21567 - DNA, 20 bp, Unknown
  RNA secondary structure sequence
caccacctggtcaagaacgg

SEQ ID NO: 21568 - DNA, 20 bp, Unknown
  RNA secondary structure sequence
ccccaccagttgctaaattt

SEQ ID NO: 21569 - DNA, 20 bp, Unknown
  RNA secondary structure sequence
gatgtggcaaaacagacata

SEQ ID NO: 21570 - DNA, 20 bp, Unknown
  RNA secondary structure sequence
ccctcccctgctgacttcat

SEQ ID NO: 21571 - DNA, 20 bp, Unknown
  RNA secondary structure sequence
ccggcggacctgcccgacaa

SEQ ID NO: 21572 - DNA, 20 bp, Unknown
  RNA secondary structure sequence
tctcctgccacacatgttct

SEQ ID NO: 21573 - DNA, 20 bp, Unknown
  RNA secondary structure sequence
gttggagcaccaaccaagac

SEQ ID NO: 21574 - DNA, 20 bp, Unknown
  RNA secondary structure sequence
gacactgggtttttcttttc

SEQ ID NO: 21575 - DNA, 20 bp, Unknown
  RNA secondary structure sequence
aaattgaaggaacctgatac

SEQ ID NO: 21576 - DNA, 20 bp, Unknown
  RNA secondary structure sequence
actgactgctctgccttggg

SEQ ID NO: 21577 - DNA, 20 bp, Unknown
  RNA secondary structure sequence
gttagggctggaaagacccg

SEQ ID NO: 21578 - DNA, 20 bp, Unknown
  RNA secondary structure sequence
gaaattgatttccaacaact

SEQ ID NO: 21579 - DNA, 20 bp, Unknown
  RNA secondary structure sequence
gcaatcttaagctttgttcg

SEQ ID NO: 21580 - DNA, 20 bp, Unknown
  RNA secondary structure sequence
aggcttaattccagacctct

SEQ ID NO: 21581 - DNA, 20 bp, Unknown
  RNA secondary structure sequence
gaacatgtctagacaaggta

SEQ ID NO: 21582 - DNA, 20 bp, Unknown
  RNA secondary structure sequence
aggagcaactgatgtagatg

SEQ ID NO: 21583 - DNA, 20 bp, Unknown
  RNA secondary structure sequence
gaactcaaatgccatgttat

SEQ ID NO: 21584 - DNA, 20 bp, Unknown
  RNA secondary structure sequence
taaaaacttcaaggatgcaa

SEQ ID NO: 21585 - DNA, 20 bp, Unknown
  RNA secondary structure sequence
aggggatgtgcctagagctt

SEQ ID NO: 21586 - DNA, 20 bp, Unknown
  RNA secondary structure sequence
aggcgaaggtcttcctggaa

SEQ ID NO: 21587 - DNA, 20 bp, Unknown
  RNA secondary structure sequence
gaaagtggagtttactcagt

SEQ ID NO: 21588 - DNA, 20 bp, Unknown
  RNA secondary structure sequence
tgtagaagaaccagaggatt

SEQ ID NO: 21589 - DNA, 20 bp, Unknown
  RNA secondary structure sequence
attcggagatgttggtcttg

SEQ ID NO: 21590 - DNA, 20 bp, Unknown
  RNA secondary structure sequence
ttaccatgtctgtggttcaa

SEQ ID NO: 21591 - DNA, 20 bp, Unknown
  RNA secondary structure sequence
ggttggagatctaagtcaac

SEQ ID NO: 21592 - DNA, 20 bp, Unknown
  RNA secondary structure sequence
acctcttcttttctactcca

SEQ ID NO: 21593 - DNA, 20 bp, Unknown
  RNA secondary structure sequence
gctgtagcgaccacacaaag

SEQ ID NO: 21594 - DNA, 20 bp, Unknown
  RNA secondary structure sequence
accgctcatacgcgatattg

SEQ ID NO: 21595 - DNA, 20 bp, Unknown
  RNA secondary structure sequence
caacaccaacaacaagcgtt

SEQ ID NO: 21596 - DNA, 20 bp, Unknown
  RNA secondary structure sequence
acaaggagttgacaatgctg

SEQ ID NO: 21597 - DNA, 20 bp, Unknown
  RNA secondary structure sequence
ctaccaagaaaatgattacc

SEQ ID NO: 21598 - DNA, 20 bp, Unknown
  RNA secondary structure sequence
tacctctgcctccgtccgga

SEQ ID NO: 21599 - DNA, 20 bp, Unknown
  RNA secondary structure sequence
cttcactgatgagttcatca

SEQ ID NO: 21600 - DNA, 20 bp, Unknown
  RNA secondary structure sequence
tgctacttgctcttccttta

SEQ ID NO: 21601 - DNA, 20 bp, Unknown
  RNA secondary structure sequence
aacaaatccaggccctgtgc

SEQ ID NO: 21602 - DNA, 20 bp, Unknown
  RNA secondary structure sequence
ttggctcaaacaaaaattgt

SEQ ID NO: 21603 - DNA, 20 bp, Unknown
  RNA secondary structure sequence
ctctagcttcattgttgcta

SEQ ID NO: 21604 - DNA, 20 bp, Unknown
  RNA secondary structure sequence
tgctcagtctccaccagact

SEQ ID NO: 21605 - DNA, 20 bp, Unknown
  RNA secondary structure sequence
caaactcaaggatgtgagac

SEQ ID NO: 21606 - DNA, 20 bp, Unknown
  RNA secondary structure sequence
cactggaatcatgaacaccg

SEQ ID NO: 21607 - DNA, 20 bp, Unknown
  RNA secondary structure sequence
gaggacagtcgcccacgacg

SEQ ID NO: 21608 - DNA, 20 bp, Unknown
  RNA secondary structure sequence
ggactacgctcattccaaat

SEQ ID NO: 21609 - DNA, 20 bp, Unknown
  RNA secondary structure sequence
caatttctttacagagcaaa

SEQ ID NO: 21610 - DNA, 20 bp, Unknown
  RNA secondary structure sequence
gacctgggctcagcccgggt

SEQ ID NO: 21611 - DNA, 20 bp, Unknown
  RNA secondary structure sequence
agcctaccaagtgcgcaatt

SEQ ID NO: 21612 - DNA, 20 bp, Unknown
  RNA secondary structure sequence
cagggacggcaaactcccca

SEQ ID NO: 21613 - DNA, 20 bp, Unknown
  RNA secondary structure sequence
ggtggggaactgggcgaagg

SEQ ID NO: 21614 - DNA, 20 bp, Unknown
  RNA secondary structure sequence
caatagcacggccttgaact

SEQ ID NO: 21615 - DNA, 20 bp, Unknown
  RNA secondary structure sequence
ccttaacaacaccaggccac

SEQ ID NO: 21616 - DNA, 20 bp, Unknown
  RNA secondary structure sequence
ggaagacagggacaggtccg

SEQ ID NO: 21617 - DNA, 20 bp, Unknown
  RNA secondary structure sequence
ggccattaagtgggagtacg

SEQ ID NO: 21618 - DNA, 20 bp, Unknown
  RNA secondary structure sequence
gttcttctgctttgcgtggt

SEQ ID NO: 21619 - DNA, 20 bp, Unknown
  RNA secondary structure sequence
tgacatcaccaaactactcc

SEQ ID NO: 21620 - DNA, 20 bp, Unknown
  RNA secondary structure sequence
tactggcacctgtgtgtata

SEQ ID NO: 21621 - DNA, 20 bp, Unknown
  RNA secondary structure sequence
cggtaagagcaccaaggtcc

SEQ ID NO: 21622 - DNA, 20 bp, Unknown
  RNA secondary structure sequence
gtactccacctacggcaagt

SEQ ID NO: 21623 - DNA, 20 bp, Unknown
  RNA secondary structure sequence
ccctccgggctccgtcactg

SEQ ID NO: 21624 - DNA, 20 bp, Unknown
  RNA secondary structure sequence
cgcattgggcatcaatgccg

SEQ ID NO: 21625 - DNA, 20 bp, Unknown
  RNA secondary structure sequence
tgaccctacctttaccattg

SEQ ID NO: 21626 - DNA, 20 bp, Unknown
  RNA secondary structure sequence
aatcaccaaatacatcatga

SEQ ID NO: 21627 - DNA, 20 bp, Unknown
  RNA secondary structure sequence
ccccacacactacgtgccgg

SEQ ID NO: 21628 - DNA, 20 bp, Unknown
  RNA secondary structure sequence
gagcgactttaagacctggc

SEQ ID NO: 21629 - DNA, 20 bp, Unknown
  RNA secondary structure sequence
cgtcggtcctaggacctgca

SEQ ID NO: 21630 - DNA, 20 bp, Unknown
  RNA secondary structure sequence
catgactactgacaatctca

SEQ ID NO: 21631 - DNA, 20 bp, Unknown
  RNA secondary structure sequence
cgagcccgaaccggacgtag

SEQ ID NO: 21632 - DNA, 20 bp, Unknown
  RNA secondary structure sequence
ctcccctgacgccgagctca

SEQ ID NO: 21633 - DNA, 20 bp, Unknown
  RNA secondary structure sequence
tcggagattcgccccagccc

SEQ ID NO: 21634 - DNA, 20 bp, Unknown
  RNA secondary structure sequence
cctggcgcccccacattcag

SEQ ID NO: 21635 - DNA, 20 bp, Unknown
  RNA secondary structure sequence
gcctgagaaggggggtcgta

SEQ ID NO: 21636 - DNA, 20 bp, Unknown
  RNA secondary structure sequence
ggtctactaccttacccgtg

SEQ ID NO: 21637 - DNA, 20 bp, Unknown
  RNA secondary structure sequence
gcttgaacaggctctcaact

SEQ ID NO: 21638 - DNA, 20 bp, Unknown
  RNA secondary structure sequence
atcacagcgtgtctcatgcc

SEQ ID NO: 21639 - DNA, 20 bp, Unknown
  RNA secondary structure sequence
cagagggccaatacggtttg

SEQ ID NO: 21640 - DNA, 20 bp, Unknown
  RNA secondary structure sequence
gggcaaaaaacaaaagaaaa

SEQ ID NO: 21641 - DNA, 20 bp, Unknown
  RNA secondary structure sequence
caatcaatgctggattcgag

SEQ ID NO: 21642 - DNA, 20 bp, Unknown
  RNA secondary structure sequence
acccacccttgacataagaa

SEQ ID NO: 21643 - DNA, 20 bp, Unknown
  RNA secondary structure sequence
gaccgacagaggctggggta

SEQ ID NO: 21644 - DNA, 20 bp, Unknown
  RNA secondary structure sequence
agtgcatcgtgagtggttca

SEQ ID NO: 21645 - DNA, 20 bp, Unknown
  RNA secondary structure sequence
tacctcggagtgtgacagca

SEQ ID NO: 21646 - DNA, 20 bp, Unknown
  RNA secondary structure sequence
gcccgccacagaggtgttaa

SEQ ID NO: 21647 - DNA, 20 bp, Unknown
  RNA secondary structure sequence
cgcgtttgggtattggctga

SEQ ID NO: 21648 - DNA, 20 bp, Unknown
  RNA secondary structure sequence
tagtgccagtgctgcccaac

SEQ ID NO: 21649 - DNA, 20 bp, Unknown
  RNA secondary structure sequence
gtacggtcccgaaagagata

SEQ ID NO: 21650 - DNA, 20 bp, Unknown
  RNA secondary structure sequence
ctttgattttttcaccctgg

SEQ ID NO: 21651 - DNA, 20 bp, Unknown
  RNA secondary structure sequence
tcaggtgctcattggaagaa

SEQ ID NO: 21652 - DNA, 20 bp, Unknown
  RNA secondary structure sequence
gtgtcagatcgcgaaagcgc

SEQ ID NO: 21653 - DNA, 20 bp, Unknown
  RNA secondary structure sequence
ctcgccgaagctgtaaggcg

SEQ ID NO: 21654 - DNA, 20 bp, Unknown
  RNA secondary structure sequence
ctctcaaaagcatcaaacaa

SEQ ID NO: 21655 - DNA, 20 bp, Unknown
  RNA secondary structure sequence
gtatccaataaatcctcttg

SEQ ID NO: 21656 - DNA, 20 bp, Unknown
  RNA secondary structure sequence
gacccttcgtgcaccctaaa

SEQ ID NO: 21657 - DNA, 20 bp, Unknown
  RNA secondary structure sequence
atctactcacggaggaccct

SEQ ID NO: 21658 - DNA, 20 bp, Unknown
  RNA secondary structure sequence
cgttcccccttcgcctggga

SEQ ID NO: 21659 - DNA, 20 bp, Unknown
  RNA secondary structure sequence
tagtccactatcgccagttg

SEQ ID NO: 21660 - DNA, 20 bp, Unknown
  RNA secondary structure sequence
gagaaacagaggaaaaggaa

SEQ ID NO: 21661 - DNA, 20 bp, Unknown
  RNA secondary structure sequence
aaaacagtcccaccctgttt

SEQ ID NO: 21662 - DNA, 20 bp, Unknown
  RNA secondary structure sequence
tctgtcgcctctggatccct

SEQ ID NO: 21663 - DNA, 20 bp, Unknown
  RNA secondary structure sequence
gagaagtagccactagagaa

SEQ ID NO: 21664 - DNA, 20 bp, Unknown
  RNA secondary structure sequence
ccagcaagtctgccgtcaaa

SEQ ID NO: 21665 - DNA, 20 bp, Unknown
  RNA secondary structure sequence
ccaaagttgtaaccaagaag

SEQ ID NO: 21666 - DNA, 20 bp, Unknown
  RNA secondary structure sequence
gggtccgcagacaccaaact

SEQ ID NO: 21667 - DNA, 20 bp, Unknown
  RNA secondary structure sequence
ttcaacgctctcaaaatccc

SEQ ID NO: 21668 - DNA, 20 bp, Unknown
  RNA secondary structure sequence
aatatcaggcaaccaccctc

SEQ ID NO: 21669 - DNA, 20 bp, Unknown
  RNA secondary structure sequence
tacccttaaggcaggcaaag

SEQ ID NO: 21670 - DNA, 20 bp, Unknown
  RNA secondary structure sequence
tctcaaagaagtcgaaaagt

SEQ ID NO: 21671 - DNA, 20 bp, Unknown
  RNA secondary structure sequence
gtatacagtagtttgaatcc

SEQ ID NO: 21672 - DNA, 20 bp, Unknown
  RNA secondary structure sequence
agcagtcgctactctgttca

SEQ ID NO: 21673 - DNA, 20 bp, Unknown
  RNA secondary structure sequence
ctaaaccagatggaaggtgg

SEQ ID NO: 21674 - DNA, 20 bp, Unknown
  RNA secondary structure sequence
atgttacaccacccaaagat

SEQ ID NO: 21675 - DNA, 20 bp, Unknown
  RNA secondary structure sequence
gcaaagtaaaagtttccaga

SEQ ID NO: 21676 - DNA, 20 bp, Unknown
  RNA secondary structure sequence
gttttacatggttataccca

SEQ ID NO: 21677 - DNA, 20 bp, Unknown
  RNA secondary structure sequence
aactcttatttggtatagat

SEQ ID NO: 21678 - DNA, 20 bp, Unknown
  RNA secondary structure sequence
agagggtggctaggcctgca

SEQ ID NO: 21679 - DNA, 20 bp, Unknown
  RNA secondary structure sequence
attgcacgttctcttagaat

SEQ ID NO: 21680 - DNA, 20 bp, Unknown
  RNA secondary structure sequence
tataaaactccaaagtcctg

SEQ ID NO: 21681 - DNA, 20 bp, Unknown
  RNA secondary structure sequence
aagagagccctgcctaagga

SEQ ID NO: 21682 - DNA, 20 bp, Unknown
  RNA secondary structure sequence
ggtaggcctgtaaatgaaat

SEQ ID NO: 21683 - DNA, 20 bp, Unknown
  RNA secondary structure sequence
attgggttatattatgaatt

SEQ ID NO: 21684 - DNA, 20 bp, Unknown
  RNA secondary structure sequence
gggctaaaaatagaagtcac

SEQ ID NO: 21685 - DNA, 20 bp, Unknown
  RNA secondary structure sequence
gacttcaggacctgcagact

SEQ ID NO: 21686 - DNA, 20 bp, Unknown
  RNA secondary structure sequence
ctcaccacattaagctccaa

SEQ ID NO: 21687 - DNA, 20 bp, Unknown
  RNA secondary structure sequence
gttgcccagaaggtccaaaa

SEQ ID NO: 21688 - DNA, 20 bp, Unknown
  RNA secondary structure sequence
acactttttggactcctgga

SEQ ID NO: 21689 - DNA, 20 bp, Unknown
  RNA secondary structure sequence
attgtaacttgctgccaggc

SEQ ID NO: 21690 - DNA, 20 bp, Unknown
  RNA secondary structure sequence
ttcaaagctctgcagttcca

SEQ ID NO: 21691 - DNA, 20 bp, Unknown
  RNA secondary structure sequence
caatattatctttgtcagaa

SEQ ID NO: 21692 - DNA, 20 bp, Unknown
  RNA secondary structure sequence
tctcagggtgtgtgcggcgt

SEQ ID NO: 21693 - DNA, 20 bp, Unknown
  RNA secondary structure sequence
ggaagccaggaatgtccagg

SEQ ID NO: 21694 - DNA, 20 bp, Unknown
  RNA secondary structure sequence
tttcactggtgctgcaatgg

SEQ ID NO: 21695 - DNA, 20 bp, Unknown
  RNA secondary structure sequence
cgccttcctctgcttttccc

SEQ ID NO: 21696 - DNA, 20 bp, Unknown
  RNA secondary structure sequence
cccccacatgtggatcgttg

SEQ ID NO: 21697 - DNA, 20 bp, Unknown
  RNA secondary structure sequence
cacctttactgatgagctca

SEQ ID NO: 21698 - DNA, 20 bp, Unknown
  RNA secondary structure sequence
cacttccacttgcaattcct

SEQ ID NO: 21699 - DNA, 20 bp, Unknown
  RNA secondary structure sequence
atgggaaaaagcaaaaacca

SEQ ID NO: 21700 - DNA, 20 bp, Unknown
  RNA secondary structure sequence
tgattggcttaagagcaaat

SEQ ID NO: 21701 - DNA, 20 bp, Unknown
  RNA secondary structure sequence
ttctatgccccccgattcgg

SEQ ID NO: 21702 - DNA, 20 bp, Unknown
  RNA secondary structure sequence
gaggagaacagtcgctcatg

SEQ ID NO: 21703 - DNA, 20 bp, Unknown
  RNA secondary structure sequence
tgttttcaccatccttggta

SEQ ID NO: 21704 - DNA, 20 bp, Unknown
  RNA secondary structure sequence
cttatgtaacgatgagttag

SEQ ID NO: 21705 - DNA, 20 bp, Unknown
  RNA secondary structure sequence
gcagagatattgtatttaag

SEQ ID NO: 21706 - DNA, 20 bp, Unknown
  RNA secondary structure sequence
tggtcggccacaggcggcgt

SEQ ID NO: 21707 - DNA, 20 bp, Unknown
  RNA secondary structure sequence
cctcctgcttcccttccacc

SEQ ID NO: 21708 - DNA, 20 bp, Unknown
  RNA secondary structure sequence
aattccgcattgcagagata

SEQ ID NO: 21709 - DNA, 20 bp, Unknown
  RNA secondary structure sequence
gctgcggcttaggagggcag

SEQ ID NO: 21710 - DNA, 20 bp, Unknown
  RNA secondary structure sequence
cggcgaatcgacaagggaga

SEQ ID NO: 21711 - DNA, 20 bp, Unknown
  RNA secondary structure sequence
gttattttaggacccgcccc

SEQ ID NO: 21712 - DNA, 20 bp, Unknown
  RNA secondary structure sequence
tcccaccaggatcacagtgc

SEQ ID NO: 21713 - DNA, 20 bp, Unknown
  RNA secondary structure sequence
ttctctcagctggagaaaca

SEQ ID NO: 21714 - DNA, 20 bp, Unknown
  RNA secondary structure sequence
ctgcggggcgaggagctggc

SEQ ID NO: 21715 - DNA, 20 bp, Unknown
  RNA secondary structure sequence
tgccagcaggcctggtacca

SEQ ID NO: 21716 - DNA, 20 bp, Unknown
  RNA secondary structure sequence
cagcccatttacatcgtcat

SEQ ID NO: 21717 - DNA, 20 bp, Unknown
  RNA secondary structure sequence
aactgcctggtgacagaaaa

SEQ ID NO: 21718 - DNA, 20 bp, Unknown
  RNA secondary structure sequence
tttgggatcctgctgtggga

SEQ ID NO: 21719 - DNA, 20 bp, Unknown
  RNA secondary structure sequence
tgccacttagtcatcattac

SEQ ID NO: 21720 - DNA, 20 bp, Unknown
  RNA secondary structure sequence
gtggtggccatgcctgtagt

SEQ ID NO: 21721 - DNA, 20 bp, Unknown
  RNA secondary structure sequence
gcccctcttacggatcaagg

SEQ ID NO: 21722 - DNA, 20 bp, Unknown
  RNA secondary structure sequence
cggaagtcaggaaacagccg

SEQ ID NO: 21723 - DNA, 20 bp, Unknown
  RNA secondary structure sequence
cataaagatcgccccttggt

SEQ ID NO: 21724 - DNA, 20 bp, Unknown
  RNA secondary structure sequence
cacttagttgttggaacaca

SEQ ID NO: 21725 - DNA, 20 bp, Unknown
  RNA secondary structure sequence
aatatcttgggtacaagtta

SEQ ID NO: 21726 - DNA, 20 bp, Unknown
  RNA secondary structure sequence
ggtcagatcctaacgaggcg

SEQ ID NO: 21727 - DNA, 20 bp, Unknown
  RNA secondary structure sequence
ccacacacccaaggccatgc

SEQ ID NO: 21728 - DNA, 20 bp, Unknown
  RNA secondary structure sequence
cgctcccagaggggatcctg

SEQ ID NO: 21729 - DNA, 20 bp, Unknown
  RNA secondary structure sequence
agtgggaaaaaggatggaac

SEQ ID NO: 21730 - DNA, 20 bp, Unknown
  RNA secondary structure sequence
gagcagccagggaacctttg

SEQ ID NO: 21731 - DNA, 20 bp, Unknown
  RNA secondary structure sequence
ggaactgaccggttagtctt

SEQ ID NO: 21732 - DNA, 20 bp, Unknown
  RNA secondary structure sequence
actcaggtctctggcgtggc

SEQ ID NO: 21733 - DNA, 20 bp, Unknown
  RNA secondary structure sequence
tttatggggagtgagtactg

SEQ ID NO: 21734 - DNA, 20 bp, Unknown
  RNA secondary structure sequence
gcggtcctgcagaaccgagc

SEQ ID NO: 21735 - DNA, 20 bp, Unknown
  RNA secondary structure sequence
atcggaagttggctgcgagg

SEQ ID NO: 21736 - DNA, 20 bp, Unknown
  RNA secondary structure sequence
tgctcttgcatagggggaaa

SEQ ID NO: 21737 - DNA, 20 bp, Unknown
  RNA secondary structure sequence
agcgtgccggggcactggct

SEQ ID NO: 21738 - DNA, 20 bp, Unknown
  RNA secondary structure sequence
tccccagtaactatgtcgcg

SEQ ID NO: 21739 - DNA, 20 bp, Unknown
  RNA secondary structure sequence
tcgatatggctgctcagatt

SEQ ID NO: 21740 - DNA, 20 bp, Unknown
  RNA secondary structure sequence
ccaagttccccatcaagtgg

SEQ ID NO: 21741 - DNA, 20 bp, Unknown
  RNA secondary structure sequence
gcatgccctgcccgcccgag

SEQ ID NO: 21742 - DNA, 20 bp, Unknown
  RNA secondary structure sequence
cgtcttccctgttttgccct

SEQ ID NO: 21743 - DNA, 20 bp, Unknown
  RNA secondary structure sequence
acttgggaaatcgggagagt

SEQ ID NO: 21744 - DNA, 20 bp, Unknown
  RNA secondary structure sequence
cgacaaaggggaggaagtgg

SEQ ID NO: 21745 - DNA, 20 bp, Unknown
  RNA secondary structure sequence
ggcggttgaggggtcagatc

SEQ ID NO: 21746 - DNA, 20 bp, Unknown
  RNA secondary structure sequence
tacggatcaaggcatagccg

SEQ ID NO: 21747 - DNA, 20 bp, Unknown
  RNA secondary structure sequence
tgttggaacacacctgtctt

SEQ ID NO: 21748 - DNA, 20 bp, Unknown
  RNA secondary structure sequence
gggtacaagttaggcagtac

SEQ ID NO: 21749 - DNA, 20 bp, Unknown
  RNA secondary structure sequence
ccaaggccatgtttgtggtt

SEQ ID NO: 21750 - DNA, 20 bp, Unknown
  RNA secondary structure sequence
agagaggctaaagatcttca

SEQ ID NO: 21751 - DNA, 20 bp, Unknown
  RNA secondary structure sequence
agggaacctttggattacat

SEQ ID NO: 21752 - DNA, 20 bp, Unknown
  RNA secondary structure sequence
cggtataaccgggggatgcg

SEQ ID NO: 21753 - DNA, 20 bp, Unknown
  RNA secondary structure sequence
ccgagcggctattgacttct

SEQ ID NO: 21754 - DNA, 20 bp, Unknown
  RNA secondary structure sequence
acagcctgagaggcactggc

SEQ ID NO: 21755 - DNA, 20 bp, Unknown
  RNA secondary structure sequence
aaattaaactcctcttgaat

SEQ ID NO: 21756 - DNA, 20 bp, Unknown
  RNA secondary structure sequence
cagaaaccacaaaagaatac

SEQ ID NO: 21757 - DNA, 20 bp, Unknown
  RNA secondary structure sequence
gataattgatgtcttgttct

SEQ ID NO: 21758 - DNA, 20 bp, Unknown
  RNA secondary structure sequence
aatccagagatatacagttc

SEQ ID NO: 21759 - DNA, 20 bp, Unknown
  RNA secondary structure sequence
ggcagcttatcagggagatt

SEQ ID NO: 21760 - DNA, 20 bp, Unknown
  RNA secondary structure sequence
ctcttttggcttaggtactg

SEQ ID NO: 21761 - DNA, 20 bp, Unknown
  RNA secondary structure sequence
gcatgtctctgttggtaccc

SEQ ID NO: 21762 - DNA, 20 bp, Unknown
  RNA secondary structure sequence
ccacagcccaaagaaagctt

SEQ ID NO: 21763 - DNA, 20 bp, Unknown
  RNA secondary structure sequence
cgcggaacgcggggaaaggg

SEQ ID NO: 21764 - DNA, 20 bp, Unknown
  RNA secondary structure sequence
tgtaaaggtccccagctatg

SEQ ID NO: 21765 - DNA, 20 bp, Unknown
  RNA secondary structure sequence
actagacaacctgattcatt

SEQ ID NO: 21766 - DNA, 20 bp, Unknown
  RNA secondary structure sequence
tcctgagctctcttgctccc

SEQ ID NO: 21767 - DNA, 20 bp, Unknown
  RNA secondary structure sequence
ggcgtctggcttgcacccgc

SEQ ID NO: 21768 - DNA, 20 bp, Unknown
  RNA secondary structure sequence
cgttttgggtctttccttta

SEQ ID NO: 21769 - DNA, 20 bp, Unknown
  RNA secondary structure sequence
aactttgccaatatattgct

SEQ ID NO: 21770 - DNA, 20 bp, Unknown
  RNA secondary structure sequence
cccccaaaaggccccccccg

SEQ ID NO: 21771 - DNA, 20 bp, Unknown
  RNA secondary structure sequence
gggacttagcgccccccaaa

SEQ ID NO: 21772 - DNA, 20 bp, Unknown
  RNA secondary structure sequence
ggctgaaaatacggtcctcc

SEQ ID NO: 21773 - DNA, 20 bp, Unknown
  RNA secondary structure sequence
gcctggcgggtcctacctca

SEQ ID NO: 21774 - DNA, 20 bp, Unknown
  RNA secondary structure sequence
gccctggctgcccgcctccg

SEQ ID NO: 21775 - DNA, 20 bp, Unknown
  RNA secondary structure sequence
gtcttgggagacctccagtg

SEQ ID NO: 21776 - DNA, 20 bp, Unknown
  RNA secondary structure sequence
tctagatataacgagcaaga

SEQ ID NO: 21777 - DNA, 20 bp, Unknown
  RNA secondary structure sequence
ctgcagactcaggccttaag

SEQ ID NO: 21778 - DNA, 20 bp, Unknown
  RNA secondary structure sequence
tccctttctcatcacgttcc

SEQ ID NO: 21779 - DNA, 20 bp, Unknown
  RNA secondary structure sequence
atcaacaatggatgacaaca

SEQ ID NO: 21780 - DNA, 20 bp, Unknown
  RNA secondary structure sequence
taacctgggaaatatgggga

SEQ ID NO: 21781 - DNA, 20 bp, Unknown
  RNA secondary structure sequence
gggaaccttcccctccctgg

SEQ ID NO: 21782 - DNA, 20 bp, Unknown
  RNA secondary structure sequence
aaggcaacgccttattatta

SEQ ID NO: 21783 - DNA, 20 bp, Unknown
  RNA secondary structure sequence
cttgctgtttcctacgcatt

SEQ ID NO: 21784 - DNA, 20 bp, Unknown
  RNA secondary structure sequence
ccgattacatcaaccttcga

SEQ ID NO: 21785 - DNA, 20 bp, Unknown
  RNA secondary structure sequence
agtgtagcgcagagaggttg

SEQ ID NO: 21786 - DNA, 20 bp, Unknown
  RNA secondary structure sequence
ttcttgcagctgtgctaagc

SEQ ID NO: 21787 - DNA, 20 bp, Unknown
  RNA secondary structure sequence
cttcccatgtaacaagcccc

SEQ ID NO: 21788 - DNA, 20 bp, Unknown
  RNA secondary structure sequence
actttcccccttcgagcagt

SEQ ID NO: 21789 - DNA, 20 bp, Unknown
  RNA secondary structure sequence
cccccccttcgataccctcc

SEQ ID NO: 21790 - DNA, 20 bp, Unknown
  RNA secondary structure sequence
cacctggtcagaattggttg

SEQ ID NO: 21791 - DNA, 20 bp, Unknown
  RNA secondary structure sequence
ctcagctctcggtcctgagc

SEQ ID NO: 21792 - DNA, 20 bp, Unknown
  RNA secondary structure sequence
taaggcaaaccacggtttgg

SEQ ID NO: 21793 - DNA, 20 bp, Unknown
  RNA secondary structure sequence
tgaaagcgatgaatccgtta

SEQ ID NO: 21794 - DNA, 20 bp, Unknown
  RNA secondary structure sequence
acgtacaatgcaatgctaca

SEQ ID NO: 21795 - DNA, 20 bp, Unknown
  RNA secondary structure sequence
acacctatgtgccaattacc

SEQ ID NO: 21796 - DNA, 20 bp, Unknown
  RNA secondary structure sequence
acaagaatcactcaacaagt

SEQ ID NO: 21797 - DNA, 20 bp, Unknown
  RNA secondary structure sequence
cctgggcacctagggcgcct

SEQ ID NO: 21798 - DNA, 20 bp, Unknown
  RNA secondary structure sequence
caggcggtgagggaatagtt

SEQ ID NO: 21799 - DNA, 20 bp, Unknown
  RNA secondary structure sequence
gagaggacagtttattggaa

SEQ ID NO: 21800 - DNA, 20 bp, Unknown
  RNA secondary structure sequence
gcatcccatacacaataaga

SEQ ID NO: 21801 - DNA, 20 bp, Unknown
  RNA secondary structure sequence
ataaacaacagacagtggtc

SEQ ID NO: 21802 - DNA, 20 bp, Unknown
  RNA secondary structure sequence
gtccactgatttgtggaaag

SEQ ID NO: 21803 - DNA, 20 bp, Unknown
  RNA secondary structure sequence
attgccggcgttccgcactg

SEQ ID NO: 21804 - DNA, 20 bp, Unknown
  RNA secondary structure sequence
caacctcatgctccactaag

SEQ ID NO: 21805 - DNA, 20 bp, Unknown
  RNA secondary structure sequence
gctggaacgcctctgaggtc

SEQ ID NO: 21806 - DNA, 20 bp, Unknown
  RNA secondary structure sequence
gccgtgattatatccccggc

SEQ ID NO: 21807 - DNA, 20 bp, Unknown
  RNA secondary structure sequence
ccctatacaggtttaatcgc

SEQ ID NO: 21808 - DNA, 20 bp, Unknown
  RNA secondary structure sequence
ccccggccataacccaccag

SEQ ID NO: 21809 - DNA, 20 bp, Unknown
  RNA secondary structure sequence
accccgcatcctttgatgct

SEQ ID NO: 21810 - DNA, 20 bp, Unknown
  RNA secondary structure sequence
acccactcctcgggaccggc

SEQ ID NO: 21811 - DNA, 20 bp, Unknown
  RNA secondary structure sequence
cagcaaatctggctatcgaa

SEQ ID NO: 21812 - DNA, 20 bp, Unknown
  RNA secondary structure sequence
agatcccagccatcgacttt

SEQ ID NO: 21813 - DNA, 20 bp, Unknown
  RNA secondary structure sequence
ccttgacgcgccacactgag

SEQ ID NO: 21814 - DNA, 20 bp, Unknown
  RNA secondary structure sequence
cagatattgtgcactgtcgt

SEQ ID NO: 21815 - DNA, 20 bp, Unknown
  RNA secondary structure sequence
aattgtacgagctagtggag

SEQ ID NO: 21816 - DNA, 20 bp, Unknown
  RNA secondary structure sequence
agtttgattccacccagaat

SEQ ID NO: 21817 - DNA, 20 bp, Unknown
  RNA secondary structure sequence
gcacccttctatggaataca

SEQ ID NO: 21818 - DNA, 20 bp, Unknown
  RNA secondary structure sequence
atgtagctcagatgtgtgtg

SEQ ID NO: 21819 - DNA, 20 bp, Unknown
  RNA secondary structure sequence
gattctcagcccttcgcaat

SEQ ID NO: 21820 - DNA, 20 bp, Unknown
  RNA secondary structure sequence
gctggggccgcgccgctaac

SEQ ID NO: 21821 - DNA, 20 bp, Unknown
  RNA secondary structure sequence
tccgttgacatgaattcaat

SEQ ID NO: 21822 - DNA, 20 bp, Unknown
  RNA secondary structure sequence
gggactgccgagctcaccac

SEQ ID NO: 21823 - DNA, 20 bp, Unknown
  RNA secondary structure sequence
acaccttccccagccccatc

SEQ ID NO: 21824 - DNA, 20 bp, Unknown
  RNA secondary structure sequence
ctgctcgttgagaatgccgc

SEQ ID NO: 21825 - DNA, 20 bp, Unknown
  RNA secondary structure sequence
cagtctactgtcgctgagct

SEQ ID NO: 21826 - DNA, 20 bp, Unknown
  RNA secondary structure sequence
gggcagaaaacaaaacaaaa

SEQ ID NO: 21827 - DNA, 20 bp, Unknown
  RNA secondary structure sequence
tggcagtaacaacggtcaac

SEQ ID NO: 21828 - DNA, 20 bp, Unknown
  RNA secondary structure sequence
aggcttcactgatcgtgggt

SEQ ID NO: 21829 - DNA, 20 bp, Unknown
  RNA secondary structure sequence
agccatcgtggtggagtact

SEQ ID NO: 21830 - DNA, 20 bp, Unknown
  RNA secondary structure sequence
atcctactctgggagtgatg

SEQ ID NO: 21831 - DNA, 20 bp, Unknown
  RNA secondary structure sequence
ggttgggaggggagacaagc

SEQ ID NO: 21832 - DNA, 20 bp, Unknown
  RNA secondary structure sequence
tgacactggatgtgccattg

SEQ ID NO: 21833 - DNA, 20 bp, Unknown
  RNA secondary structure sequence
acaggttgatgctttcaatg

SEQ ID NO: 21834 - DNA, 20 bp, Unknown
  RNA secondary structure sequence
ggcgaggtatgtggtgctag

SEQ ID NO: 21835 - DNA, 20 bp, Unknown
  RNA secondary structure sequence
gtggccagccactgagtttt

SEQ ID NO: 21836 - DNA, 20 bp, Unknown
  RNA secondary structure sequence
tgttttccacacactatggc

SEQ ID NO: 21837 - DNA, 20 bp, Unknown
  RNA secondary structure sequence
tgatttgcaagatgagatac

SEQ ID NO: 21838 - DNA, 20 bp, Unknown
  RNA secondary structure sequence
tgggccgcgcacgaatgcca

SEQ ID NO: 21839 - DNA, 20 bp, Unknown
  RNA secondary structure sequence
accggaaaaacagaggtcac

SEQ ID NO: 21840 - DNA, 20 bp, Unknown
  RNA secondary structure sequence
aagcatggcactggacctgc

SEQ ID NO: 21841 - DNA, 20 bp, Unknown
  RNA secondary structure sequence
ggctacgctcactttgtggg

SEQ ID NO: 21842 - DNA, 20 bp, Unknown
  RNA secondary structure sequence
aaaagttctctgcccttaca

SEQ ID NO: 21843 - DNA, 20 bp, Unknown
  RNA secondary structure sequence
actactggggcgaatggatc

SEQ ID NO: 21844 - DNA, 20 bp, Unknown
  RNA secondary structure sequence
agtgttcgctgaacagaatc

SEQ ID NO: 21845 - DNA, 20 bp, Unknown
  RNA secondary structure sequence
agggaaaatgtacgctgatg

SEQ ID NO: 21846 - DNA, 20 bp, Unknown
  RNA secondary structure sequence
agaaggaaagaccgtaatgg

SEQ ID NO: 21847 - DNA, 20 bp, Unknown
  RNA secondary structure sequence
gatagctgtcaggacctggc

SEQ ID NO: 21848 - DNA, 20 bp, Unknown
  RNA secondary structure sequence
agcatatgcacagatgtggc

SEQ ID NO: 21849 - DNA, 20 bp, Unknown
  RNA secondary structure sequence
ccggatactgggtagacggt

SEQ ID NO: 21850 - DNA, 20 bp, Unknown
  RNA secondary structure sequence
tagaggttagaggagacccc

SEQ ID NO: 21851 - DNA, 20 bp, Unknown
  RNA secondary structure sequence
gaccccgcatttgcatcaaa

SEQ ID NO: 21852 - DNA, 20 bp, Unknown
  RNA secondary structure sequence
cccgaacagggacctgagag

SEQ ID NO: 21853 - DNA, 20 bp, Unknown
  RNA secondary structure sequence
gttagagaaggtgacggtac

SEQ ID NO: 21854 - DNA, 20 bp, Unknown
  RNA secondary structure sequence
tcagaaaaatctaagtgtga

SEQ ID NO: 21855 - DNA, 20 bp, Unknown
  RNA secondary structure sequence
gttgaggatgtaatgaacac

SEQ ID NO: 21856 - DNA, 20 bp, Unknown
  RNA secondary structure sequence
cctatagatattttatatgg

SEQ ID NO: 21857 - DNA, 20 bp, Unknown
  RNA secondary structure sequence
tttgaggtagaaaatagtac

SEQ ID NO: 21858 - DNA, 20 bp, Unknown
  RNA secondary structure sequence
catactggtcatccctggaa

SEQ ID NO: 21859 - DNA, 20 bp, Unknown
  RNA secondary structure sequence
aagagctgggtgaagtcaat

SEQ ID NO: 21860 - DNA, 20 bp, Unknown
  RNA secondary structure sequence
tatgactgttgcattaaagc

SEQ ID NO: 21861 - DNA, 20 bp, Unknown
  RNA secondary structure sequence
ctttgtaataaatataattc

SEQ ID NO: 21862 - DNA, 20 bp, Unknown
  RNA secondary structure sequence
ctccgggcctctcctgcctg

SEQ ID NO: 21863 - DNA, 20 bp, Unknown
  RNA secondary structure sequence
gaccccttaaaagacggagg

SEQ ID NO: 21864 - DNA, 20 bp, Unknown
  RNA secondary structure sequence
ggcaagacagatatgcctgc

SEQ ID NO: 21865 - DNA, 20 bp, Unknown
  RNA secondary structure sequence
gccacgtgtggtgccgtccg

SEQ ID NO: 21866 - DNA, 20 bp, Unknown
  RNA secondary structure sequence
attaagaagaaatcaggaaa

SEQ ID NO: 21867 - DNA, 20 bp, Unknown
  RNA secondary structure sequence
gctgtgtccttgcatttaga

SEQ ID NO: 21868 - DNA, 20 bp, Unknown
  RNA secondary structure sequence
ttgggcatagaacatactac

SEQ ID NO: 21869 - DNA, 20 bp, Unknown
  RNA secondary structure sequence
ttttgaatataaaagcctgt

SEQ ID NO: 21870 - DNA, 20 bp, Unknown
  RNA secondary structure sequence
aattaaaattacctctctct

SEQ ID NO: 21871 - DNA, 20 bp, Unknown
  RNA secondary structure sequence
acccagagagagggatatgt

SEQ ID NO: 21872 - DNA, 20 bp, Unknown
  RNA secondary structure sequence
aggcgcaaggggaaaacaag

SEQ ID NO: 21873 - DNA, 20 bp, Unknown
  RNA secondary structure sequence
acgcaactgctgcccagcag

SEQ ID NO: 21874 - DNA, 20 bp, Unknown
  RNA secondary structure sequence
tgtaaacaagttgcctatat

SEQ ID NO: 21875 - DNA, 20 bp, Unknown
  RNA secondary structure sequence
gagttgatcacaaatgaact

SEQ ID NO: 21876 - DNA, 20 bp, Unknown
  RNA secondary structure sequence
atagggagagtaactggaag

SEQ ID NO: 21877 - DNA, 20 bp, Unknown
  RNA secondary structure sequence
tgcaagaaaggaaagaactt

SEQ ID NO: 21878 - DNA, 20 bp, Unknown
  RNA secondary structure sequence
aagaacacaaaaattgtcgg

SEQ ID NO: 21879 - DNA, 20 bp, Unknown
  RNA secondary structure sequence
ccacaaagtcacgttgatgt

SEQ ID NO: 21880 - DNA, 20 bp, Unknown
  RNA secondary structure sequence
agccaggtggtgaagttagt

SEQ ID NO: 21881 - DNA, 20 bp, Unknown
  RNA secondary structure sequence
gacagtacctcttgcaatag

SEQ ID NO: 21882 - DNA, 20 bp, Unknown
  RNA secondary structure sequence
ttgcaatgtgtgcctatctt

SEQ ID NO: 21883 - DNA, 20 bp, Unknown
  RNA secondary structure sequence
cacaggaaagttatagaaga

SEQ ID NO: 21884 - DNA, 20 bp, Unknown
  RNA secondary structure sequence
ataacgtgtgggatgtcgct

SEQ ID NO: 21885 - DNA, 20 bp, Unknown
  RNA secondary structure sequence
cctgctgaggaaggtgactt

SEQ ID NO: 21886 - DNA, 20 bp, Unknown
  RNA secondary structure sequence
ccaaaagcagttatagagga

SEQ ID NO: 21887 - DNA, 20 bp, Unknown
  RNA secondary structure sequence
gctgttaagaacataatggc

SEQ ID NO: 21888 - DNA, 20 bp, Unknown
  RNA secondary structure sequence
caggctctctcaaagaggca

SEQ ID NO: 21889 - DNA, 20 bp, Unknown
  RNA secondary structure sequence
cacacagcactatacaaaag

SEQ ID NO: 21890 - DNA, 20 bp, Unknown
  RNA secondary structure sequence
tccgagacacagcaagaagg

SEQ ID NO: 21891 - DNA, 20 bp, Unknown
  RNA secondary structure sequence
ggcaaacttaccaaagtgga

SEQ ID NO: 21892 - DNA, 20 bp, Unknown
  RNA secondary structure sequence
gggactataaaaccagtact

SEQ ID NO: 21893 - DNA, 20 bp, Unknown
  RNA secondary structure sequence
gcttaccaattggcacaggg

SEQ ID NO: 21894 - DNA, 20 bp, Unknown
  RNA secondary structure sequence
cgcccaacacgcacagctaa

SEQ ID NO: 21895 - DNA, 20 bp, Unknown
  RNA secondary structure sequence
aggtaccgagacctcaaaat

SEQ ID NO: 21896 - DNA, 20 bp, Unknown
  RNA secondary structure sequence
caagcagcagcacaagctaa

SEQ ID NO: 21897 - DNA, 20 bp, Unknown
  RNA secondary structure sequence
aaaatgcaattgttagcaca

SEQ ID NO: 21898 - DNA, 20 bp, Unknown
  RNA secondary structure sequence
agagacataaggggaaaaca

SEQ ID NO: 21899 - DNA, 20 bp, Unknown
  RNA secondary structure sequence
aggcacccccacattggaca

SEQ ID NO: 21900 - DNA, 20 bp, Unknown
  RNA secondary structure sequence
tgtatcaggagaaagggaaa

SEQ ID NO: 21901 - DNA, 20 bp, Unknown
  RNA secondary structure sequence
gaattatggaaattgcccac

SEQ ID NO: 21902 - DNA, 20 bp, Unknown
  RNA secondary structure sequence
atagcagaaagcattaatgg

SEQ ID NO: 21903 - DNA, 20 bp, Unknown
  RNA secondary structure sequence
atacaagacaacaggagagg

SEQ ID NO: 21904 - DNA, 20 bp, Unknown
  RNA secondary structure sequence
tctctggcaaatggagaatg

SEQ ID NO: 21905 - DNA, 20 bp, Unknown
  RNA secondary structure sequence
caacctaaggtgtcagaaaa

SEQ ID NO: 21906 - DNA, 20 bp, Unknown
  RNA secondary structure sequence
attagggcaagaaacattcc

SEQ ID NO: 21907 - DNA, 20 bp, Unknown
  RNA secondary structure sequence
gaaaaaaagagaactcagcc

SEQ ID NO: 21908 - DNA, 20 bp, Unknown
  RNA secondary structure sequence
gcaggatgtgttagaggcaa

SEQ ID NO: 21909 - DNA, 20 bp, Unknown
  RNA secondary structure sequence
agcaaaatatatcaattgga

SEQ ID NO: 21910 - DNA, 20 bp, Unknown
  RNA secondary structure sequence
agacgtctttgattggtcag

SEQ ID NO: 21911 - DNA, 20 bp, Unknown
  RNA secondary structure sequence
actgtagctctgagctgtat

SEQ ID NO: 21912 - DNA, 20 bp, Unknown
  RNA secondary structure sequence
cccgtaggacgctctaatac

SEQ ID NO: 21913 - DNA, 20 bp, Unknown
  RNA secondary structure sequence
acaaaatgggggctcaagta

SEQ ID NO: 21914 - DNA, 20 bp, Unknown
  RNA secondary structure sequence
cttctgatgatttccaatcg

SEQ ID NO: 21915 - DNA, 20 bp, Unknown
  RNA secondary structure sequence
tcttgtgccgatctgcttgt

SEQ ID NO: 21916 - DNA, 20 bp, Unknown
  RNA secondary structure sequence
tcagtattggaaatgcttat

SEQ ID NO: 21917 - DNA, 20 bp, Unknown
  RNA secondary structure sequence
tacgcgacctgctgtggtta

SEQ ID NO: 21918 - DNA, 20 bp, Unknown
  RNA secondary structure sequence
ccctagtaaaaattgtgtca

SEQ ID NO: 21919 - DNA, 20 bp, Unknown
  RNA secondary structure sequence
ccattgagcaaagtgcacct

SEQ ID NO: 21920 - DNA, 20 bp, Unknown
  RNA secondary structure sequence
ttgaacctgtatgcttgctc

SEQ ID NO: 21921 - DNA, 20 bp, Unknown
  RNA secondary structure sequence
tatgccagaacccagatggt

SEQ ID NO: 21922 - DNA, 20 bp, Unknown
  RNA secondary structure sequence
gggcactggctaggaggttt

SEQ ID NO: 21923 - DNA, 20 bp, Unknown
  RNA secondary structure sequence
atagaaggacacaagtcaga

SEQ ID NO: 21924 - DNA, 20 bp, Unknown
  RNA secondary structure sequence
cagatctactcaaatcagta

SEQ ID NO: 21925 - DNA, 20 bp, Unknown
  RNA secondary structure sequence
caggtcagtgtggcggagtg

SEQ ID NO: 21926 - DNA, 20 bp, Unknown
  RNA secondary structure sequence
cgcctagcaaaactaaattg

SEQ ID NO: 21927 - DNA, 20 bp, Unknown
  RNA secondary structure sequence
tcacctgggctaatgtcaca

SEQ ID NO: 21928 - DNA, 20 bp, Unknown
  RNA secondary structure sequence
gtgaattgtgtgaagacaca

SEQ ID NO: 21929 - DNA, 20 bp, Unknown
  RNA secondary structure sequence
cggacacacaagggtcaaat

SEQ ID NO: 21930 - DNA, 20 bp, Unknown
  RNA secondary structure sequence
atctcaagtgcaggctgaga

SEQ ID NO: 21931 - DNA, 20 bp, Unknown
  RNA secondary structure sequence
ttgatggccccgaaacagca

SEQ ID NO: 21932 - DNA, 20 bp, Unknown
  RNA secondary structure sequence
ccgtccatgccgatatgggt

SEQ ID NO: 21933 - DNA, 20 bp, Unknown
  RNA secondary structure sequence
cttatcttgccctactagca

SEQ ID NO: 21934 - DNA, 20 bp, Unknown
  RNA secondary structure sequence
cagattggataccattagca

SEQ ID NO: 21935 - DNA, 20 bp, Unknown
  RNA secondary structure sequence
caggaccattagtggctgga

SEQ ID NO: 21936 - DNA, 20 bp, Unknown
  RNA secondary structure sequence
aaaatgaagaggaagaacaa

SEQ ID NO: 21937 - DNA, 20 bp, Unknown
  RNA secondary structure sequence
agaaagacctaatatcatat

SEQ ID NO: 21938 - DNA, 20 bp, Unknown
  RNA secondary structure sequence
ctcctggaacgtcaggatct

SEQ ID NO: 21939 - DNA, 20 bp, Unknown
  RNA secondary structure sequence
gggttatagaccccagacgc

SEQ ID NO: 21940 - DNA, 20 bp, Unknown
  RNA secondary structure sequence
tgagaagaggagacctacca

SEQ ID NO: 21941 - DNA, 20 bp, Unknown
  RNA secondary structure sequence
cctcagtgaatgtgtcccta

SEQ ID NO: 21942 - DNA, 20 bp, Unknown
  RNA secondary structure sequence
aaggcctaacaaaaggagga

SEQ ID NO: 21943 - DNA, 20 bp, Unknown
  RNA secondary structure sequence
ccaggatgtgcaccagagaa

SEQ ID NO: 21944 - DNA, 20 bp, Unknown
  RNA secondary structure sequence
tggaaggagaagggctgcac

SEQ ID NO: 21945 - DNA, 20 bp, Unknown
  RNA secondary structure sequence
ccgaggccattttcaaacta

SEQ ID NO: 21946 - DNA, 20 bp, Unknown
  RNA secondary structure sequence
taaatgacatgggaaagatt

SEQ ID NO: 21947 - DNA, 20 bp, Unknown
  RNA secondary structure sequence
aggtcggattaagccatagt

SEQ ID NO: 21948 - DNA, 20 bp, Unknown
  RNA secondary structure sequence
gcatggcgtagtggactagc

SEQ ID NO: 21949 - DNA, 20 bp, Unknown
  RNA secondary structure sequence
cagggaccaatgaaattggt

SEQ ID NO: 21950 - DNA, 20 bp, Unknown
  RNA secondary structure sequence
aaaaagacatcgctctgtct

SEQ ID NO: 21951 - DNA, 20 bp, Unknown
  RNA secondary structure sequence
atgggactggacacacgcac

SEQ ID NO: 21952 - DNA, 20 bp, Unknown
  RNA secondary structure sequence
atgctggtcaccccatccat

SEQ ID NO: 21953 - DNA, 20 bp, Unknown
  RNA secondary structure sequence
ggcaaaggaagcttggtaac

SEQ ID NO: 21954 - DNA, 20 bp, Unknown
  RNA secondary structure sequence
atgttcgaggccactgaaag

SEQ ID NO: 21955 - DNA, 20 bp, Unknown
  RNA secondary structure sequence
ccaaacacaccggagtgtcc

SEQ ID NO: 21956 - DNA, 20 bp, Unknown
  RNA secondary structure sequence
gccgacatgggctactggat

SEQ ID NO: 21957 - DNA, 20 bp, Unknown
  RNA secondary structure sequence
tgttgccgctcgtgcacact

SEQ ID NO: 21958 - DNA, 20 bp, Unknown
  RNA secondary structure sequence
ttagtggccgggggcttgct

SEQ ID NO: 21959 - DNA, 20 bp, Unknown
  RNA secondary structure sequence
ctgatttcatatggaggagg

SEQ ID NO: 21960 - DNA, 20 bp, Unknown
  RNA secondary structure sequence
atggatcttcatcctgggtc

SEQ ID NO: 21961 - DNA, 20 bp, Unknown
  RNA secondary structure sequence
tctgaacacacaggaagaga

SEQ ID NO: 21962 - DNA, 20 bp, Unknown
  RNA secondary structure sequence
ggagaggcagccgcaatctt

SEQ ID NO: 21963 - DNA, 20 bp, Unknown
  RNA secondary structure sequence
attaaagccggaaatgacat

SEQ ID NO: 21964 - DNA, 20 bp, Unknown
  RNA secondary structure sequence
aggggtgaccttccagtttg

SEQ ID NO: 21965 - DNA, 20 bp, Unknown
  RNA secondary structure sequence
gatgcccgcacttattcaga

SEQ ID NO: 21966 - DNA, 20 bp, Unknown
  RNA secondary structure sequence
ggcggtagggcttacaggca

SEQ ID NO: 21967 - DNA, 20 bp, Unknown
  RNA secondary structure sequence
tgcgcagtccaactcttgct

SEQ ID NO: 21968 - DNA, 20 bp, Unknown
  RNA secondary structure sequence
cttgctttttctattatgaa

SEQ ID NO: 21969 - DNA, 20 bp, Unknown
  RNA secondary structure sequence
ttgaaaagaggagagacaac

SEQ ID NO: 21970 - DNA, 20 bp, Unknown
  RNA secondary structure sequence
tacacaaaaggcggtccagg

SEQ ID NO: 21971 - DNA, 20 bp, Unknown
  RNA secondary structure sequence
tggatatctaatggcacagg

SEQ ID NO: 21972 - DNA, 20 bp, Unknown
  RNA secondary structure sequence
atattcaagctcacatacca

SEQ ID NO: 21973 - DNA, 20 bp, Unknown
  RNA secondary structure sequence
gctcaccatcagtggatgac

SEQ ID NO: 21974 - DNA, 20 bp, Unknown
  RNA secondary structure sequence
gcaacctgggcccagaacat

SEQ ID NO: 21975 - DNA, 20 bp, Unknown
  RNA secondary structure sequence
taagccacagtacggaagaa

SEQ ID NO: 21976 - DNA, 20 bp, Unknown
  RNA secondary structure sequence
gttagaggagaccccccgca

SEQ ID NO: 21977 - DNA, 20 bp, Unknown
  RNA secondary structure sequence
atgctggtaactccatccat

SEQ ID NO: 21978 - DNA, 20 bp, Unknown
  RNA secondary structure sequence
caagctcccacgtcggaaat

SEQ ID NO: 21979 - DNA, 20 bp, Unknown
  RNA secondary structure sequence
gaatggtgctgtagatcttg

SEQ ID NO: 21980 - DNA, 20 bp, Unknown
  RNA secondary structure sequence
ggcccactaatagctggagg

SEQ ID NO: 21981 - DNA, 20 bp, Unknown
  RNA secondary structure sequence
cccggcacatctggatctcc

SEQ ID NO: 21982 - DNA, 20 bp, Unknown
  RNA secondary structure sequence
acaataatggacctacatcc

SEQ ID NO: 21983 - DNA, 20 bp, Unknown
  RNA secondary structure sequence
agggtaatagacccgaggcg

SEQ ID NO: 21984 - DNA, 20 bp, Unknown
  RNA secondary structure sequence
aatgagatgggattactgga

SEQ ID NO: 21985 - DNA, 20 bp, Unknown
  RNA secondary structure sequence
gatgtcattcccatggtcac

SEQ ID NO: 21986 - DNA, 20 bp, Unknown
  RNA secondary structure sequence
atccatgcccaccatcaatg

SEQ ID NO: 21987 - DNA, 20 bp, Unknown
  RNA secondary structure sequence
cggccaaaagccacgtgtat

SEQ ID NO: 21988 - DNA, 20 bp, Unknown
  RNA secondary structure sequence
caccttcaaggttaatgatt

SEQ ID NO: 21989 - DNA, 20 bp, Unknown
  RNA secondary structure sequence
ccacgctggaggtttgctgg

SEQ ID NO: 21990 - DNA, 20 bp, Unknown
  RNA secondary structure sequence
cgaatacaaggacttcctgg

SEQ ID NO: 21991 - DNA, 20 bp, Unknown
  RNA secondary structure sequence
gtctagaaactttgctcagt

SEQ ID NO: 21992 - DNA, 20 bp, Unknown
  RNA secondary structure sequence
agggaaggatttctcactca

SEQ ID NO: 21993 - DNA, 20 bp, Unknown
  RNA secondary structure sequence
agaggagaacgttttcggtt

SEQ ID NO: 21994 - DNA, 20 bp, Unknown
  RNA secondary structure sequence
cagatgtgtgcagctgattg

SEQ ID NO: 21995 - DNA, 20 bp, Unknown
  RNA secondary structure sequence
ccccgaacatgcgaagcgca

SEQ ID NO: 21996 - DNA, 20 bp, Unknown
  RNA secondary structure sequence
agctgggctccagttcagag

SEQ ID NO: 21997 - DNA, 20 bp, Unknown
  RNA secondary structure sequence
taaagcaagacagcaagcga

SEQ ID NO: 21998 - DNA, 20 bp, Unknown
  RNA secondary structure sequence
ctaccccactggggtgagca

SEQ ID NO: 21999 - DNA, 20 bp, Unknown
  RNA secondary structure sequence
atctttcatccgcctctctt

SEQ ID NO: 22000 - DNA, 20 bp, Unknown
  RNA secondary structure sequence
cacctccccggggcttccat

SEQ ID NO: 22001 - DNA, 20 bp, Unknown
  RNA secondary structure sequence
aggagtctctttgttgagga

SEQ ID NO: 22002 - DNA, 20 bp, Unknown
  RNA secondary structure sequence
atctagcaagacaatgtaga

SEQ ID NO: 22003 - DNA, 20 bp, Unknown
  RNA secondary structure sequence
aaaaagagcagatccaaata

SEQ ID NO: 22004 - DNA, 20 bp, Unknown
  RNA secondary structure sequence
ttatcaagtatatcagaagg

SEQ ID NO: 22005 - DNA, 20 bp, Unknown
  RNA secondary structure sequence
agaagcctgggaatcaaatt

SEQ ID NO: 22006 - DNA, 20 bp, Unknown
  RNA secondary structure sequence
agcaaaagcagcctattgga

SEQ ID NO: 22007 - DNA, 20 bp, Unknown
  RNA secondary structure sequence
attacaaacagataatggac

SEQ ID NO: 22008 - DNA, 20 bp, Unknown
  RNA secondary structure sequence
gaagaatcagaaataatttt

SEQ ID NO: 22009 - DNA, 20 bp, Unknown
  RNA secondary structure sequence
acaaaaaacctaacctttgc

SEQ ID NO: 22010 - DNA, 20 bp, Unknown
  RNA secondary structure sequence
tggaaagcttgctaatgacg

SEQ ID NO: 22011 - DNA, 20 bp, Unknown
  RNA secondary structure sequence
ctgaaaaacaaggctctgac

SEQ ID NO: 22012 - DNA, 20 bp, Unknown
  RNA secondary structure sequence
cttccgcgttcttgtctcgt

SEQ ID NO: 22013 - DNA, 20 bp, Unknown
  RNA secondary structure sequence
gcattgtcttcccggggaag

SEQ ID NO: 22014 - DNA, 20 bp, Unknown
  RNA secondary structure sequence
ctcttgggcagctatcctac

SEQ ID NO: 22015 - DNA, 20 bp, Unknown
  RNA secondary structure sequence
acacactaacagcccccttg

SEQ ID NO: 22016 - DNA, 20 bp, Unknown
  RNA secondary structure sequence
gacatctcgatactcccact

SEQ ID NO: 22017 - DNA, 20 bp, Unknown
  RNA secondary structure sequence
accctgatcctaggcgccag

SEQ ID NO: 22018 - DNA, 20 bp, Unknown
  RNA secondary structure sequence
cttctatacctcccagacga

SEQ ID NO: 22019 - DNA, 20 bp, Unknown
  RNA secondary structure sequence
ttgaaccatactcaggacca

SEQ ID NO: 22020 - DNA, 20 bp, Unknown
  RNA secondary structure sequence
agaccatagatcttactgac

SEQ ID NO: 22021 - DNA, 20 bp, Unknown
  RNA secondary structure sequence
ccctatattctgcccttcac

SEQ ID NO: 22022 - DNA, 20 bp, Unknown
  RNA secondary structure sequence
catctgtcatctttcaaccc

SEQ ID NO: 22023 - DNA, 20 bp, Unknown
  RNA secondary structure sequence
caaagcaagccctttgcgac

SEQ ID NO: 22024 - DNA, 20 bp, Unknown
  RNA secondary structure sequence
gcagccacaccaacctcccc

SEQ ID NO: 22025 - DNA, 20 bp, Unknown
  RNA secondary structure sequence
tccaccacagtcctccacta

SEQ ID NO: 22026 - DNA, 20 bp, Unknown
  RNA secondary structure sequence
ggtggatcccgtggcgattc

SEQ ID NO: 22027 - DNA, 20 bp, Unknown
  RNA secondary structure sequence
gtgtcccttcgactacactt

SEQ ID NO: 22028 - DNA, 20 bp, Unknown
  RNA secondary structure sequence
cccgctcctccatcccaacc

SEQ ID NO: 22029 - DNA, 20 bp, Unknown
  RNA secondary structure sequence
tccgccctagcggccggaac

SEQ ID NO: 22030 - DNA, 20 bp, Unknown
  RNA secondary structure sequence
cgaggattagacctcctatt

SEQ ID NO: 22031 - DNA, 20 bp, Unknown
  RNA secondary structure sequence
gaaatccacataaccctgaa

SEQ ID NO: 22032 - DNA, 20 bp, Unknown
  RNA secondary structure sequence
ccacctgtccagagcaccaa

SEQ ID NO: 22033 - DNA, 20 bp, Unknown
  RNA secondary structure sequence
tctttcaatcaatgcgaaag

SEQ ID NO: 22034 - DNA, 20 bp, Unknown
  RNA secondary structure sequence
aaaaattcgaaaccaaagcc

SEQ ID NO: 22035 - DNA, 20 bp, Unknown
  RNA secondary structure sequence
ttcccctagcgctgaaaaac

SEQ ID NO: 22036 - DNA, 20 bp, Unknown
  RNA secondary structure sequence
gcggcctcggttgagacgcc

SEQ ID NO: 22037 - DNA, 20 bp, Unknown
  RNA secondary structure sequence
gtacccactgccaaaagcct

SEQ ID NO: 22038 - DNA, 20 bp, Unknown
  RNA secondary structure sequence
cagcttatgctgggacgccc

SEQ ID NO: 22039 - DNA, 20 bp, Unknown
  RNA secondary structure sequence
gttaaatacacattcacgca

SEQ ID NO: 22040 - DNA, 20 bp, Unknown
  RNA secondary structure sequence
agattctcttcgatgtatac

SEQ ID NO: 22041 - DNA, 20 bp, Unknown
  RNA secondary structure sequence
tacacatggcaaagtgcttc

SEQ ID NO: 22042 - DNA, 20 bp, Unknown
  RNA secondary structure sequence
atggcattcagaatagtaaa

SEQ ID NO: 22043 - DNA, 20 bp, Unknown
  RNA secondary structure sequence
ttcaccagtaattttgttct

SEQ ID NO: 22044 - DNA, 20 bp, Unknown
  RNA secondary structure sequence
gattgccatcaaccatctaa

SEQ ID NO: 22045 - DNA, 20 bp, Unknown
  RNA secondary structure sequence
ctatccctgttaaggaaaaa

SEQ ID NO: 22046 - DNA, 20 bp, Unknown
  RNA secondary structure sequence
attaatttgagtagcacccc

SEQ ID NO: 22047 - DNA, 20 bp, Unknown
  RNA secondary structure sequence
ttattctctaagtacaaggg

SEQ ID NO: 22048 - DNA, 20 bp, Unknown
  RNA secondary structure sequence
tttgattactctaattttga

SEQ ID NO: 22049 - DNA, 20 bp, Unknown
  RNA secondary structure sequence
tcttttgtctttctcagttt

SEQ ID NO: 22050 - DNA, 20 bp, Unknown
  RNA secondary structure sequence
tggtttcctagggaaggcac

SEQ ID NO: 22051 - DNA, 20 bp, Unknown
  RNA secondary structure sequence
aatttgttaaaacaggaaga

SEQ ID NO: 22052 - DNA, 20 bp, Unknown
  RNA secondary structure sequence
ctaaaagagttaaagattgc

SEQ ID NO: 22053 - DNA, 20 bp, Unknown
  RNA secondary structure sequence
actaagacagaggacctttc

SEQ ID NO: 22054 - DNA, 20 bp, Unknown
  RNA secondary structure sequence
agaccttatcgaaaaaaggg

SEQ ID NO: 22055 - DNA, 20 bp, Unknown
  RNA secondary structure sequence
tcgggttgctttgtttgtgg

SEQ ID NO: 22056 - DNA, 20 bp, Unknown
  RNA secondary structure sequence
attatttgacatccttaaag

SEQ ID NO: 22057 - DNA, 20 bp, Unknown
  RNA secondary structure sequence
tcaatatggtgtcaaccctc

SEQ ID NO: 22058 - DNA, 20 bp, Unknown
  RNA secondary structure sequence
tgagtgagcccacgagtgag

SEQ ID NO: 22059 - DNA, 20 bp, Unknown
  RNA secondary structure sequence
cgcagcatccccattgtata

SEQ ID NO: 22060 - DNA, 20 bp, Unknown
  RNA secondary structure sequence
ctttatgtcgagcccgggtt

SEQ ID NO: 22061 - DNA, 20 bp, Unknown
  RNA secondary structure sequence
gagctgcgggggacgacccg

SEQ ID NO: 22062 - DNA, 20 bp, Unknown
  RNA secondary structure sequence
agtaccaattcctggagatt

SEQ ID NO: 22063 - DNA, 20 bp, Unknown
  RNA secondary structure sequence
ctcagatattgaagtgcaag

SEQ ID NO: 22064 - DNA, 20 bp, Unknown
  RNA secondary structure sequence
aggatcataccctctgctct

SEQ ID NO: 22065 - DNA, 20 bp, Unknown
  RNA secondary structure sequence
accatccactcccacgactg

SEQ ID NO: 22066 - DNA, 20 bp, Unknown
  RNA secondary structure sequence
gcaaggaagaggaggcaggc

SEQ ID NO: 22067 - DNA, 20 bp, Unknown
  RNA secondary structure sequence
ccgagacacccattaaaaag

SEQ ID NO: 22068 - DNA, 20 bp, Unknown
  RNA secondary structure sequence
ccggccctgcatcacgcagt

SEQ ID NO: 22069 - DNA, 20 bp, Unknown
  RNA secondary structure sequence
acccgaggaactcctcaaag

SEQ ID NO: 22070 - DNA, 20 bp, Unknown
  RNA secondary structure sequence
taatctaataccgctggaca

SEQ ID NO: 22071 - DNA, 20 bp, Unknown
  RNA secondary structure sequence
acagccagcatcgcgaggaa

SEQ ID NO: 22072 - DNA, 20 bp, Unknown
  RNA secondary structure sequence
cagcacccaagagcgatccc

SEQ ID NO: 22073 - DNA, 20 bp, Unknown
  RNA secondary structure sequence
tcaagactcatccagtgtcc

SEQ ID NO: 22074 - DNA, 20 bp, Unknown
  RNA secondary structure sequence
gacacaagagatttgcggga

SEQ ID NO: 22075 - DNA, 20 bp, Unknown
  RNA secondary structure sequence
cagggcaggagatgatattg

SEQ ID NO: 22076 - DNA, 20 bp, Unknown
  RNA secondary structure sequence
tagcctatccgacgctgtcc

SEQ ID NO: 22077 - DNA, 20 bp, Unknown
  RNA secondary structure sequence
ccagagagaatcaaattgga

SEQ ID NO: 22078 - DNA, 20 bp, Unknown
  RNA secondary structure sequence
ccattgatcacacacggttc

SEQ ID NO: 22079 - DNA, 20 bp, Unknown
  RNA secondary structure sequence
ttttcttacttttatccttt

SEQ ID NO: 22080 - DNA, 20 bp, Unknown
  RNA secondary structure sequence
acagtcactcgggaagatgg

SEQ ID NO: 22081 - DNA, 20 bp, Unknown
  RNA secondary structure sequence
ataccctgaagttcacctag

SEQ ID NO: 22082 - DNA, 20 bp, Unknown
  RNA secondary structure sequence
tacttgccataggaggagac

SEQ ID NO: 22083 - DNA, 20 bp, Unknown
  RNA secondary structure sequence
gaccgctatgaccattgatg

SEQ ID NO: 22084 - DNA, 20 bp, Unknown
  RNA secondary structure sequence
tgctgcagacacaatccgga

SEQ ID NO: 22085 - DNA, 20 bp, Unknown
  RNA secondary structure sequence
tgtaagtgaccctcattgcc

SEQ ID NO: 22086 - DNA, 20 bp, Unknown
  RNA secondary structure sequence
aaggattgcttcgttagtgc

SEQ ID NO: 22087 - DNA, 20 bp, Unknown
  RNA secondary structure sequence
gagaggttatgaccgttatc

SEQ ID NO: 22088 - DNA, 20 bp, Unknown
  RNA secondary structure sequence
ggggatgaattatctgaata

SEQ ID NO: 22089 - DNA, 20 bp, Unknown
  RNA secondary structure sequence
cgacccttactcagcaaatc

SEQ ID NO: 22090 - DNA, 20 bp, Unknown
  RNA secondary structure sequence
tatagtacctagggcagctc

SEQ ID NO: 22091 - DNA, 20 bp, Unknown
  RNA secondary structure sequence
agcagggatggtgctattga

SEQ ID NO: 22092 - DNA, 20 bp, Unknown
  RNA secondary structure sequence
aagagccccaagtagatcct

SEQ ID NO: 22093 - DNA, 20 bp, Unknown
  RNA secondary structure sequence
agcgcataggttgagggatc

SEQ ID NO: 22094 - DNA, 20 bp, Unknown
  RNA secondary structure sequence
agaaacattgtttcgactcg

SEQ ID NO: 22095 - DNA, 20 bp, Unknown
  RNA secondary structure sequence
tgacgccctcgctgaggtaa

SEQ ID NO: 22096 - DNA, 20 bp, Unknown
  RNA secondary structure sequence
gcggacttcacctggactta

SEQ ID NO: 22097 - DNA, 20 bp, Unknown
  RNA secondary structure sequence
gatcactcgcaaattttggg

SEQ ID NO: 22098 - DNA, 20 bp, Unknown
  RNA secondary structure sequence
ctctgcagaatggccaacct

SEQ ID NO: 22099 - DNA, 20 bp, Unknown
  RNA secondary structure sequence
caagccctttgtacacccta

SEQ ID NO: 22100 - DNA, 20 bp, Unknown
  RNA secondary structure sequence
ggcattccccctccgcacag

SEQ ID NO: 22101 - DNA, 20 bp, Unknown
  RNA secondary structure sequence
cctcatcaccacactccact

SEQ ID NO: 22102 - DNA, 20 bp, Unknown
  RNA secondary structure sequence
cactgtggccgtgaagacct

SEQ ID NO: 22103 - DNA, 20 bp, Unknown
  RNA secondary structure sequence
ggactacctgagggagtgta

SEQ ID NO: 22104 - DNA, 20 bp, Unknown
  RNA secondary structure sequence
ggaatccagtatctcagatg

SEQ ID NO: 22105 - DNA, 20 bp, Unknown
  RNA secondary structure sequence
ggtcactgcctctccttcct

SEQ ID NO: 22106 - DNA, 20 bp, Unknown
  RNA secondary structure sequence
gtccccagggagagacaagg

SEQ ID NO: 22107 - DNA, 20 bp, Unknown
  RNA secondary structure sequence
tgaccccaccaaggccggcc

SEQ ID NO: 22108 - DNA, 20 bp, Unknown
  RNA secondary structure sequence
cgccttcatccccctcatat

SEQ ID NO: 22109 - DNA, 20 bp, Unknown
  RNA secondary structure sequence
ggctggcaagaacctgtaca

SEQ ID NO: 22110 - DNA, 20 bp, Unknown
  RNA secondary structure sequence
gagggagacctggatggagc

SEQ ID NO: 22111 - DNA, 20 bp, Unknown
  RNA secondary structure sequence
ccccggtgcctcagacccag

SEQ ID NO: 22112 - DNA, 20 bp, Unknown
  RNA secondary structure sequence
ttcattggaaggaagctgtc

SEQ ID NO: 22113 - DNA, 20 bp, Unknown
  RNA secondary structure sequence
cactggctggctaggcacat

SEQ ID NO: 22114 - DNA, 20 bp, Unknown
  RNA secondary structure sequence
agagtacgagccatagataa

SEQ ID NO: 22115 - DNA, 20 bp, Unknown
  RNA secondary structure sequence
cagctgaatatgggccaaac

SEQ ID NO: 22116 - DNA, 20 bp, Unknown
  RNA secondary structure sequence
cagtttctagagaaccatca

SEQ ID NO: 22117 - DNA, 20 bp, Unknown
  RNA secondary structure sequence
gcacgattctgggtgaaaga

SEQ ID NO: 22118 - DNA, 20 bp, Unknown
  RNA secondary structure sequence
tgccccggctcagggccaag

SEQ ID NO: 22119 - DNA, 20 bp, Unknown
  RNA secondary structure sequence
aacgccattttgcaaggcat

SEQ ID NO: 22120 - DNA, 20 bp, Unknown
  RNA secondary structure sequence
cccaccgtcgggaggtaagc

SEQ ID NO: 22121 - DNA, 20 bp, Unknown
  RNA secondary structure sequence
tttcggtttttcgccgaaac

SEQ ID NO: 22122 - DNA, 20 bp, Unknown
  RNA secondary structure sequence
agtccgtagatgtcaagaag

SEQ ID NO: 22123 - DNA, 20 bp, Unknown
  RNA secondary structure sequence
tcacctgggaggctattgcc

SEQ ID NO: 22124 - DNA, 20 bp, Unknown
  RNA secondary structure sequence
cgataatggcggacctctca

SEQ ID NO: 22125 - DNA, 20 bp, Unknown
  RNA secondary structure sequence
agcccacctgggatgattgc

SEQ ID NO: 22126 - DNA, 20 bp, Unknown
  RNA secondary structure sequence
aagaaagagagagaaggaga

SEQ ID NO: 22127 - DNA, 20 bp, Unknown
  RNA secondary structure sequence
cccaaaatcctggaccccta

SEQ ID NO: 22128 - DNA, 20 bp, Unknown
  RNA secondary structure sequence
cttctaaaagagggtcaggg

SEQ ID NO: 22129 - DNA, 20 bp, Unknown
  RNA secondary structure sequence
acggggactctgtttaaatg

SEQ ID NO: 22130 - DNA, 20 bp, Unknown
  RNA secondary structure sequence
tctgtatggggcacccccgc

SEQ ID NO: 22131 - DNA, 20 bp, Unknown
  RNA secondary structure sequence
ccccctccgtgtcggtgacg

SEQ ID NO: 22132 - DNA, 20 bp, Unknown
  RNA secondary structure sequence
aatatagggccccgcatccc

SEQ ID NO: 22133 - DNA, 20 bp, Unknown
  RNA secondary structure sequence
ttactaaatctagtacaggg

SEQ ID NO: 22134 - DNA, 20 bp, Unknown
  RNA secondary structure sequence
gaccatacaggcctagtaag

SEQ ID NO: 22135 - DNA, 20 bp, Unknown
  RNA secondary structure sequence
gccaagaacagatggtcccc

SEQ ID NO: 22136 - DNA, 20 bp, Unknown
  RNA secondary structure sequence
atctggcggacccgtggtgg

SEQ ID NO: 22137 - DNA, 20 bp, Unknown
  RNA secondary structure sequence
agacgagaacctaaaacagt

SEQ ID NO: 22138 - DNA, 20 bp, Unknown
  RNA secondary structure sequence
gaccttaggtcactggaaag

SEQ ID NO: 22139 - DNA, 20 bp, Unknown
  RNA secondary structure sequence
agggcccaatgagtctccct

SEQ ID NO: 22140 - DNA, 20 bp, Unknown
  RNA secondary structure sequence
cctgaccctagatgactagg

SEQ ID NO: 22141 - DNA, 20 bp, Unknown
  RNA secondary structure sequence
gatcatacctctgaaagcaa

SEQ ID NO: 22142 - DNA, 20 bp, Unknown
  RNA secondary structure sequence
cgtggatgacttactgctgg

SEQ ID NO: 22143 - DNA, 20 bp, Unknown
  RNA secondary structure sequence
gactgaggccagaaaagaga

SEQ ID NO: 22144 - DNA, 20 bp, Unknown
  RNA secondary structure sequence
gccgctcccagacgccgacc

SEQ ID NO: 22145 - DNA, 20 bp, Unknown
  RNA secondary structure sequence
agtgactgatataaaggacc

SEQ ID NO: 22146 - DNA, 20 bp, Unknown
  RNA secondary structure sequence
cttagccctgtaccgagccc

SEQ ID NO: 22147 - DNA, 20 bp, Unknown
  RNA secondary structure sequence
agtctggagacctctggcgg

SEQ ID NO: 22148 - DNA, 20 bp, Unknown
  RNA secondary structure sequence
cgcgtcccaatagggccaaa

SEQ ID NO: 22149 - DNA, 20 bp, Unknown
  RNA secondary structure sequence
caagccctcaacctcaccag

SEQ ID NO: 22150 - DNA, 20 bp, Unknown
  RNA secondary structure sequence
accattatgggacccctcat

SEQ ID NO: 22151 - DNA, 20 bp, Unknown
  RNA secondary structure sequence
ccagggtgccccaaggacct

SEQ ID NO: 22152 - DNA, 20 bp, Unknown
  RNA secondary structure sequence
ccaataaaccctcttgcagt

SEQ ID NO: 22153 - DNA, 20 bp, Unknown
  RNA secondary structure sequence
cgggggtctttcatttgggg

SEQ ID NO: 22154 - DNA, 20 bp, Unknown
  RNA secondary structure sequence
gtctcgctgttccttgggag

SEQ ID NO: 22155 - DNA, 20 bp, Unknown
  RNA secondary structure sequence
tgtttgatgttatgcgcctg

SEQ ID NO: 22156 - DNA, 20 bp, Unknown
  RNA secondary structure sequence
cgaccccgtcaggatatgtg

SEQ ID NO: 22157 - DNA, 20 bp, Unknown
  RNA secondary structure sequence
atcacccaggttaagatcaa

SEQ ID NO: 22158 - DNA, 20 bp, Unknown
  RNA secondary structure sequence
gaacctcctctttcgacccc

SEQ ID NO: 22159 - DNA, 20 bp, Unknown
  RNA secondary structure sequence
ggagatagtggagaagcgac

SEQ ID NO: 22160 - DNA, 20 bp, Unknown
  RNA secondary structure sequence
gcggtgcggggcgatgatgg

SEQ ID NO: 22161 - DNA, 20 bp, Unknown
  RNA secondary structure sequence
gatcgtaggagacatagaga

SEQ ID NO: 22162 - DNA, 20 bp, Unknown
  RNA secondary structure sequence
cggggaccaagaccccagac

SEQ ID NO: 22163 - DNA, 20 bp, Unknown
  RNA secondary structure sequence
gcctacggatggtagcagcc

SEQ ID NO: 22164 - DNA, 20 bp, Unknown
  RNA secondary structure sequence
gggaccgggtccagttcaga

SEQ ID NO: 22165 - DNA, 20 bp, Unknown
  RNA secondary structure sequence
gaagcagtcttttacaagag

SEQ ID NO: 22166 - DNA, 20 bp, Unknown
  RNA secondary structure sequence
gcccgcaacacgccgggccc

SEQ ID NO: 22167 - DNA, 20 bp, Unknown
  RNA secondary structure sequence
tgagctgtcgccatcggtag

SEQ ID NO: 22168 - DNA, 20 bp, Unknown
  RNA secondary structure sequence
cacgcccgaagactccaaca

SEQ ID NO: 22169 - DNA, 20 bp, Unknown
  RNA secondary structure sequence
ggagatcctaaaaggagaga

SEQ ID NO: 22170 - DNA, 20 bp, Unknown
  RNA secondary structure sequence
ctccctgactggaaaggcac

SEQ ID NO: 22171 - DNA, 20 bp, Unknown
  RNA secondary structure sequence
ggacctgaaaatgaccctgt

SEQ ID NO: 22172 - DNA, 20 bp, Unknown
  RNA secondary structure sequence
aaagttcagatcaaggtcag

SEQ ID NO: 22173 - DNA, 20 bp, Unknown
  RNA secondary structure sequence
ttatttgaactaaccaatca

SEQ ID NO: 22174 - DNA, 20 bp, Unknown
  RNA secondary structure sequence
ctctcctgcctgactgtgga

SEQ ID NO: 22175 - DNA, 20 bp, Unknown
  RNA secondary structure sequence
gtcatggaaggagttatggg

SEQ ID NO: 22176 - DNA, 20 bp, Unknown
  RNA secondary structure sequence
ttaaaatgcagctgttagca

SEQ ID NO: 22177 - DNA, 20 bp, Unknown
  RNA secondary structure sequence
agaaatattaagggattgga

SEQ ID NO: 22178 - DNA, 20 bp, Unknown
  RNA secondary structure sequence
agggtatccagcaaagtggc

SEQ ID NO: 22179 - DNA, 20 bp, Unknown
  RNA secondary structure sequence
aaagttaatggaaggggata

SEQ ID NO: 22180 - DNA, 20 bp, Unknown
  RNA secondary structure sequence
cgttaaatttagaaaacacg

SEQ ID NO: 22181 - DNA, 20 bp, Unknown
  RNA secondary structure sequence
ggtagtagtatataacagca

SEQ ID NO: 22182 - DNA, 20 bp, Unknown
  RNA secondary structure sequence
tattcccctagcagaggaag

SEQ ID NO: 22183 - DNA, 20 bp, Unknown
  RNA secondary structure sequence
gtggctgggaccaacacagg

SEQ ID NO: 22184 - DNA, 20 bp, Unknown
  RNA secondary structure sequence
gtaacaggtaaggaaaaatc

SEQ ID NO: 22185 - DNA, 20 bp, Unknown
  RNA secondary structure sequence
ggcgttgctaatgccgtgca

SEQ ID NO: 22186 - DNA, 20 bp, Unknown
  RNA secondary structure sequence
ggctgcaccaatggggtagc

SEQ ID NO: 22187 - DNA, 20 bp, Unknown
  RNA secondary structure sequence
tggacaacccattattaagc

SEQ ID NO: 22188 - DNA, 20 bp, Unknown
  RNA secondary structure sequence
agtgcaggactggacctctg

SEQ ID NO: 22189 - DNA, 20 bp, Unknown
  RNA secondary structure sequence
aacccccaacaaagtgctca

SEQ ID NO: 22190 - DNA, 20 bp, Unknown
  RNA secondary structure sequence
aagagccgttaataaggtaa

SEQ ID NO: 22191 - DNA, 20 bp, Unknown
  RNA secondary structure sequence
caacttccaaagtcctatgc

SEQ ID NO: 22192 - DNA, 20 bp, Unknown
  RNA secondary structure sequence
cttactcacctacccctcgc

SEQ ID NO: 22193 - DNA, 20 bp, Unknown
  RNA secondary structure sequence
aaaatccccctacctgtcag

SEQ ID NO: 22194 - DNA, 20 bp, Unknown
  RNA secondary structure sequence
ggggcgaggctcagcctgca

SEQ ID NO: 22195 - DNA, 20 bp, Unknown
  RNA secondary structure sequence
cagcaagcccctattcacgt

SEQ ID NO: 22196 - DNA, 20 bp, Unknown
  RNA secondary structure sequence
attctgtcagccacccacca

SEQ ID NO: 22197 - DNA, 20 bp, Unknown
  RNA secondary structure sequence
ctgcctgcaaactggacagg

SEQ ID NO: 22198 - DNA, 20 bp, Unknown
  RNA secondary structure sequence
gctaccggtacagcaggact

SEQ ID NO: 22199 - DNA, 20 bp, Unknown
  RNA secondary structure sequence
cccttccttggacccttatt

SEQ ID NO: 22200 - DNA, 20 bp, Unknown
  RNA secondary structure sequence
ccaaaaaggtacctgtaagc

SEQ ID NO: 22201 - DNA, 20 bp, Unknown
  RNA secondary structure sequence
ttaaataaagcatacaagtc

SEQ ID NO: 22202 - DNA, 20 bp, Unknown
  RNA secondary structure sequence
tctgttctagggggctatct

SEQ ID NO: 22203 - DNA, 20 bp, Unknown
  RNA secondary structure sequence
actaccggccgagagctcaa

SEQ ID NO: 22204 - DNA, 20 bp, Unknown
  RNA secondary structure sequence
ttctacctactgctccacta

SEQ ID NO: 22205 - DNA, 20 bp, Unknown
  RNA secondary structure sequence
cccttcaaaagggtgtttaa

SEQ ID NO: 22206 - DNA, 20 bp, Unknown
  RNA secondary structure sequence
tttcctgatgacatgctgga

SEQ ID NO: 22207 - DNA, 20 bp, Unknown
  RNA secondary structure sequence
caccttatacatgaacgccc

SEQ ID NO: 22208 - DNA, 20 bp, Unknown
  RNA secondary structure sequence
tgacagaaactacacactta

SEQ ID NO: 22209 - DNA, 20 bp, Unknown
  RNA secondary structure sequence
atcaatggatccatcagaaa

SEQ ID NO: 22210 - DNA, 20 bp, Unknown
  RNA secondary structure sequence
ctggagtctagtcagcttat

SEQ ID NO: 22211 - DNA, 20 bp, Unknown
  RNA secondary structure sequence
ccaaatagtcaacctcgcca

SEQ ID NO: 22212 - DNA, 20 bp, Unknown
  RNA secondary structure sequence
gtcctggattcacgcgttgt

SEQ ID NO: 22213 - DNA, 20 bp, Unknown
  RNA secondary structure sequence
ccgaacgataagaaggcagt

SEQ ID NO: 22214 - DNA, 20 bp, Unknown
  RNA secondary structure sequence
gggctcgtccacctctatgt

SEQ ID NO: 22215 - DNA, 20 bp, Unknown
  RNA secondary structure sequence
tattctcctgaggctagata

SEQ ID NO: 22216 - DNA, 20 bp, Unknown
  RNA secondary structure sequence
aggatgttcagaatgggtct

SEQ ID NO: 22217 - DNA, 20 bp, Unknown
  RNA secondary structure sequence
tattctagatgatctcaatg

SEQ ID NO: 22218 - DNA, 20 bp, Unknown
  RNA secondary structure sequence
acgcagatgcaggtcagtga

SEQ ID NO: 22219 - DNA, 20 bp, Unknown
  RNA secondary structure sequence
cccacgcccggctacacccg

SEQ ID NO: 22220 - DNA, 20 bp, Unknown
  RNA secondary structure sequence
cacttggacaccgtgcaacc

SEQ ID NO: 22221 - DNA, 20 bp, Unknown
  RNA secondary structure sequence
gcccgcgccgccggacccgt

SEQ ID NO: 22222 - DNA, 20 bp, Unknown
  RNA secondary structure sequence
ctcgctgccaggcgcgtcag

SEQ ID NO: 22223 - DNA, 20 bp, Unknown
  RNA secondary structure sequence
gtcaccaatgaccgcgccta

SEQ ID NO: 22224 - DNA, 20 bp, Unknown
  RNA secondary structure sequence
gcgcaggctgcgcgcgcctg

SEQ ID NO: 22225 - DNA, 20 bp, Unknown
  RNA secondary structure sequence
gcggtcggcggcggcccacg

SEQ ID NO: 22226 - DNA, 20 bp, Unknown
  RNA secondary structure sequence
gcatcagtccaacgccctcg

SEQ ID NO: 22227 - DNA, 20 bp, Unknown
  RNA secondary structure sequence
gaccttcacctcgccttctc

SEQ ID NO: 22228 - DNA, 20 bp, Unknown
  RNA secondary structure sequence
gagatgcccggaacggaacg

SEQ ID NO: 22229 - DNA, 20 bp, Unknown
  RNA secondary structure sequence
gagcccgaggtcgatgcgtg

SEQ ID NO: 22230 - DNA, 20 bp, Unknown
  RNA secondary structure sequence
tgccgccgtttcgacccaga

SEQ ID NO: 22231 - DNA, 20 bp, Unknown
  RNA secondary structure sequence
ggcgcggtcttttaccgcgt

SEQ ID NO: 22232 - DNA, 20 bp, Unknown
  RNA secondary structure sequence
gccccccaggccttccttgc

SEQ ID NO: 22233 - DNA, 20 bp, Unknown
  RNA secondary structure sequence
cgaccgccgcccgcgacccc

SEQ ID NO: 22234 - DNA, 20 bp, Unknown
  RNA secondary structure sequence
agccccatgggacgcgcgac

SEQ ID NO: 22235 - DNA, 20 bp, Unknown
  RNA secondary structure sequence
cctggcggcagctactacaa

SEQ ID NO: 22236 - DNA, 20 bp, Unknown
  RNA secondary structure sequence
cctgtcataggctctcaggc

SEQ ID NO: 22237 - DNA, 20 bp, Unknown
  RNA secondary structure sequence
cgcacgttagcgccaccccg

SEQ ID NO: 22238 - DNA, 20 bp, Unknown
  RNA secondary structure sequence
cccccgccctaccaagtcag

SEQ ID NO: 22239 - DNA, 20 bp, Unknown
  RNA secondary structure sequence
ctgggcgccatttgcgccct

SEQ ID NO: 22240 - DNA, 20 bp, Unknown
  RNA secondary structure sequence
gttgctgagcgtcggagagg

SEQ ID NO: 22241 - DNA, 20 bp, Unknown
  RNA secondary structure sequence
ctcagcactgtcagggagaa

SEQ ID NO: 22242 - DNA, 20 bp, Unknown
  RNA secondary structure sequence
caaatgctttaagtgcggca

SEQ ID NO: 22243 - DNA, 20 bp, Unknown
  RNA secondary structure sequence
tccagcaaagaagctcctcc

SEQ ID NO: 22244 - DNA, 20 bp, Unknown
  RNA secondary structure sequence
tctcaatatgtaatgaacat

SEQ ID NO: 22245 - DNA, 20 bp, Unknown
  RNA secondary structure sequence
caccccagaaagaggatggc

SEQ ID NO: 22246 - DNA, 20 bp, Unknown
  RNA secondary structure sequence
gtggtgcacattcaaggaag

SEQ ID NO: 22247 - DNA, 20 bp, Unknown
  RNA secondary structure sequence
ggagaggacctttttcccct

SEQ ID NO: 22248 - DNA, 20 bp, Unknown
  RNA secondary structure sequence
aacaaacgatgaggccttgt

SEQ ID NO: 22249 - DNA, 20 bp, Unknown
  RNA secondary structure sequence
aaacatattgggatacttta

SEQ ID NO: 22250 - DNA, 20 bp, Unknown
  RNA secondary structure sequence
gtagatcagaaaatagaaca

SEQ ID NO: 22251 - DNA, 20 bp, Unknown
  RNA secondary structure sequence
ctgtctctaaaaaggtatat

SEQ ID NO: 22252 - DNA, 20 bp, Unknown
  RNA secondary structure sequence
ggttctggtcatggttctca

SEQ ID NO: 22253 - DNA, 20 bp, Unknown
  RNA secondary structure sequence
ggccagacaacggaggaggg

SEQ ID NO: 22254 - DNA, 20 bp, Unknown
  RNA secondary structure sequence
aagcgctagtgtcagcactt

SEQ ID NO: 22255 - DNA, 20 bp, Unknown
  RNA secondary structure sequence
tgggtgttcgctggttagcc

SEQ ID NO: 22256 - DNA, 20 bp, Unknown
  RNA secondary structure sequence
tggcttcatatagctcaata

SEQ ID NO: 22257 - DNA, 20 bp, Unknown
  RNA secondary structure sequence
cactggccagggcaacatat

SEQ ID NO: 22258 - DNA, 20 bp, Unknown
  RNA secondary structure sequence
cttttggattaatcctaggc

SEQ ID NO: 22259 - DNA, 20 bp, Unknown
  RNA secondary structure sequence
tcgagacagacaataaggta

SEQ ID NO: 22260 - DNA, 20 bp, Unknown
  RNA secondary structure sequence
aggatttgaacttaatggtc

SEQ ID NO: 22261 - DNA, 20 bp, Unknown
  RNA secondary structure sequence
ctctgaccccaattcccata

SEQ ID NO: 22262 - DNA, 20 bp, Unknown
  RNA secondary structure sequence
gatggccgcatatactctta

SEQ ID NO: 22263 - DNA, 20 bp, Unknown
  RNA secondary structure sequence
tgtcgcacaaattaaacaca

SEQ ID NO: 22264 - DNA, 20 bp, Unknown
  RNA secondary structure sequence
aaagataaaaaagggggaat

SEQ ID NO: 22265 - DNA, 20 bp, Unknown
  RNA secondary structure sequence
attagataatacatggcatg

SEQ ID NO: 22266 - DNA, 20 bp, Unknown
  RNA secondary structure sequence
tatcaacaatgtaacattgg

SEQ ID NO: 22267 - DNA, 20 bp, Unknown
  RNA secondary structure sequence
tttcatggattcctccctta

SEQ ID NO: 22268 - DNA, 20 bp, Unknown
  RNA secondary structure sequence
cctaagacaggcgcagcctc

SEQ ID NO: 22269 - DNA, 20 bp, Unknown
  RNA secondary structure sequence
tgtctcttgttcccttcaat

SEQ ID NO: 22270 - DNA, 20 bp, Unknown
  RNA secondary structure sequence
ctccgtcttactttcccgcc

SEQ ID NO: 22271 - DNA, 20 bp, Unknown
  RNA secondary structure sequence
tgtgcatcgtaagggctatg

SEQ ID NO: 22272 - DNA, 20 bp, Unknown
  RNA secondary structure sequence
ccattgatgtcaaaatgatg

SEQ ID NO: 22273 - DNA, 20 bp, Unknown
  RNA secondary structure sequence
gtccctgcaaagtgcccatt

SEQ ID NO: 22274 - DNA, 20 bp, Unknown
  RNA secondary structure sequence
agataaaccatcactggcac

SEQ ID NO: 22275 - DNA, 20 bp, Unknown
  RNA secondary structure sequence
ttagatcactctttggaggg

SEQ ID NO: 22276 - DNA, 20 bp, Unknown
  RNA secondary structure sequence
cgaagatcataggaaccgcc

SEQ ID NO: 22277 - DNA, 20 bp, Unknown
  RNA secondary structure sequence
gtgatctcatcatacccatc

SEQ ID NO: 22278 - DNA, 20 bp, Unknown
  RNA secondary structure sequence
ccgacatgattgatcctttt

SEQ ID NO: 22279 - DNA, 20 bp, Unknown
  RNA secondary structure sequence
tcggcgccgcgtttgctgaa

SEQ ID NO: 22280 - DNA, 20 bp, Unknown
  RNA secondary structure sequence
tgctactcatggttggagtt

SEQ ID NO: 22281 - DNA, 20 bp, Unknown
  RNA secondary structure sequence
gggagagtgatgctgaaatc

SEQ ID NO: 22282 - DNA, 20 bp, Unknown
  RNA secondary structure sequence
gcgccattgtgcaaggagag

SEQ ID NO: 22283 - DNA, 20 bp, Unknown
  RNA secondary structure sequence
tgctggcacccaccagggtc

SEQ ID NO: 22284 - DNA, 20 bp, Unknown
  RNA secondary structure sequence
aaacagagatcccagacaga

SEQ ID NO: 22285 - DNA, 20 bp, Unknown
  RNA secondary structure sequence
ccagcgctgctcagcggaga

SEQ ID NO: 22286 - DNA, 20 bp, Unknown
  RNA secondary structure sequence
tcttacttgatctgcggccg

SEQ ID NO: 22287 - DNA, 20 bp, Unknown
  RNA secondary structure sequence
cagtcaccctatgggagaat

SEQ ID NO: 22288 - DNA, 20 bp, Unknown
  RNA secondary structure sequence
aaaggcgtttcctcgagcca

SEQ ID NO: 22289 - DNA, 20 bp, Unknown
  RNA secondary structure sequence
ccatgaagagtggagtcgac

SEQ ID NO: 22290 - DNA, 20 bp, Unknown
  RNA secondary structure sequence
tgctatgcccttacatgccc

SEQ ID NO: 22291 - DNA, 20 bp, Unknown
  RNA secondary structure sequence
tcaaggaaaaggtggacaca

SEQ ID NO: 22292 - DNA, 20 bp, Unknown
  RNA secondary structure sequence
ttgaagaacagaaccaatgg

SEQ ID NO: 22293 - DNA, 20 bp, Unknown
  RNA secondary structure sequence
ggaaaactgtgatggacgtc

SEQ ID NO: 22294 - DNA, 20 bp, Unknown
  RNA secondary structure sequence
aggtcagaacctggctgttt

SEQ ID NO: 22295 - DNA, 20 bp, Unknown
  RNA secondary structure sequence
ggtatgactggcagcaggtt

SEQ ID NO: 22296 - DNA, 20 bp, Unknown
  RNA secondary structure sequence
acgcgcagatgtggctgctg

SEQ ID NO: 22297 - DNA, 20 bp, Unknown
  RNA secondary structure sequence
cttgtttgcctccatcgacc

SEQ ID NO: 22298 - DNA, 20 bp, Unknown
  RNA secondary structure sequence
tcggagatgcgtcgtgaaga

SEQ ID NO: 22299 - DNA, 20 bp, Unknown
  RNA secondary structure sequence
cggggggcaatggctgcgcg

SEQ ID NO: 22300 - DNA, 20 bp, Unknown
  RNA secondary structure sequence
taggtccaatgagattctag

SEQ ID NO: 22301 - DNA, 20 bp, Unknown
  RNA secondary structure sequence
caacacagcccttctggtca

SEQ ID NO: 22302 - DNA, 20 bp, Unknown
  RNA secondary structure sequence
tgaacgggtgtatgtaaatg

SEQ ID NO: 22303 - DNA, 20 bp, Unknown
  RNA secondary structure sequence
cgcccaggtaattggaccga

SEQ ID NO: 22304 - DNA, 20 bp, Unknown
  RNA secondary structure sequence
aactcgcctatttctgacga

SEQ ID NO: 22305 - DNA, 20 bp, Unknown
  RNA secondary structure sequence
gtcaaccgaaaatgatgacg

SEQ ID NO: 22306 - DNA, 20 bp, Unknown
  RNA secondary structure sequence
gctcatcgcaaccagcacta

SEQ ID NO: 22307 - DNA, 20 bp, Unknown
  RNA secondary structure sequence
ccccaccaccacggaagacc

SEQ ID NO: 22308 - DNA, 20 bp, Unknown
  RNA secondary structure sequence
cgggttctatggttttgggt

SEQ ID NO: 22309 - DNA, 20 bp, Unknown
  RNA secondary structure sequence
gcctccggggagattcaccc

SEQ ID NO: 22310 - DNA, 20 bp, Unknown
  RNA secondary structure sequence
caaacaagagtatcgaccac

SEQ ID NO: 22311 - DNA, 20 bp, Unknown
  RNA secondary structure sequence
gggagctacaatgttggact

SEQ ID NO: 22312 - DNA, 20 bp, Unknown
  RNA secondary structure sequence
ccttccctctggttttgcca

SEQ ID NO: 22313 - DNA, 20 bp, Unknown
  RNA secondary structure sequence
aatcactagtagagtgccac

SEQ ID NO: 22314 - DNA, 20 bp, Unknown
  RNA secondary structure sequence
agtagtcacatatgcgttga

SEQ ID NO: 22315 - DNA, 20 bp, Unknown
  RNA secondary structure sequence
aaccaattggttcccactag

SEQ ID NO: 22316 - DNA, 20 bp, Unknown
  RNA secondary structure sequence
catttagacgtgatcgaata

SEQ ID NO: 22317 - DNA, 20 bp, Unknown
  RNA secondary structure sequence
gtaagagaagcctgtaaaca

SEQ ID NO: 22318 - DNA, 20 bp, Unknown
  RNA secondary structure sequence
ataatagatgcaataaactc

SEQ ID NO: 22319 - DNA, 20 bp, Unknown
  RNA secondary structure sequence
agtatcattagtaattcagt

SEQ ID NO: 22320 - DNA, 20 bp, Unknown
  RNA secondary structure sequence
gcccgacatggggaatacgc

SEQ ID NO: 22321 - DNA, 20 bp, Unknown
  RNA secondary structure sequence
gcggcacatgatgcggaagt

SEQ ID NO: 22322 - DNA, 20 bp, Unknown
  RNA secondary structure sequence
cgtctcgctgcagaaattga

SEQ ID NO: 22323 - DNA, 20 bp, Unknown
  RNA secondary structure sequence
ttgtcgcctgatttcacaaa

SEQ ID NO: 22324 - DNA, 20 bp, Unknown
  RNA secondary structure sequence
ttgttactattgtgtgagac

SEQ ID NO: 22325 - DNA, 20 bp, Unknown
  RNA secondary structure sequence
gtaatttcaactggaagaac

SEQ ID NO: 22326 - DNA, 20 bp, Unknown
  RNA secondary structure sequence
tgccatgctttcactttaga

SEQ ID NO: 22327 - DNA, 20 bp, Unknown
  RNA secondary structure sequence
cttcctgatgatgcctggcg

SEQ ID NO: 22328 - DNA, 20 bp, Unknown
  RNA secondary structure sequence
caagttgtgctagcgtatgc

SEQ ID NO: 22329 - DNA, 20 bp, Unknown
  RNA secondary structure sequence
actgacgataatactccttc

SEQ ID NO: 22330 - DNA, 20 bp, Unknown
  RNA secondary structure sequence
tccttatcagtcttatctta

SEQ ID NO: 22331 - DNA, 20 bp, Unknown
  RNA secondary structure sequence
tccatcatattcaaggtcaa

SEQ ID NO: 22332 - DNA, 20 bp, Unknown
  RNA secondary structure sequence
agcatttcaccagtcctccc

SEQ ID NO: 22333 - DNA, 20 bp, Unknown
  RNA secondary structure sequence
tcaatagacatgctattgac

SEQ ID NO: 22334 - DNA, 20 bp, Unknown
  RNA secondary structure sequence
ctactgaaatcaacttggga

SEQ ID NO: 22335 - DNA, 20 bp, Unknown
  RNA secondary structure sequence
caagaattaatttacttttt

SEQ ID NO: 22336 - DNA, 20 bp, Unknown
  RNA secondary structure sequence
caccgactatatatcatgaa

SEQ ID NO: 22337 - DNA, 20 bp, Unknown
  RNA secondary structure sequence
tatttttaaggttccagtaa

SEQ ID NO: 22338 - DNA, 20 bp, Unknown
  RNA secondary structure sequence
tgtcagctgtatacaaacac

SEQ ID NO: 22339 - DNA, 20 bp, Unknown
  RNA secondary structure sequence
catgatggttgtcactgaga

SEQ ID NO: 22340 - DNA, 20 bp, Unknown
  RNA secondary structure sequence
attgaatgcggcacgagttg

SEQ ID NO: 22341 - DNA, 20 bp, Unknown
  RNA secondary structure sequence
ggaactgcgacttgaaggaa

SEQ ID NO: 22342 - DNA, 20 bp, Unknown
  RNA secondary structure sequence
catagttcatagatataatg

SEQ ID NO: 22343 - DNA, 20 bp, Unknown
  RNA secondary structure sequence
aatcaggaatttatcacata

SEQ ID NO: 22344 - DNA, 20 bp, Unknown
  RNA secondary structure sequence
ctcgaagataatcttaaatt

SEQ ID NO: 22345 - DNA, 20 bp, Unknown
  RNA secondary structure sequence
gaaaccatatagctcaaatg

SEQ ID NO: 22346 - DNA, 20 bp, Unknown
  RNA secondary structure sequence
cagaccctgtgatggatgtc

SEQ ID NO: 22347 - DNA, 20 bp, Unknown
  RNA secondary structure sequence
tgcccgtagtaccactcgac

SEQ ID NO: 22348 - DNA, 20 bp, Unknown
  RNA secondary structure sequence
cgggggaattgtgtgctgtt

SEQ ID NO: 22349 - DNA, 20 bp, Unknown
  RNA secondary structure sequence
ctgtcacttcccgagttggt

SEQ ID NO: 22350 - DNA, 20 bp, Unknown
  RNA secondary structure sequence
catacatgcgctttgatgca

SEQ ID NO: 22351 - DNA, 20 bp, Unknown
  RNA secondary structure sequence
ccattgccactgtggtagca

SEQ ID NO: 22352 - DNA, 20 bp, Unknown
  RNA secondary structure sequence
tgaccctggttactcttgat

SEQ ID NO: 22353 - DNA, 20 bp, Unknown
  RNA secondary structure sequence
gggtcaagcccaataaagag

SEQ ID NO: 22354 - DNA, 20 bp, Unknown
  RNA secondary structure sequence
tagggaacacactgcatgag

SEQ ID NO: 22355 - DNA, 20 bp, Unknown
  RNA secondary structure sequence
atgatgctagtctcagtcca

SEQ ID NO: 22356 - DNA, 20 bp, Unknown
  RNA secondary structure sequence
tgactatgactcctgcagac

SEQ ID NO: 22357 - DNA, 20 bp, Unknown
  RNA secondary structure sequence
aaaccttagagatcgttatc

SEQ ID NO: 22358 - DNA, 20 bp, Unknown
  RNA secondary structure sequence
tgagaagcctaattattgac

SEQ ID NO: 22359 - DNA, 20 bp, Unknown
  RNA secondary structure sequence
tgtttttcttttgattgcat

SEQ ID NO: 22360 - DNA, 20 bp, Unknown
  RNA secondary structure sequence
atcacacccacccaggtgag

SEQ ID NO: 22361 - DNA, 20 bp, Unknown
  RNA secondary structure sequence
ttttaccttatgtcaatgct

SEQ ID NO: 22362 - DNA, 20 bp, Unknown
  RNA secondary structure sequence
tcattcctgttaacaataca

SEQ ID NO: 22363 - DNA, 20 bp, Unknown
  RNA secondary structure sequence
atactaacctacacacacaa

SEQ ID NO: 22364 - DNA, 20 bp, Unknown
  RNA secondary structure sequence
ggaggtttcttaaagagaaa

SEQ ID NO: 22365 - DNA, 20 bp, Unknown
  RNA secondary structure sequence
gaattaagaatttatatatc

SEQ ID NO: 22366 - DNA, 20 bp, Unknown
  RNA secondary structure sequence
ctaagtgctgtccatttatc

SEQ ID NO: 22367 - DNA, 20 bp, Unknown
  RNA secondary structure sequence
cacctccagccatagctgac

SEQ ID NO: 22368 - DNA, 20 bp, Unknown
  RNA secondary structure sequence
gtcttggcatatatgaccaa

SEQ ID NO: 22369 - DNA, 20 bp, Unknown
  RNA secondary structure sequence
atgtttcatctaaaacccga

SEQ ID NO: 22370 - DNA, 20 bp, Unknown
  RNA secondary structure sequence
tactagatgcttataagaac

SEQ ID NO: 22371 - DNA, 20 bp, Unknown
  RNA secondary structure sequence
gtagacatgcataccaggaa

SEQ ID NO: 22372 - DNA, 20 bp, Unknown
  RNA secondary structure sequence
gtcataaaggtgatttcgtc

SEQ ID NO: 22373 - DNA, 20 bp, Unknown
  RNA secondary structure sequence
gccagagatatctataaaaa

SEQ ID NO: 22374 - DNA, 20 bp, Unknown
  RNA secondary structure sequence
ggtctctccaatatagaagt

SEQ ID NO: 22375 - DNA, 20 bp, Unknown
  RNA secondary structure sequence
gtgttgtttcaatctgagtg

SEQ ID NO: 22376 - DNA, 20 bp, Unknown
  RNA secondary structure sequence
accatggtatgtataggcgg

SEQ ID NO: 22377 - DNA, 20 bp, Unknown
  RNA secondary structure sequence
aacccagagtccaaatgcca

SEQ ID NO: 22378 - DNA, 20 bp, Unknown
  RNA secondary structure sequence
tggttggcttgcaaaaacgt

SEQ ID NO: 22379 - DNA, 20 bp, Unknown
  RNA secondary structure sequence
agagtgtggtgaccagggtt

SEQ ID NO: 22380 - DNA, 20 bp, Unknown
  RNA secondary structure sequence
cttggcaggtccatagggac

SEQ ID NO: 22381 - DNA, 20 bp, Unknown
  RNA secondary structure sequence
gggttcctgtggcacacatt

SEQ ID NO: 22382 - DNA, 20 bp, Unknown
  RNA secondary structure sequence
ctttcaacagcatcttcggg

SEQ ID NO: 22383 - DNA, 20 bp, Unknown
  RNA secondary structure sequence
tggactcagagttattcctt

SEQ ID NO: 22384 - DNA, 20 bp, Unknown
  RNA secondary structure sequence
gagcatctgtgaggagtacc

SEQ ID NO: 22385 - DNA, 20 bp, Unknown
  RNA secondary structure sequence
tggtggcagtggggatcaca

SEQ ID NO: 22386 - DNA, 20 bp, Unknown
  RNA secondary structure sequence
tcctaagtgtagcttcggca

SEQ ID NO: 22387 - DNA, 20 bp, Unknown
  RNA secondary structure sequence
gtgtcttgcacacgatgtgg

SEQ ID NO: 22388 - DNA, 20 bp, Unknown
  RNA secondary structure sequence
gcctgagaacgttggtgttg

SEQ ID NO: 22389 - DNA, 20 bp, Unknown
  RNA secondary structure sequence
agggaagacaaaattgggag

SEQ ID NO: 22390 - DNA, 20 bp, Unknown
  RNA secondary structure sequence
ccattactagtgaggaaaga

SEQ ID NO: 22391 - DNA, 20 bp, Unknown
  RNA secondary structure sequence
cctttgaaaaggactactcc

SEQ ID NO: 22392 - DNA, 20 bp, Unknown
  RNA secondary structure sequence
ccctgggtgtcatctggtgc

SEQ ID NO: 22393 - DNA, 20 bp, Unknown
  RNA secondary structure sequence
cgggaaaacagagaagcagt

SEQ ID NO: 22394 - DNA, 20 bp, Unknown
  RNA secondary structure sequence
cgaatgtggacatccagcca

SEQ ID NO: 22395 - DNA, 20 bp, Unknown
  RNA secondary structure sequence
gtgtggcgggacatgtcatg

SEQ ID NO: 22396 - DNA, 20 bp, Unknown
  RNA secondary structure sequence
gatcaggaatggacgtgttc

SEQ ID NO: 22397 - DNA, 20 bp, Unknown
  RNA secondary structure sequence
aaaacagatgggcaagtgca

SEQ ID NO: 22398 - DNA, 20 bp, Unknown
  RNA secondary structure sequence
tcatggatgtcatcacaaga

SEQ ID NO: 22399 - DNA, 20 bp, Unknown
  RNA secondary structure sequence
tacccttttgttcacaccat

SEQ ID NO: 22400 - DNA, 20 bp, Unknown
  RNA secondary structure sequence
agccccagaaaccgacgcct

SEQ ID NO: 22401 - DNA, 20 bp, Unknown
  RNA secondary structure sequence
tacagtcacttgcgtgtggg

SEQ ID NO: 22402 - DNA, 20 bp, Unknown
  RNA secondary structure sequence
cgtgacgtgtgttctggacc

SEQ ID NO: 22403 - DNA, 20 bp, Unknown
  RNA secondary structure sequence
ggggcccctgggcaaccagg

SEQ ID NO: 22404 - DNA, 20 bp, Unknown
  RNA secondary structure sequence
tttcccgctggccctcttga

SEQ ID NO: 22405 - DNA, 20 bp, Unknown
  RNA secondary structure sequence
gtggaggcacaaagccgtga

SEQ ID NO: 22406 - DNA, 20 bp, Unknown
  RNA secondary structure sequence
tgaggttctcatcggcgtct

SEQ ID NO: 22407 - DNA, 20 bp, Unknown
  RNA secondary structure sequence
tacgtcgcgaagcatgggaa

SEQ ID NO: 22408 - DNA, 20 bp, Unknown
  RNA secondary structure sequence
tgggaggtttttggccaacc

SEQ ID NO: 22409 - DNA, 20 bp, Unknown
  RNA secondary structure sequence
ccctatgacgcagcaccctt

SEQ ID NO: 22410 - DNA, 20 bp, Unknown
  RNA secondary structure sequence
tgccattgcctattataggg

SEQ ID NO: 22411 - DNA, 20 bp, Unknown
  RNA secondary structure sequence
gggtgttcagcggaccatgt

SEQ ID NO: 22412 - DNA, 20 bp, Unknown
  RNA secondary structure sequence
ctacacagcaaccgccaagt

SEQ ID NO: 22413 - DNA, 20 bp, Unknown
  RNA secondary structure sequence
taacaactctggcactacca

SEQ ID NO: 22414 - DNA, 20 bp, Unknown
  RNA secondary structure sequence
ggtggatgaggtacaggtgg

SEQ ID NO: 22415 - DNA, 20 bp, Unknown
  RNA secondary structure sequence
tgagaagaccccgtcggtgt

SEQ ID NO: 22416 - DNA, 20 bp, Unknown
  RNA secondary structure sequence
gatgtcgtgctgcgttgaaa

SEQ ID NO: 22417 - DNA, 20 bp, Unknown
  RNA secondary structure sequence
tgaatgtgacaagtgtgagg

SEQ ID NO: 22418 - DNA, 20 bp, Unknown
  RNA secondary structure sequence
acggagggtggacaaggtga

SEQ ID NO: 22419 - DNA, 20 bp, Unknown
  RNA secondary structure sequence
ggtgtcggttaaggacttag

SEQ ID NO: 22420 - DNA, 20 bp, Unknown
  RNA secondary structure sequence
gtgcgagccctcatatcatg

SEQ ID NO: 22421 - DNA, 20 bp, Unknown
  RNA secondary structure sequence
cctcctttatccttggcacc

SEQ ID NO: 22422 - DNA, 20 bp, Unknown
  RNA secondary structure sequence
agcagcgttgagggttaccg

SEQ ID NO: 22423 - DNA, 20 bp, Unknown
  RNA secondary structure sequence
tccaggcctacggcttcctc

SEQ ID NO: 22424 - DNA, 20 bp, Unknown
  RNA secondary structure sequence
catctgttgcggcaaggtct

SEQ ID NO: 22425 - DNA, 20 bp, Unknown
  RNA secondary structure sequence
ctgcggagaggctggcagat

SEQ ID NO: 22426 - DNA, 20 bp, Unknown
  RNA secondary structure sequence
tgtgtgttcccatctctcct

SEQ ID NO: 22427 - DNA, 20 bp, Unknown
  RNA secondary structure sequence
agtgaaggcagtaagggcgg

SEQ ID NO: 22428 - DNA, 20 bp, Unknown
  RNA secondary structure sequence
gaaactggaactgcagagaa

SEQ ID NO: 22429 - DNA, 20 bp, Unknown
  RNA secondary structure sequence
gaagtagtgccaggatttca

SEQ ID NO: 22430 - DNA, 20 bp, Unknown
  RNA secondary structure sequence
cccaccctagaagagatgct

SEQ ID NO: 22431 - DNA, 20 bp, Unknown
  RNA secondary structure sequence
cctccggcagatccagcagc

SEQ ID NO: 22432 - DNA, 20 bp, Unknown
  RNA secondary structure sequence
tagtaggagatcctatacca

SEQ ID NO: 22433 - DNA, 20 bp, Unknown
  RNA secondary structure sequence
gccaacagaaaggagaagcc

SEQ ID NO: 22434 - DNA, 20 bp, Unknown
  RNA secondary structure sequence
tattaaaactggccagtagg

SEQ ID NO: 22435 - DNA, 20 bp, Unknown
  RNA secondary structure sequence
attcaaattttaaaaatttc

SEQ ID NO: 22436 - DNA, 20 bp, Unknown
  RNA secondary structure sequence
aggaactggatagtagtccc

SEQ ID NO: 22437 - DNA, 20 bp, Unknown
  RNA secondary structure sequence
gaagtaagaagagccatcag

SEQ ID NO: 22438 - DNA, 20 bp, Unknown
  RNA secondary structure sequence
ggccttcgagtggctagaga

SEQ ID NO: 22439 - DNA, 20 bp, Unknown
  RNA secondary structure sequence
tatatttacacatttcaaga

SEQ ID NO: 22440 - DNA, 20 bp, Unknown
  RNA secondary structure sequence
tgggtaatagaaactctgag

SEQ ID NO: 22441 - DNA, 20 bp, Unknown
  RNA secondary structure sequence
gactccaaggaaaactaaga

SEQ ID NO: 22442 - DNA, 20 bp, Unknown
  RNA secondary structure sequence
ccatgtgtcaagctaacacc

SEQ ID NO: 22443 - DNA, 20 bp, Unknown
  RNA secondary structure sequence
ttagggtatgaggagatgat

SEQ ID NO: 22444 - DNA, 20 bp, Unknown
  RNA secondary structure sequence
aagcactattgggatgctat

SEQ ID NO: 22445 - DNA, 20 bp, Unknown
  RNA secondary structure sequence
gtgcatatagtagtgggaat

SEQ ID NO: 22446 - DNA, 20 bp, Unknown
  RNA secondary structure sequence
tttccagaaggggctgtaac

SEQ ID NO: 22447 - DNA, 20 bp, Unknown
  RNA secondary structure sequence
cagtaccatattggcggcag

SEQ ID NO: 22448 - DNA, 20 bp, Unknown
  RNA secondary structure sequence
gccctgatttgaaacagatt

SEQ ID NO: 22449 - DNA, 20 bp, Unknown
  RNA secondary structure sequence
aaccatcccaaccctctcag

SEQ ID NO: 22450 - DNA, 20 bp, Unknown
  RNA secondary structure sequence
ctaagttaagacaaggaccc

SEQ ID NO: 22451 - DNA, 20 bp, Unknown
  RNA secondary structure sequence
tgtcattaacatcccttcaa

SEQ ID NO: 22452 - DNA, 20 bp, Unknown
  RNA secondary structure sequence
gactggcctcctgtaaaaca

SEQ ID NO: 22453 - DNA, 20 bp, Unknown
  RNA secondary structure sequence
agcaccagtgccgacctcat

SEQ ID NO: 22454 - DNA, 20 bp, Unknown
  RNA secondary structure sequence
tcagcaaccagaatatccta

SEQ ID NO: 22455 - DNA, 20 bp, Unknown
  RNA secondary structure sequence
acatgtcagtcatagcacct

SEQ ID NO: 22456 - DNA, 20 bp, Unknown
  RNA secondary structure sequence
tgaaaacatggataatgaat

SEQ ID NO: 22457 - DNA, 20 bp, Unknown
  RNA secondary structure sequence
tcacaaccatggttgatgtg

SEQ ID NO: 22458 - DNA, 20 bp, Unknown
  RNA secondary structure sequence
aagcagaagcccactcacac

SEQ ID NO: 22459 - DNA, 20 bp, Unknown
  RNA secondary structure sequence
tggcatctccatatgtgtgg

SEQ ID NO: 22460 - DNA, 20 bp, Unknown
  RNA secondary structure sequence
ggaacctatgtagccagtag

SEQ ID NO: 22461 - DNA, 20 bp, Unknown
  RNA secondary structure sequence
gaatggaaaatagcaactag

SEQ ID NO: 22462 - DNA, 20 bp, Unknown
  RNA secondary structure sequence
caacgaaggggacttaaccc

SEQ ID NO: 22463 - DNA, 20 bp, Unknown
  RNA secondary structure sequence
cttttacgggaatatcagaa

SEQ ID NO: 22464 - DNA, 20 bp, Unknown
  RNA secondary structure sequence
aacagatggaaggatttaca

SEQ ID NO: 22465 - DNA, 20 bp, Unknown
  RNA secondary structure sequence
aaaggcactaatactaccct

SEQ ID NO: 22466 - DNA, 20 bp, Unknown
  RNA secondary structure sequence
tatgtaagtggacgaaattg

SEQ ID NO: 22467 - DNA, 20 bp, Unknown
  RNA secondary structure sequence
atttgcttgggggggaacac

SEQ ID NO: 22468 - DNA, 20 bp, Unknown
  RNA secondary structure sequence
ccaagtaacaactgtattta

SEQ ID NO: 22469 - DNA, 20 bp, Unknown
  RNA secondary structure sequence
cttttccattgtatgaacta

SEQ ID NO: 22470 - DNA, 20 bp, Unknown
  RNA secondary structure sequence
tagttaatataaaaactcat

SEQ ID NO: 22471 - DNA, 20 bp, Unknown
  RNA secondary structure sequence
tttatcaatcatggcgggtt

SEQ ID NO: 22472 - DNA, 20 bp, Unknown
  RNA secondary structure sequence
acttcagctcgcgatggaat

SEQ ID NO: 22473 - DNA, 20 bp, Unknown
  RNA secondary structure sequence
ccaacttccaaaaaattgag

SEQ ID NO: 22474 - DNA, 20 bp, Unknown
  RNA secondary structure sequence
tggggtaaatagacattagt

SEQ ID NO: 22475 - DNA, 20 bp, Unknown
  RNA secondary structure sequence
gggatactctcaatcatcta

SEQ ID NO: 22476 - DNA, 20 bp, Unknown
  RNA secondary structure sequence
cagttcaaacaataaaaaac

SEQ ID NO: 22477 - DNA, 20 bp, Unknown
  RNA secondary structure sequence
ccactgtgctcgacacaacc

SEQ ID NO: 22478 - DNA, 20 bp, Unknown
  RNA secondary structure sequence
tagcagaaaaccgtgaccta

SEQ ID NO: 22479 - DNA, 20 bp, Unknown
  RNA secondary structure sequence
atatcatccatattgatttc

SEQ ID NO: 22480 - DNA, 20 bp, Unknown
  RNA secondary structure sequence
tcagaatctttggacatcca

SEQ ID NO: 22481 - DNA, 20 bp, Unknown
  RNA secondary structure sequence
gcagtgatgtattagatgaa

SEQ ID NO: 22482 - DNA, 20 bp, Unknown
  RNA secondary structure sequence
tgggtggtattgagggctgg

SEQ ID NO: 22483 - DNA, 20 bp, Unknown
  RNA secondary structure sequence
cagattatttgttagcatta

SEQ ID NO: 22484 - DNA, 20 bp, Unknown
  RNA secondary structure sequence
actgggtatatgcatccata

SEQ ID NO: 22485 - DNA, 20 bp, Unknown
  RNA secondary structure sequence
aacgaatcaggacgaaatag

SEQ ID NO: 22486 - DNA, 20 bp, Unknown
  RNA secondary structure sequence
ttgatggaaagcgatgctaa

SEQ ID NO: 22487 - DNA, 20 bp, Unknown
  RNA secondary structure sequence
caagaagatgacaaaagaat

SEQ ID NO: 22488 - DNA, 20 bp, Unknown
  RNA secondary structure sequence
aaacattgcaaaaatgatga

SEQ ID NO: 22489 - DNA, 20 bp, Unknown
  RNA secondary structure sequence
taaatacactgggaatgacc

SEQ ID NO: 22490 - DNA, 20 bp, Unknown
  RNA secondary structure sequence
ggttcagactgattccaaag

SEQ ID NO: 22491 - DNA, 20 bp, Unknown
  RNA secondary structure sequence
gtagattccatatcatataa

SEQ ID NO: 22492 - DNA, 20 bp, Unknown
  RNA secondary structure sequence
ctactaggtaacaagatcta

SEQ ID NO: 22493 - DNA, 20 bp, Unknown
  RNA secondary structure sequence
gtatatgataagtaatcagc

SEQ ID NO: 22494 - DNA, 20 bp, Unknown
  RNA secondary structure sequence
ccagaagaatttcttattga

SEQ ID NO: 22495 - DNA, 20 bp, Unknown
  RNA secondary structure sequence
gatatttgaatctggagaat

SEQ ID NO: 22496 - DNA, 20 bp, Unknown
  RNA secondary structure sequence
tggaatgttagatacgacaa

SEQ ID NO: 22497 - DNA, 20 bp, Unknown
  RNA secondary structure sequence
agtcagcagattcataacaa

SEQ ID NO: 22498 - DNA, 20 bp, Unknown
  RNA secondary structure sequence
atttaagaggttctgggatt

SEQ ID NO: 22499 - DNA, 20 bp, Unknown
  RNA secondary structure sequence
cactccgaattggtctagaa

SEQ ID NO: 22500 - DNA, 20 bp, Unknown
  RNA secondary structure sequence
agaatttttatcaactccag

SEQ ID NO: 22501 - DNA, 20 bp, Unknown
  RNA secondary structure sequence
tagagagtgtataggatcaa

SEQ ID NO: 22502 - DNA, 20 bp, Unknown
  RNA secondary structure sequence
gggacatcaagcagccatgc

SEQ ID NO: 22503 - DNA, 20 bp, Unknown
  RNA secondary structure sequence
aatgagccaagtaacaaatt

SEQ ID NO: 22504 - DNA, 20 bp, Unknown
  RNA secondary structure sequence
agattgtactgagagacagg

SEQ ID NO: 22505 - DNA, 20 bp, Unknown
  RNA secondary structure sequence
ttaaagccaggaatggatgg

SEQ ID NO: 22506 - DNA, 20 bp, Unknown
  RNA secondary structure sequence
gcatgggtaccagcacacaa

SEQ ID NO: 22507 - DNA, 20 bp, Unknown
  RNA secondary structure sequence
aagttcagaagtacacatcc

SEQ ID NO: 22508 - DNA, 20 bp, Unknown
  RNA secondary structure sequence
gaaactgacagaggatagat

SEQ ID NO: 22509 - DNA, 20 bp, Unknown
  RNA secondary structure sequence
ctgcttgtaccaattgctat

SEQ ID NO: 22510 - DNA, 20 bp, Unknown
  RNA secondary structure sequence
cttgatataataccaataga

SEQ ID NO: 22511 - DNA, 20 bp, Unknown
  RNA secondary structure sequence
tttggaaataataaaacaat

SEQ ID NO: 22512 - DNA, 20 bp, Unknown
  RNA secondary structure sequence
agtgacacaatcaccctccc

SEQ ID NO: 22513 - DNA, 20 bp, Unknown
  RNA secondary structure sequence
ggaagcactatgggcgcagc

SEQ ID NO: 22514 - DNA, 20 bp, Unknown
  RNA secondary structure sequence
gtactttctatagtgaatag

SEQ ID NO: 22515 - DNA, 20 bp, Unknown
  RNA secondary structure sequence
gatctgcggagcctgtgcct

SEQ ID NO: 22516 - DNA, 20 bp, Unknown
  RNA secondary structure sequence
tcatcacgtggcccgagagc

SEQ ID NO: 22517 - DNA, 20 bp, Unknown
  RNA secondary structure sequence
acagatttatatacttgata

SEQ ID NO: 22518 - DNA, 20 bp, Unknown
  RNA secondary structure sequence
cctaggcataatgggagaat

SEQ ID NO: 22519 - DNA, 20 bp, Unknown
  RNA secondary structure sequence
ttccaatcatccatgccagc

SEQ ID NO: 22520 - DNA, 20 bp, Unknown
  RNA secondary structure sequence
atactgaacaaactctgtga

SEQ ID NO: 22521 - DNA, 20 bp, Unknown
  RNA secondary structure sequence
cagcaagcccaccacaaaac

SEQ ID NO: 22522 - DNA, 20 bp, Unknown
  RNA secondary structure sequence
gagaactaccaaggtttatg

SEQ ID NO: 22523 - DNA, 20 bp, Unknown
  RNA secondary structure sequence
attatgtaaataagcaagaa

SEQ ID NO: 22524 - DNA, 20 bp, Unknown
  RNA secondary structure sequence
tttaatttatacacaaaatt

SEQ ID NO: 22525 - DNA, 20 bp, Unknown
  RNA secondary structure sequence
tataatcaattcttgacatg

SEQ ID NO: 22526 - DNA, 20 bp, Unknown
  RNA secondary structure sequence
aaactaaacacttatccttc

SEQ ID NO: 22527 - DNA, 20 bp, Unknown
  RNA secondary structure sequence
gaagctatatcactattgga

SEQ ID NO: 22528 - DNA, 20 bp, Unknown
  RNA secondary structure sequence
ctcttgtgttttcataaagg

SEQ ID NO: 22529 - DNA, 20 bp, Unknown
  RNA secondary structure sequence
gttgtgattgataaaattat

SEQ ID NO: 22530 - DNA, 20 bp, Unknown
  RNA secondary structure sequence
tttttaaggctgtacaatgg

SEQ ID NO: 22531 - DNA, 20 bp, Unknown
  RNA secondary structure sequence
tacttagtccttacaatagg

SEQ ID NO: 22532 - DNA, 20 bp, Unknown
  RNA secondary structure sequence
aaaaaaggaattaatactgc

SEQ ID NO: 22533 - DNA, 20 bp, Unknown
  RNA secondary structure sequence
ttggcttgcaaaggcgcgga

SEQ ID NO: 22534 - DNA, 20 bp, Unknown
  RNA secondary structure sequence
tcaacagcatctttggagga

SEQ ID NO: 22535 - DNA, 20 bp, Unknown
  RNA secondary structure sequence
tgatctggagtatccctgag

SEQ ID NO: 22536 - DNA, 20 bp, Unknown
  RNA secondary structure sequence
caggagtgatgggggccgcc

SEQ ID NO: 22537 - DNA, 20 bp, Unknown
  RNA secondary structure sequence
tggcggtggggattgcgttc

SEQ ID NO: 22538 - DNA, 20 bp, Unknown
  RNA secondary structure sequence
cactcacagaaataatgagg

SEQ ID NO: 22539 - DNA, 20 bp, Unknown
  RNA secondary structure sequence
gggcgcacgaggtgcaccag

SEQ ID NO: 22540 - DNA, 20 bp, Unknown
  RNA secondary structure sequence
tcagcagcatcgctcaggga

SEQ ID NO: 22541 - DNA, 20 bp, Unknown
  RNA secondary structure sequence
tgagtacgttggtgctggct

SEQ ID NO: 22542 - DNA, 20 bp, Unknown
  RNA secondary structure sequence
gccctgagcaggacaagatg

SEQ ID NO: 22543 - DNA, 20 bp, Unknown
  RNA secondary structure sequence
tgggtgtcgtctggtgtttc

SEQ ID NO: 22544 - DNA, 20 bp, Unknown
  RNA secondary structure sequence
tggcaggacatgttatgact

SEQ ID NO: 22545 - DNA, 20 bp, Unknown
  RNA secondary structure sequence
ggaagcgcaggctgaacaac

SEQ ID NO: 22546 - DNA, 20 bp, Unknown
  RNA secondary structure sequence
atcgcaccctcaagggagag

SEQ ID NO: 22547 - DNA, 20 bp, Unknown
  RNA secondary structure sequence
ctccataccgcccagaggta

SEQ ID NO: 22548 - DNA, 20 bp, Unknown
  RNA secondary structure sequence
ttgacacaaaagcacaggag

SEQ ID NO: 22549 - DNA, 20 bp, Unknown
  RNA secondary structure sequence
tcgaaagcacagtgcccctc

SEQ ID NO: 22550 - DNA, 20 bp, Unknown
  RNA secondary structure sequence
acccctgccctctcgcatta

SEQ ID NO: 22551 - DNA, 20 bp, Unknown
  RNA secondary structure sequence
cctccaacagccctcggctc

SEQ ID NO: 22552 - DNA, 20 bp, Unknown
  RNA secondary structure sequence
gagtccccagttcatgcaaa

SEQ ID NO: 22553 - DNA, 20 bp, Unknown
  RNA secondary structure sequence
caaggacaaagcccgggtcc

SEQ ID NO: 22554 - DNA, 20 bp, Unknown
  RNA secondary structure sequence
gtctccattgcaggcgcccc

SEQ ID NO: 22555 - DNA, 20 bp, Unknown
  RNA secondary structure sequence
tgcgtctacctacccttccg

SEQ ID NO: 22556 - DNA, 20 bp, Unknown
  RNA secondary structure sequence
cctccccgattattacccgt

SEQ ID NO: 22557 - DNA, 20 bp, Unknown
  RNA secondary structure sequence
accccgtctttccagtcaaa

SEQ ID NO: 22558 - DNA, 20 bp, Unknown
  RNA secondary structure sequence
tccaaatcccccttccaaaa

SEQ ID NO: 22559 - DNA, 20 bp, Unknown
  RNA secondary structure sequence
ccttccctatgtctactatc

SEQ ID NO: 22560 - DNA, 20 bp, Unknown
  RNA secondary structure sequence
aagttatatctcccaaccat

SEQ ID NO: 22561 - DNA, 20 bp, Unknown
  RNA secondary structure sequence
gatggcccctggtttggctg

SEQ ID NO: 22562 - DNA, 20 bp, Unknown
  RNA secondary structure sequence
tctccactcttaacgaatac

SEQ ID NO: 22563 - DNA, 20 bp, Unknown
  RNA secondary structure sequence
ctgaaactgtcagcgccctc

SEQ ID NO: 22564 - DNA, 20 bp, Unknown
  RNA secondary structure sequence
aaaggaccaatggcattgtt

SEQ ID NO: 22565 - DNA, 20 bp, Unknown
  RNA secondary structure sequence
tgcagtcttgcccaacctat

SEQ ID NO: 22566 - DNA, 20 bp, Unknown
  RNA secondary structure sequence
tgtggctcttctatgaccct

SEQ ID NO: 22567 - DNA, 20 bp, Unknown
  RNA secondary structure sequence
caactaactctacaaagtac

SEQ ID NO: 22568 - DNA, 20 bp, Unknown
  RNA secondary structure sequence
tggtctcactgttaccagcc

SEQ ID NO: 22569 - DNA, 20 bp, Unknown
  RNA secondary structure sequence
gcagggggaataaccggatc

SEQ ID NO: 22570 - DNA, 20 bp, Unknown
  RNA secondary structure sequence
acaatacccttcaaacccca

SEQ ID NO: 22571 - DNA, 20 bp, Unknown
  RNA secondary structure sequence
gcgaccatcccgtacatcct

SEQ ID NO: 22572 - DNA, 20 bp, Unknown
  RNA secondary structure sequence
tccaggtttcggacagagcc

SEQ ID NO: 22573 - DNA, 20 bp, Unknown
  RNA secondary structure sequence
cgttgtcggctctcctctcc

SEQ ID NO: 22574 - DNA, 20 bp, Unknown
  RNA secondary structure sequence
atacccaactctcggagacc

SEQ ID NO: 22575 - DNA, 20 bp, Unknown
  RNA secondary structure sequence
ctaccactctctcataacta

SEQ ID NO: 22576 - DNA, 20 bp, Unknown
  RNA secondary structure sequence
taggtagaatattgttttca

SEQ ID NO: 22577 - DNA, 20 bp, Unknown
  RNA secondary structure sequence
tgtcgtctccccctaagcaa

SEQ ID NO: 22578 - DNA, 20 bp, Unknown
  RNA secondary structure sequence
aagtaaagtatgattttgat

SEQ ID NO: 22579 - DNA, 20 bp, Unknown
  RNA secondary structure sequence
ctggacccgttcaatcgcgc

SEQ ID NO: 22580 - DNA, 20 bp, Unknown
  RNA secondary structure sequence
ccgcaaatcgtgttgaacaa

SEQ ID NO: 22581 - DNA, 20 bp, Unknown
  RNA secondary structure sequence
gtttatggttggtaggtgaa

SEQ ID NO: 22582 - DNA, 20 bp, Unknown
  RNA secondary structure sequence
aggttggaatttgggccgaa

SEQ ID NO: 22583 - DNA, 20 bp, Unknown
  RNA secondary structure sequence
ggaagttgtctgttcctaca

SEQ ID NO: 22584 - DNA, 20 bp, Unknown
  RNA secondary structure sequence
ttggtgaagaatttgatttt

SEQ ID NO: 22585 - DNA, 20 bp, Unknown
  RNA secondary structure sequence
gggactttggaaatttcgat

SEQ ID NO: 22586 - DNA, 20 bp, Unknown
  RNA secondary structure sequence
aatttcgttttagcccagaa

SEQ ID NO: 22587 - DNA, 20 bp, Unknown
  RNA secondary structure sequence
tgatggcgctgatacatcac

SEQ ID NO: 22588 - DNA, 20 bp, Unknown
  RNA secondary structure sequence
tagttttattccattttatt

SEQ ID NO: 22589 - DNA, 20 bp, Unknown
  RNA secondary structure sequence
tggtgttcatccaatgacta

SEQ ID NO: 22590 - DNA, 20 bp, Unknown
  RNA secondary structure sequence
gccctgcttacacgggtatt

SEQ ID NO: 22591 - DNA, 20 bp, Unknown
  RNA secondary structure sequence
ggtggtaagggtacgtctat

SEQ ID NO: 22592 - DNA, 20 bp, Unknown
  RNA secondary structure sequence
gagttgctacgcggcctggc

SEQ ID NO: 22593 - DNA, 20 bp, Unknown
  RNA secondary structure sequence
gtgctctttgcaccttctat

SEQ ID NO: 22594 - DNA, 20 bp, Unknown
  RNA secondary structure sequence
gttattggcacgcccttcag

SEQ ID NO: 22595 - DNA, 20 bp, Unknown
  RNA secondary structure sequence
gtgattcagtcagtaacgcc

SEQ ID NO: 22596 - DNA, 20 bp, Unknown
  RNA secondary structure sequence
cttacctaccgaccgtggag

SEQ ID NO: 22597 - DNA, 20 bp, Unknown
  RNA secondary structure sequence
caagaggtgcgctgccccta

SEQ ID NO: 22598 - DNA, 20 bp, Unknown
  RNA secondary structure sequence
tgacccacggtggcaaggag

SEQ ID NO: 22599 - DNA, 20 bp, Unknown
  RNA secondary structure sequence
tattcctgtttgagcacgct

SEQ ID NO: 22600 - DNA, 20 bp, Unknown
  RNA secondary structure sequence
gtaggggagacgaagtgctc

SEQ ID NO: 22601 - DNA, 20 bp, Unknown
  RNA secondary structure sequence
tggaaccttgcaaatgctca

SEQ ID NO: 22602 - DNA, 20 bp, Unknown
  RNA secondary structure sequence
gtacttatggaagattcatg

SEQ ID NO: 22603 - DNA, 20 bp, Unknown
  RNA secondary structure sequence
cgggggccccaatggccgca

SEQ ID NO: 22604 - DNA, 20 bp, Unknown
  RNA secondary structure sequence
taacaatttcactgcggaca

SEQ ID NO: 22605 - DNA, 20 bp, Unknown
  RNA secondary structure sequence
ccggggggtcgataaccagc

SEQ ID NO: 22606 - DNA, 20 bp, Unknown
  RNA secondary structure sequence
tctcttgggaggccccaatc

SEQ ID NO: 22607 - DNA, 20 bp, Unknown
  RNA secondary structure sequence
agcttcagtgtgcgaaggct

SEQ ID NO: 22608 - DNA, 20 bp, Unknown
  RNA secondary structure sequence
gcttcgacagcatgccaagc

SEQ ID NO: 22609 - DNA, 20 bp, Unknown
  RNA secondary structure sequence
ttgattcgtcaatcgacgaa

SEQ ID NO: 22610 - DNA, 20 bp, Unknown
  RNA secondary structure sequence
acttagaagtactagcaaaa

SEQ ID NO: 22611 - DNA, 20 bp, Unknown
  RNA secondary structure sequence
gatggactcggccattaggc

SEQ ID NO: 22612 - DNA, 20 bp, Unknown
  RNA secondary structure sequence
gggtgttgagcggtatgtca

SEQ ID NO: 22613 - DNA, 20 bp, Unknown
  RNA secondary structure sequence
tggcaccttcatgacaacag

SEQ ID NO: 22614 - DNA, 20 bp, Unknown
  RNA secondary structure sequence
cagtaatgacgatgtgctga

SEQ ID NO: 22615 - DNA, 20 bp, Unknown
  RNA secondary structure sequence
gagcatgattgagacccgca

SEQ ID NO: 22616 - DNA, 20 bp, Unknown
  RNA secondary structure sequence
ggtattcgcggacacggacg

SEQ ID NO: 22617 - DNA, 20 bp, Unknown
  RNA secondary structure sequence
tatctattactgcaaatcca

SEQ ID NO: 22618 - DNA, 20 bp, Unknown
  RNA secondary structure sequence
aaaggtttgccaaattcttg

SEQ ID NO: 22619 - DNA, 20 bp, Unknown
  RNA secondary structure sequence
ccatctagagaagcgcgtcc

SEQ ID NO: 22620 - DNA, 20 bp, Unknown
  RNA secondary structure sequence
ggcagtcattcagagtgtgt

SEQ ID NO: 22621 - DNA, 20 bp, Unknown
  RNA secondary structure sequence
cctgaaccttgctggcaggc

SEQ ID NO: 22622 - DNA, 20 bp, Unknown
  RNA secondary structure sequence
acaaggacaaattgaatata

SEQ ID NO: 22623 - DNA, 20 bp, Unknown
  RNA secondary structure sequence
ccgtttgatagaggcatcta

SEQ ID NO: 22624 - DNA, 20 bp, Unknown
  RNA secondary structure sequence
ttggtgaccccgacgtgatc

SEQ ID NO: 22625 - DNA, 20 bp, Unknown
  RNA secondary structure sequence
aacctaccgagaactcagag

SEQ ID NO: 22626 - DNA, 20 bp, Unknown
  RNA secondary structure sequence
caactccagacggttatagc

SEQ ID NO: 22627 - DNA, 20 bp, Unknown
  RNA secondary structure sequence
tgctttaggcagaagtcaca

SEQ ID NO: 22628 - DNA, 20 bp, Unknown
  RNA secondary structure sequence
gagaacttctacctggcggc

SEQ ID NO: 22629 - DNA, 20 bp, Unknown
  RNA secondary structure sequence
gaggagcactgtaagcccca

SEQ ID NO: 22630 - DNA, 20 bp, Unknown
  RNA secondary structure sequence
gagtacgttctgtctctcca

SEQ ID NO: 22631 - DNA, 20 bp, Unknown
  RNA secondary structure sequence
tgggacattcttcatgcttg

SEQ ID NO: 22632 - DNA, 20 bp, Unknown
  RNA secondary structure sequence
acagcacaaccctcacctat

SEQ ID NO: 22633 - DNA, 20 bp, Unknown
  RNA secondary structure sequence
cttctgcagaagatattaat

SEQ ID NO: 22634 - DNA, 20 bp, Unknown
  RNA secondary structure sequence
caggatgcaaaaattaaaca

SEQ ID NO: 22635 - DNA, 20 bp, Unknown
  RNA secondary structure sequence
acctgcttcttttgcaaaca

SEQ ID NO: 22636 - DNA, 20 bp, Unknown
  RNA secondary structure sequence
aatggccgcatggaccggtc

SEQ ID NO: 22637 - DNA, 20 bp, Unknown
  RNA secondary structure sequence
attcctatgttggtagatac

SEQ ID NO: 22638 - DNA, 20 bp, Unknown
  RNA secondary structure sequence
ctagaaaatcaaggaatatt

SEQ ID NO: 22639 - DNA, 20 bp, Unknown
  RNA secondary structure sequence
ccgcctcatgactgcgtttt

SEQ ID NO: 22640 - DNA, 20 bp, Unknown
  RNA secondary structure sequence
gttgaaggacgaccaacatg

SEQ ID NO: 22641 - DNA, 20 bp, Unknown
  RNA secondary structure sequence
agatcacggtacctaacagc

SEQ ID NO: 22642 - DNA, 20 bp, Unknown
  RNA secondary structure sequence
ctattactaccattcttgga

SEQ ID NO: 22643 - DNA, 20 bp, Unknown
  RNA secondary structure sequence
ttaaccaacatgctgaatac

SEQ ID NO: 22644 - DNA, 20 bp, Unknown
  RNA secondary structure sequence
agacaaaagaaatgggcaaa

SEQ ID NO: 22645 - DNA, 20 bp, Unknown
  RNA secondary structure sequence
tacattaaactatcttatcg

SEQ ID NO: 22646 - DNA, 20 bp, Unknown
  RNA secondary structure sequence
atcacgataaccacagccac

SEQ ID NO: 22647 - DNA, 20 bp, Unknown
  RNA secondary structure sequence
aaatgcacactgggtttagg

SEQ ID NO: 22648 - DNA, 20 bp, Unknown
  RNA secondary structure sequence
aggcctaaagtagaaataac

SEQ ID NO: 22649 - DNA, 20 bp, Unknown
  RNA secondary structure sequence
aaagtagaaataacaactga

SEQ ID NO: 22650 - DNA, 20 bp, Unknown
  RNA secondary structure sequence
tcctctccaattacagcaac

SEQ ID NO: 22651 - DNA, 20 bp, Unknown
  RNA secondary structure sequence
ggccgggagctggaatgctg

SEQ ID NO: 22652 - DNA, 20 bp, Unknown
  RNA secondary structure sequence
tggaggaggatataatttta

SEQ ID NO: 22653 - DNA, 20 bp, Unknown
  RNA secondary structure sequence
aggattattggattactgca

SEQ ID NO: 22654 - DNA, 20 bp, Unknown
  RNA secondary structure sequence
tccaggagagggtgtacagg

SEQ ID NO: 22655 - DNA, 20 bp, Unknown
  RNA secondary structure sequence
tacgtgcctgtggttataac

SEQ ID NO: 22656 - DNA, 20 bp, Unknown
  RNA secondary structure sequence
accaatgtcataaaggaatt

SEQ ID NO: 22657 - DNA, 20 bp, Unknown
  RNA secondary structure sequence
cggatcctactcgtcctgca

SEQ ID NO: 22658 - DNA, 20 bp, Unknown
  RNA secondary structure sequence
cgcgctatatgctgctcatt

SEQ ID NO: 22659 - DNA, 20 bp, Unknown
  RNA secondary structure sequence
tttatagaggttcccgaact

SEQ ID NO: 22660 - DNA, 20 bp, Unknown
  RNA secondary structure sequence
tgtcacgtcgtatagatttt

SEQ ID NO: 22661 - DNA, 20 bp, Unknown
  RNA secondary structure sequence
cggaaactgaaaagtcccgt

SEQ ID NO: 22662 - DNA, 20 bp, Unknown
  RNA secondary structure sequence
tcaattctttggatcgtaat

SEQ ID NO: 22663 - DNA, 20 bp, Unknown
  RNA secondary structure sequence
cgatatgtgtgggtgtcaac

SEQ ID NO: 22664 - DNA, 20 bp, Unknown
  RNA secondary structure sequence
tagctatttagctttactaa

SEQ ID NO: 22665 - DNA, 20 bp, Unknown
  RNA secondary structure sequence
tgaatccccgtcgtcatcca

SEQ ID NO: 22666 - DNA, 20 bp, Unknown
  RNA secondary structure sequence
ttacccttctaatgttgtta

SEQ ID NO: 22667 - DNA, 20 bp, Unknown
  RNA secondary structure sequence
ttattctccgttagtcgatt

SEQ ID NO: 22668 - DNA, 20 bp, Unknown
  RNA secondary structure sequence
gcagatccatgcgtgtaggt

SEQ ID NO: 22669 - DNA, 20 bp, Unknown
  RNA secondary structure sequence
tcgtcgtactgcttacgatt

SEQ ID NO: 22670 - DNA, 20 bp, Unknown
  RNA secondary structure sequence
aagtctacccccggcccgtc

SEQ ID NO: 22671 - DNA, 20 bp, Unknown
  RNA secondary structure sequence
agacgtgttcggggctcacc

SEQ ID NO: 22672 - DNA, 20 bp, Unknown
  RNA secondary structure sequence
ctcaggcgatgggaccgccg

SEQ ID NO: 22673 - DNA, 20 bp, Unknown
  RNA secondary structure sequence
tccctctacaatattggcct

SEQ ID NO: 22674 - DNA, 20 bp, Unknown
  RNA secondary structure sequence
aggaacgggaaagaattctc

SEQ ID NO: 22675 - DNA, 20 bp, Unknown
  RNA secondary structure sequence
caggtctcaaaggggcagct

SEQ ID NO: 22676 - DNA, 20 bp, Unknown
  RNA secondary structure sequence
gggcaagagaatgtccccga

SEQ ID NO: 22677 - DNA, 20 bp, Unknown
  RNA secondary structure sequence
aacccatgggaaaagtaggg

SEQ ID NO: 22678 - DNA, 20 bp, Unknown
  RNA secondary structure sequence
aactaaaggcccagatccag

SEQ ID NO: 22679 - DNA, 20 bp, Unknown
  RNA secondary structure sequence
gagccggcatgggactagcc

SEQ ID NO: 22680 - DNA, 20 bp, Unknown
  RNA secondary structure sequence
aggatgcctttttctgcctc

SEQ ID NO: 22681 - DNA, 20 bp, Unknown
  RNA secondary structure sequence
atctggggtacctactcaag

SEQ ID NO: 22682 - DNA, 20 bp, Unknown
  RNA secondary structure sequence
ccctaacaaaagagagcatc

SEQ ID NO: 22683 - DNA, 20 bp, Unknown
  RNA secondary structure sequence
atgaaattctctatggagga

SEQ ID NO: 22684 - DNA, 20 bp, Unknown
  RNA secondary structure sequence
acccgttccaggtcggggat

SEQ ID NO: 22685 - DNA, 20 bp, Unknown
  RNA secondary structure sequence
cagatgagtcctgggagctg

SEQ ID NO: 22686 - DNA, 20 bp, Unknown
  RNA secondary structure sequence
caaactcccacggtgagaaa

SEQ ID NO: 22687 - DNA, 20 bp, Unknown
  RNA secondary structure sequence
atagcctcatcaggagaggt

SEQ ID NO: 22688 - DNA, 20 bp, Unknown
  RNA secondary structure sequence
caattcatcaatgataggat

SEQ ID NO: 22689 - DNA, 20 bp, Unknown
  RNA secondary structure sequence
acaccccgacttgctgagtt

SEQ ID NO: 22690 - DNA, 20 bp, Unknown
  RNA secondary structure sequence
ttgaaaacagttattcatac

SEQ ID NO: 22691 - DNA, 20 bp, Unknown
  RNA secondary structure sequence
ttcttaactttaagtctatg

SEQ ID NO: 22692 - DNA, 20 bp, Unknown
  RNA secondary structure sequence
cctactttactggtgaatta

SEQ ID NO: 22693 - DNA, 20 bp, Unknown
  RNA secondary structure sequence
acaagccattacggacagtt

SEQ ID NO: 22694 - DNA, 20 bp, Unknown
  RNA secondary structure sequence
agacaaaaatgaaaacacaa

SEQ ID NO: 22695 - DNA, 20 bp, Unknown
  RNA secondary structure sequence
tgattgatgatttgggccaa

SEQ ID NO: 22696 - DNA, 20 bp, Unknown
  RNA secondary structure sequence
tattagattcaggtgctctg

SEQ ID NO: 22697 - DNA, 20 bp, Unknown
  RNA secondary structure sequence
acactagactagaagaacca

SEQ ID NO: 22698 - DNA, 20 bp, Unknown
  RNA secondary structure sequence
caaccatttttaatacatgt

SEQ ID NO: 22699 - DNA, 20 bp, Unknown
  RNA secondary structure sequence
ataagaatttttgtaccagc

SEQ ID NO: 22700 - DNA, 20 bp, Unknown
  RNA secondary structure sequence
aacgacccagacatagaagc

SEQ ID NO: 22701 - DNA, 20 bp, Unknown
  RNA secondary structure sequence
tatggactgaggatcaccga

SEQ ID NO: 22702 - DNA, 20 bp, Unknown
  RNA secondary structure sequence
ttctttgcgactatcagatt

SEQ ID NO: 22703 - DNA, 20 bp, Unknown
  RNA secondary structure sequence
ggtggttatccactcctgtg

SEQ ID NO: 22704 - DNA, 20 bp, Unknown
  RNA secondary structure sequence
aggcagtcagtgactttcaa

SEQ ID NO: 22705 - DNA, 20 bp, Unknown
  RNA secondary structure sequence
taggatcctttacaatctca

SEQ ID NO: 22706 - DNA, 20 bp, Unknown
  RNA secondary structure sequence
atcaagcatccaacaaccaa

SEQ ID NO: 22707 - DNA, 20 bp, Unknown
  RNA secondary structure sequence
tggacaaagagtgtcaaaca

SEQ ID NO: 22708 - DNA, 20 bp, Unknown
  RNA secondary structure sequence
gcctccagtcatcccggagt

SEQ ID NO: 22709 - DNA, 20 bp, Unknown
  RNA secondary structure sequence
cattgacactactcctgagg

SEQ ID NO: 22710 - DNA, 20 bp, Unknown
  RNA secondary structure sequence
aaattatcatgcagaccatc

SEQ ID NO: 22711 - DNA, 20 bp, Unknown
  RNA secondary structure sequence
tacacatcataatggccagt

SEQ ID NO: 22712 - DNA, 20 bp, Unknown
  RNA secondary structure sequence
agaagaacagctggggctac

SEQ ID NO: 22713 - DNA, 20 bp, Unknown
  RNA secondary structure sequence
ctaaaggggtgaaataaaac

SEQ ID NO: 22714 - DNA, 20 bp, Unknown
  RNA secondary structure sequence
ctgtgggatcatagttctgg

SEQ ID NO: 22715 - DNA, 20 bp, Unknown
  RNA secondary structure sequence
gtgcaccgggactgttatgg

SEQ ID NO: 22716 - DNA, 20 bp, Unknown
  RNA secondary structure sequence
cacagcaggtgttgccttat

SEQ ID NO: 22717 - DNA, 20 bp, Unknown
  RNA secondary structure sequence
aatagatcaaattagctgca

SEQ ID NO: 22718 - DNA, 20 bp, Unknown
  RNA secondary structure sequence
taacgataattcagaatgga

SEQ ID NO: 22719 - DNA, 20 bp, Unknown
  RNA secondary structure sequence
catcacaattcctgctaaca

SEQ ID NO: 22720 - DNA, 20 bp, Unknown
  RNA secondary structure sequence
gccttacggtccatcaggta

SEQ ID NO: 22721 - DNA, 20 bp, Unknown
  RNA secondary structure sequence
attaggcgatgttgataccg

SEQ ID NO: 22722 - DNA, 20 bp, Unknown
  RNA secondary structure sequence
atactaaatgtaatcaaact

SEQ ID NO: 22723 - DNA, 20 bp, Unknown
  RNA secondary structure sequence
gaaatacatgagtcaatcgc

SEQ ID NO: 22724 - DNA, 20 bp, Unknown
  RNA secondary structure sequence
gccaatcatgaaagcacacg

SEQ ID NO: 22725 - DNA, 20 bp, Unknown
  RNA secondary structure sequence
ctatcatatggaattcagtc

SEQ ID NO: 22726 - DNA, 20 bp, Unknown
  RNA secondary structure sequence
tgcagaaagacttgacgaaa

SEQ ID NO: 22727 - DNA, 20 bp, Unknown
  RNA secondary structure sequence
ttgtgcaaggcaagctcaat

SEQ ID NO: 22728 - DNA, 20 bp, Unknown
  RNA secondary structure sequence
aataagatcaggattgaaaa

SEQ ID NO: 22729 - DNA, 20 bp, Unknown
  RNA secondary structure sequence
gaataaagagcactcatcca

SEQ ID NO: 22730 - DNA, 20 bp, Unknown
  RNA secondary structure sequence
ttcagtcaagtgggcatttg

SEQ ID NO: 22731 - DNA, 20 bp, Unknown
  RNA secondary structure sequence
aatcttatcaatgaatacta

SEQ ID NO: 22732 - DNA, 20 bp, Unknown
  RNA secondary structure sequence
gagaaaagttttgattctag

SEQ ID NO: 22733 - DNA, 20 bp, Unknown
  RNA secondary structure sequence
ctccattcagcttcttcgga

SEQ ID NO: 22734 - DNA, 20 bp, Unknown
  RNA secondary structure sequence
ccgccctcccacatcctccc

SEQ ID NO: 22735 - DNA, 20 bp, Unknown
  RNA secondary structure sequence
cgctcccaatctcggccgcg

SEQ ID NO: 22736 - DNA, 20 bp, Unknown
  RNA secondary structure sequence
tggtgtaaggttcatgtgcc

SEQ ID NO: 22737 - DNA, 20 bp, Unknown
  RNA secondary structure sequence
tctgtgctcgctgctgtggc

SEQ ID NO: 22738 - DNA, 20 bp, Unknown
  RNA secondary structure sequence
ttggctctcctctctcttcc

SEQ ID NO: 22739 - DNA, 20 bp, Unknown
  RNA secondary structure sequence
ttcacccgcggctggaacat

SEQ ID NO: 22740 - DNA, 20 bp, Unknown
  RNA secondary structure sequence
tacaacacccactccatgtg

SEQ ID NO: 22741 - DNA, 20 bp, Unknown
  RNA secondary structure sequence
tatgaaagcaacaccgctac

SEQ ID NO: 22742 - DNA, 20 bp, Unknown
  RNA secondary structure sequence
tctttccacggtctccgcta

SEQ ID NO: 22743 - DNA, 20 bp, Unknown
  RNA secondary structure sequence
gcccaccggcctggtctcat

SEQ ID NO: 22744 - DNA, 20 bp, Unknown
  RNA secondary structure sequence
ttcactggctccgctcagca

SEQ ID NO: 22745 - DNA, 20 bp, Unknown
  RNA secondary structure sequence
tcccaaaccctcaccgaaga

SEQ ID NO: 22746 - DNA, 20 bp, Unknown
  RNA secondary structure sequence
aaccctgccaccatgcttgt

SEQ ID NO: 22747 - DNA, 20 bp, Unknown
  RNA secondary structure sequence
tcatacttcggatgggagga

SEQ ID NO: 22748 - DNA, 20 bp, Unknown
  RNA secondary structure sequence
gacggcagtgccaaacagat

SEQ ID NO: 22749 - DNA, 20 bp, Unknown
  RNA secondary structure sequence
gtcagctccatcactggcga

SEQ ID NO: 22750 - DNA, 20 bp, Unknown
  RNA secondary structure sequence
ttggtctccatcgcccagga

SEQ ID NO: 22751 - DNA, 20 bp, Unknown
  RNA secondary structure sequence
gcttcactcctcgctcaaac

SEQ ID NO: 22752 - DNA, 20 bp, Unknown
  RNA secondary structure sequence
ctcgtctcctctgccccctt

SEQ ID NO: 22753 - DNA, 20 bp, Unknown
  RNA secondary structure sequence
caagccatcgcaaacaacac

SEQ ID NO: 22754 - DNA, 20 bp, Unknown
  RNA secondary structure sequence
ggcgcccatccccaccccac

SEQ ID NO: 22755 - DNA, 20 bp, Unknown
  RNA secondary structure sequence
aaccggatgtcccgcttgca

SEQ ID NO: 22756 - DNA, 20 bp, Unknown
  RNA secondary structure sequence
atgctcctcggtggtctcat

SEQ ID NO: 22757 - DNA, 20 bp, Unknown
  RNA secondary structure sequence
ttcacccttgttgctgacca

SEQ ID NO: 22758 - DNA, 20 bp, Unknown
  RNA secondary structure sequence
atctgtgtcctctctgccct

SEQ ID NO: 22759 - DNA, 20 bp, Unknown
  RNA secondary structure sequence
caggatttcccacccacgtc

SEQ ID NO: 22760 - DNA, 20 bp, Unknown
  RNA secondary structure sequence
tagttagttagaaccctttg

SEQ ID NO: 22761 - DNA, 20 bp, Unknown
  RNA secondary structure sequence
aagccatggttgtactgcac

SEQ ID NO: 22762 - DNA, 20 bp, Unknown
  RNA secondary structure sequence
ataaacctcttgctgattgc

SEQ ID NO: 22763 - DNA, 20 bp, Unknown
  RNA secondary structure sequence
catacctgttgtccttgtat

SEQ ID NO: 22764 - DNA, 20 bp, Unknown
  RNA secondary structure sequence
taggggggcaaccggtgact

SEQ ID NO: 22765 - DNA, 20 bp, Unknown
  RNA secondary structure sequence
ttcctcaagggttcaagaat

SEQ ID NO: 22766 - DNA, 20 bp, Unknown
  RNA secondary structure sequence
ctttgggcaataaggggtac

SEQ ID NO: 22767 - DNA, 20 bp, Unknown
  RNA secondary structure sequence
tcaaggatgcagggaagcta

SEQ ID NO: 22768 - DNA, 20 bp, Unknown
  RNA secondary structure sequence
ttaaccctgctaccttgctc

SEQ ID NO: 22769 - DNA, 20 bp, Unknown
  RNA secondary structure sequence
gaggaaaaactatcatgcct

SEQ ID NO: 22770 - DNA, 20 bp, Unknown
  RNA secondary structure sequence
gtgctcaaatcaacgccgga

SEQ ID NO: 22771 - DNA, 20 bp, Unknown
  RNA secondary structure sequence
tggatgtaaaactacagata

SEQ ID NO: 22772 - DNA, 20 bp, Unknown
  RNA secondary structure sequence
tcccaaacggattgggaccg

SEQ ID NO: 22773 - DNA, 20 bp, Unknown
  RNA secondary structure sequence
ccccccatcctgcctatcta

SEQ ID NO: 22774 - DNA, 20 bp, Unknown
  RNA secondary structure sequence
taacactggactcaccccat

SEQ ID NO: 22775 - DNA, 20 bp, Unknown
  RNA secondary structure sequence
agtcttacaaaacagacggg

SEQ ID NO: 22776 - DNA, 20 bp, Unknown
  RNA secondary structure sequence
gggatggtttgaaggatggt

SEQ ID NO: 22777 - DNA, 20 bp, Unknown
  RNA secondary structure sequence
gttcccatgagatacaagga

SEQ ID NO: 22778 - DNA, 20 bp, Unknown
  RNA secondary structure sequence
ctttgctgagacttgaccgc

SEQ ID NO: 22779 - DNA, 20 bp, Unknown
  RNA secondary structure sequence
ccaagtacactacccactag

SEQ ID NO: 22780 - DNA, 20 bp, Unknown
  RNA secondary structure sequence
acccaagattggtcccgaga

SEQ ID NO: 22781 - DNA, 20 bp, Unknown
  RNA secondary structure sequence
atggctagggctgcattggc

SEQ ID NO: 22782 - DNA, 20 bp, Unknown
  RNA secondary structure sequence
gaggcagtggatcattggga

SEQ ID NO: 22783 - DNA, 20 bp, Unknown
  RNA secondary structure sequence
gctatagtcatcaccaccaa

SEQ ID NO: 22784 - DNA, 20 bp, Unknown
  RNA secondary structure sequence
ttctcacatctaaaaatgga

SEQ ID NO: 22785 - DNA, 20 bp, Unknown
  RNA secondary structure sequence
atggcgggatctgcgctcgt

SEQ ID NO: 22786 - DNA, 20 bp, Unknown
  RNA secondary structure sequence
caacggcgacaacttggtct

SEQ ID NO: 22787 - DNA, 20 bp, Unknown
  RNA secondary structure sequence
ggatggggcttttgggtcag

SEQ ID NO: 22788 - DNA, 20 bp, Unknown
  RNA secondary structure sequence
cttgaagaaggttgccctga

SEQ ID NO: 22789 - DNA, 20 bp, Unknown
  RNA secondary structure sequence
gccggccacgagattgtgag

SEQ ID NO: 22790 - DNA, 20 bp, Unknown
  RNA secondary structure sequence
aaaaggaagaatgatgattg

SEQ ID NO: 22791 - DNA, 20 bp, Unknown
  RNA secondary structure sequence
ctactatggggcgccgatct

SEQ ID NO: 22792 - DNA, 20 bp, Unknown
  RNA secondary structure sequence
gcagattatacagcatggga

SEQ ID NO: 22793 - DNA, 20 bp, Unknown
  RNA secondary structure sequence
ccatctggattcccatgtac

SEQ ID NO: 22794 - DNA, 20 bp, Unknown
  RNA secondary structure sequence
atcttctggacccgcgggcc

SEQ ID NO: 22795 - DNA, 20 bp, Unknown
  RNA secondary structure sequence
caatgtccagagtgtgcagt

SEQ ID NO: 22796 - DNA, 20 bp, Unknown
  RNA secondary structure sequence
ccccattgggtttccagacc

SEQ ID NO: 22797 - DNA, 20 bp, Unknown
  RNA secondary structure sequence
ctggatttcccccccatcac

SEQ ID NO: 22798 - DNA, 20 bp, Unknown
  RNA secondary structure sequence
ctgggagcgggcatacaggt

SEQ ID NO: 22799 - DNA, 20 bp, Unknown
  RNA secondary structure sequence
cgtgctgggggtttgaccag

SEQ ID NO: 22800 - DNA, 20 bp, Unknown
  RNA secondary structure sequence
gttttagccagcactacagc

SEQ ID NO: 22801 - DNA, 20 bp, Unknown
  RNA secondary structure sequence
caggcctatcagaaacgaat

SEQ ID NO: 22802 - DNA, 20 bp, Unknown
  RNA secondary structure sequence
ggagcaattgagctcagtgt

SEQ ID NO: 22803 - DNA, 20 bp, Unknown
  RNA secondary structure sequence
caaagtaagagatcaagctg

SEQ ID NO: 22804 - DNA, 20 bp, Unknown
  RNA secondary structure sequence
ccagttcactggtgcttttg

SEQ ID NO: 22805 - DNA, 20 bp, Unknown
  RNA secondary structure sequence
cttactgaatgacaggcatt

SEQ ID NO: 22806 - DNA, 20 bp, Unknown
  RNA secondary structure sequence
aggtccagataatggagcag

SEQ ID NO: 22807 - DNA, 20 bp, Unknown
  RNA secondary structure sequence
gggacgacctaaagaaaaaa

SEQ ID NO: 22808 - DNA, 20 bp, Unknown
  RNA secondary structure sequence
ctaggaggtctggagccgca

SEQ ID NO: 22809 - DNA, 20 bp, Unknown
  RNA secondary structure sequence
tcaaagggacgaaggtggtc

SEQ ID NO: 22810 - DNA, 20 bp, Unknown
  RNA secondary structure sequence
ccgaactttctttgaccatc

SEQ ID NO: 22811 - DNA, 20 bp, Unknown
  RNA secondary structure sequence
aagctggactgctggtctcc

SEQ ID NO: 22812 - DNA, 20 bp, Unknown
  RNA secondary structure sequence
gtcatgaaggagagggaata

SEQ ID NO: 22813 - DNA, 20 bp, Unknown
  RNA secondary structure sequence
tccagtcacttcaacaaatt

SEQ ID NO: 22814 - DNA, 20 bp, Unknown
  RNA secondary structure sequence
cggtatttaacagcttgtat

SEQ ID NO: 22815 - DNA, 20 bp, Unknown
  RNA secondary structure sequence
gaacatgctgggaacagatg

SEQ ID NO: 22816 - DNA, 20 bp, Unknown
  RNA secondary structure sequence
tagacatccttaagcagaac

SEQ ID NO: 22817 - DNA, 20 bp, Unknown
  RNA secondary structure sequence
agataagagtgcatgaggga

SEQ ID NO: 22818 - DNA, 20 bp, Unknown
  RNA secondary structure sequence
tgacaataacttactcatcg

SEQ ID NO: 22819 - DNA, 20 bp, Unknown
  RNA secondary structure sequence
acaggagatatgggccagca

SEQ ID NO: 22820 - DNA, 20 bp, Unknown
  RNA secondary structure sequence
ttgatgagaggattgtcctc

SEQ ID NO: 22821 - DNA, 20 bp, Unknown
  RNA secondary structure sequence
agcaacatgacgcaacgagt

SEQ ID NO: 22822 - DNA, 20 bp, Unknown
  RNA secondary structure sequence
aagccttcattggacatctc

SEQ ID NO: 22823 - DNA, 20 bp, Unknown
  RNA secondary structure sequence
tattctgatagaggctgggg

SEQ ID NO: 22824 - DNA, 20 bp, Unknown
  RNA secondary structure sequence
gccccctgcaggattccagt

SEQ ID NO: 22825 - DNA, 20 bp, Unknown
  RNA secondary structure sequence
ggcaagagagagctcaagtg

SEQ ID NO: 22826 - DNA, 20 bp, Unknown
  RNA secondary structure sequence
tccccagggaggaagaatgg

SEQ ID NO: 22827 - DNA, 20 bp, Unknown
  RNA secondary structure sequence
agatccaccacggatagcgg

SEQ ID NO: 22828 - DNA, 20 bp, Unknown
  RNA secondary structure sequence
catgagatgaacaatggagg

SEQ ID NO: 22829 - DNA, 20 bp, Unknown
  RNA secondary structure sequence
gatgaagcccattttttgga

SEQ ID NO: 22830 - DNA, 20 bp, Unknown
  RNA secondary structure sequence
gggcgcattgggagaaatcc

SEQ ID NO: 22831 - DNA, 20 bp, Unknown
  RNA secondary structure sequence
ccagtttcccctggtgaaat

SEQ ID NO: 22832 - DNA, 20 bp, Unknown
  RNA secondary structure sequence
gacagcggtgaaacagtgaa

SEQ ID NO: 22833 - DNA, 20 bp, Unknown
  RNA secondary structure sequence
gatttcctggctaaaaaagg

SEQ ID NO: 22834 - DNA, 20 bp, Unknown
  RNA secondary structure sequence
gacaaccaagtggcatacct

SEQ ID NO: 22835 - DNA, 20 bp, Unknown
  RNA secondary structure sequence
gcctggacagtgtacgttgg

SEQ ID NO: 22836 - DNA, 20 bp, Unknown
  RNA secondary structure sequence
ctggtcagtggctggaattc

SEQ ID NO: 22837 - DNA, 20 bp, Unknown
  RNA secondary structure sequence
gttgacattgaggaagctcc

SEQ ID NO: 22838 - DNA, 20 bp, Unknown
  RNA secondary structure sequence
aagcgacagtttgagttgta

SEQ ID NO: 22839 - DNA, 20 bp, Unknown
  RNA secondary structure sequence
ccagtgaaatgtgacaccct

SEQ ID NO: 22840 - DNA, 20 bp, Unknown
  RNA secondary structure sequence
cttgagtttgaggccctggg

SEQ ID NO: 22841 - DNA, 20 bp, Unknown
  RNA secondary structure sequence
atcacagaggcagaccttga

SEQ ID NO: 22842 - DNA, 20 bp, Unknown
  RNA secondary structure sequence
ctgaagaggatggcggtgag

SEQ ID NO: 22843 - DNA, 20 bp, Unknown
  RNA secondary structure sequence
ttccatgaactacagctgaa

SEQ ID NO: 22844 - DNA, 20 bp, Unknown
  RNA secondary structure sequence
atggtgaaaaaatggagaga

SEQ ID NO: 22845 - DNA, 20 bp, Unknown
  RNA secondary structure sequence
gacaggtattctgtggatgc

SEQ ID NO: 22846 - DNA, 20 bp, Unknown
  RNA secondary structure sequence
cgggataaaaactacggatg

SEQ ID NO: 22847 - DNA, 20 bp, Unknown
  RNA secondary structure sequence
acatataaacaaaaaccagc

SEQ ID NO: 22848 - DNA, 20 bp, Unknown
  RNA secondary structure sequence
cggagaggtaatgtgaatgg

SEQ ID NO: 22849 - DNA, 20 bp, Unknown
  RNA secondary structure sequence
tggatatggctgatgaacaa

SEQ ID NO: 22850 - DNA, 20 bp, Unknown
  RNA secondary structure sequence
ggtgttgtactggacaggcc

SEQ ID NO: 22851 - DNA, 20 bp, Unknown
  RNA secondary structure sequence
aagcaattagggatccttgg

SEQ ID NO: 22852 - DNA, 20 bp, Unknown
  RNA secondary structure sequence
accagtgctgagtttatgca

SEQ ID NO: 22853 - DNA, 20 bp, Unknown
  RNA secondary structure sequence
tttccatcaaggcataagag

SEQ ID NO: 22854 - DNA, 20 bp, Unknown
  RNA secondary structure sequence
cagataacattggccactgg

SEQ ID NO: 22855 - DNA, 20 bp, Unknown
  RNA secondary structure sequence
ggagatatgaaggaaggtga

SEQ ID NO: 22856 - DNA, 20 bp, Unknown
  RNA secondary structure sequence
aggtttgctgaaaatcttag

SEQ ID NO: 22857 - DNA, 20 bp, Unknown
  RNA secondary structure sequence
gagtcaggtgtgacattgcc

SEQ ID NO: 22858 - DNA, 20 bp, Unknown
  RNA secondary structure sequence
gaggtcctcaacaacctcct

SEQ ID NO: 22859 - DNA, 20 bp, Unknown
  RNA secondary structure sequence
tacacatacctcaatgcaag

SEQ ID NO: 22860 - DNA, 20 bp, Unknown
  RNA secondary structure sequence
aaggaattagctgtgggaga

SEQ ID NO: 22861 - DNA, 20 bp, Unknown
  RNA secondary structure sequence
tatgctacaagttccttgaa

SEQ ID NO: 22862 - DNA, 20 bp, Unknown
  RNA secondary structure sequence
tatcaagatcttgtcgatag

SEQ ID NO: 22863 - DNA, 20 bp, Unknown
  RNA secondary structure sequence
aacaaaggttctacctcaaa

SEQ ID NO: 22864 - DNA, 20 bp, Unknown
  RNA secondary structure sequence
aagtgccctccatgtagtaa

SEQ ID NO: 22865 - DNA, 20 bp, Unknown
  RNA secondary structure sequence
ggctcaacaatggcctctgc

SEQ ID NO: 22866 - DNA, 20 bp, Unknown
  RNA secondary structure sequence
cccggctatgaaggtaaaac

SEQ ID NO: 22867 - DNA, 20 bp, Unknown
  RNA secondary structure sequence
gcatatagatttgaggacat

SEQ ID NO: 22868 - DNA, 20 bp, Unknown
  RNA secondary structure sequence
gcgacggatccgttatccgc

SEQ ID NO: 22869 - DNA, 20 bp, Unknown
  RNA secondary structure sequence
catgggacgctagttgtgaa

SEQ ID NO: 22870 - DNA, 20 bp, Unknown
  RNA secondary structure sequence
tccgggtacaccgtgcatgt

SEQ ID NO: 22871 - DNA, 20 bp, Unknown
  RNA secondary structure sequence
atagatgatagtttcaccga

SEQ ID NO: 22872 - DNA, 20 bp, Unknown
  RNA secondary structure sequence
caggggttaggtcagatgct

SEQ ID NO: 22873 - DNA, 20 bp, Unknown
  RNA secondary structure sequence
tctgatacagtgcaaaccag

SEQ ID NO: 22874 - DNA, 20 bp, Unknown
  RNA secondary structure sequence
gtccagttacggaggaaatt

SEQ ID NO: 22875 - DNA, 20 bp, Unknown
  RNA secondary structure sequence
gcatctctaaatgacttcgg

SEQ ID NO: 22876 - DNA, 20 bp, Unknown
  RNA secondary structure sequence
acgcttacacccctctccac

SEQ ID NO: 22877 - DNA, 20 bp, Unknown
  RNA secondary structure sequence
gcccagggcaccgattcaat

SEQ ID NO: 22878 - DNA, 20 bp, Unknown
  RNA secondary structure sequence
cttgggtgtgatgcttcacc

SEQ ID NO: 22879 - DNA, 20 bp, Unknown
  RNA secondary structure sequence
ctggaggagaaaggaatcct

SEQ ID NO: 22880 - DNA, 20 bp, Unknown
  RNA secondary structure sequence
caaggaccagggttcgatta

SEQ ID NO: 22881 - DNA, 20 bp, Unknown
  RNA secondary structure sequence
aaaacaaaggttgagcaggg

SEQ ID NO: 22882 - DNA, 20 bp, Unknown
  RNA secondary structure sequence
gcaggcatgcaaaatcatat

SEQ ID NO: 22883 - DNA, 20 bp, Unknown
  RNA secondary structure sequence
accataaataatggaactcc

SEQ ID NO: 22884 - DNA, 20 bp, Unknown
  RNA secondary structure sequence
caacaaggcactgttgacaa

SEQ ID NO: 22885 - DNA, 20 bp, Unknown
  RNA secondary structure sequence
tttagcaggacggaaagtga

SEQ ID NO: 22886 - DNA, 20 bp, Unknown
  RNA secondary structure sequence
gacggcgtgcatgctgtcct

SEQ ID NO: 22887 - DNA, 20 bp, Unknown
  RNA secondary structure sequence
aatttaagagtgtaactcaa

SEQ ID NO: 22888 - DNA, 20 bp, Unknown
  RNA secondary structure sequence
ccgctgtctcattagttcaa

SEQ ID NO: 22889 - DNA, 20 bp, Unknown
  RNA secondary structure sequence
tgtccctagacggattggat

SEQ ID NO: 22890 - DNA, 20 bp, Unknown
  RNA secondary structure sequence
acctttgcacctgggcctgt

SEQ ID NO: 22891 - DNA, 20 bp, Unknown
  RNA secondary structure sequence
gcagacaagataagagagtc

SEQ ID NO: 22892 - DNA, 20 bp, Unknown
  RNA secondary structure sequence
gccccagaattagttgcttt

SEQ ID NO: 22893 - DNA, 20 bp, Unknown
  RNA secondary structure sequence
ttagttgatgaccttgctct

SEQ ID NO: 22894 - DNA, 20 bp, Unknown
  RNA secondary structure sequence
ttagatttccaaacaataat

SEQ ID NO: 22895 - DNA, 20 bp, Unknown
  RNA secondary structure sequence
ctaccacaaccattcaaccg

SEQ ID NO: 22896 - DNA, 20 bp, Unknown
  RNA secondary structure sequence
atcatcccctttgcgcgtac

SEQ ID NO: 22897 - DNA, 20 bp, Unknown
  RNA secondary structure sequence
tctcctcgtggaggaatcga

SEQ ID NO: 22898 - DNA, 20 bp, Unknown
  RNA secondary structure sequence
gtgagcaagatgtgcttaac

SEQ ID NO: 22899 - DNA, 20 bp, Unknown
  RNA secondary structure sequence
tttgttcatatatctaatga

SEQ ID NO: 22900 - DNA, 20 bp, Unknown
  RNA secondary structure sequence
tgcatcaatctggatgtcat

SEQ ID NO: 22901 - DNA, 20 bp, Unknown
  RNA secondary structure sequence
gatagagttctaaatctagt

SEQ ID NO: 22902 - DNA, 20 bp, Unknown
  RNA secondary structure sequence
ttcaatctaagttcatccga

SEQ ID NO: 22903 - DNA, 20 bp, Unknown
  RNA secondary structure sequence
gagtacattattcacaaggt

SEQ ID NO: 22904 - DNA, 20 bp, Unknown
  RNA secondary structure sequence
gacaatgatatacctgatta

SEQ ID NO: 22905 - DNA, 20 bp, Unknown
  RNA secondary structure sequence
aagtcaccaaaaggttccac

SEQ ID NO: 22906 - DNA, 20 bp, Unknown
  RNA secondary structure sequence
gtgagagttcaatactcacc

SEQ ID NO: 22907 - DNA, 20 bp, Unknown
  RNA secondary structure sequence
agtactggggcttgatcctc

SEQ ID NO: 22908 - DNA, 20 bp, Unknown
  RNA secondary structure sequence
tgaccagaatacagaaaaca

SEQ ID NO: 22909 - DNA, 20 bp, Unknown
  RNA secondary structure sequence
caatagctgactgtaaaaaa

SEQ ID NO: 22910 - DNA, 20 bp, Unknown
  RNA secondary structure sequence
tgctgcattctgatcaagga

SEQ ID NO: 22911 - DNA, 20 bp, Unknown
  RNA secondary structure sequence
ctacaaagtggtacccactt

SEQ ID NO: 22912 - DNA, 20 bp, Unknown
  RNA secondary structure sequence
atgactaagccattgcctct

SEQ ID NO: 22913 - DNA, 20 bp, Unknown
  RNA secondary structure sequence
gacaaggagagggttttggg

SEQ ID NO: 22914 - DNA, 20 bp, Unknown
  RNA secondary structure sequence
tcaactcaagaccaatatat

SEQ ID NO: 22915 - DNA, 20 bp, Unknown
  RNA secondary structure sequence
aaggaagaaacatataggaa

SEQ ID NO: 22916 - DNA, 20 bp, Unknown
  RNA secondary structure sequence
gggacctcatatgatttgga

SEQ ID NO: 22917 - DNA, 20 bp, Unknown
  RNA secondary structure sequence
gaaatagttaaccaagactg

SEQ ID NO: 22918 - DNA, 20 bp, Unknown
  RNA secondary structure sequence
agatttcagattcagctctt

SEQ ID NO: 22919 - DNA, 20 bp, Unknown
  RNA secondary structure sequence
cctcatcataggccactaca

SEQ ID NO: 22920 - DNA, 20 bp, Unknown
  RNA secondary structure sequence
tcgtgaggacccttatgtta

SEQ ID NO: 22921 - DNA, 20 bp, Unknown
  RNA secondary structure sequence
ggttttaagatgcttccgca

SEQ ID NO: 22922 - DNA, 20 bp, Unknown
  RNA secondary structure sequence
tcaggggagacagacctttg

SEQ ID NO: 22923 - DNA, 20 bp, Unknown
  RNA secondary structure sequence
taatatgctatctacagtat

SEQ ID NO: 22924 - DNA, 20 bp, Unknown
  RNA secondary structure sequence
ccacttggggccgaataacc

SEQ ID NO: 22925 - DNA, 20 bp, Unknown
  RNA secondary structure sequence
gtggatttgcaagagcagtg

SEQ ID NO: 22926 - DNA, 20 bp, Unknown
  RNA secondary structure sequence
atttcaaaaccattgaggaa

SEQ ID NO: 22927 - DNA, 20 bp, Unknown
  RNA secondary structure sequence
ccttagctaaggaatgtcta

SEQ ID NO: 22928 - DNA, 20 bp, Unknown
  RNA secondary structure sequence
taataccaatcaccaacaga

SEQ ID NO: 22929 - DNA, 20 bp, Unknown
  RNA secondary structure sequence
ccacacattatgtttctcag

SEQ ID NO: 22930 - DNA, 20 bp, Unknown
  RNA secondary structure sequence
cttttgccggaagcacacta

SEQ ID NO: 22931 - DNA, 20 bp, Unknown
  RNA secondary structure sequence
cacaaacgcatcaaatgccc

SEQ ID NO: 22932 - DNA, 20 bp, Unknown
  RNA secondary structure sequence
cttgataataagagaacctt

SEQ ID NO: 22933 - DNA, 20 bp, Unknown
  RNA secondary structure sequence
catagaatgtgcctgtagag

SEQ ID NO: 22934 - DNA, 20 bp, Unknown
  RNA secondary structure sequence
gcttggaggcatcaaaggag

SEQ ID NO: 22935 - DNA, 20 bp, Unknown
  RNA secondary structure sequence
tatgctttttaaaacccaaa

SEQ ID NO: 22936 - DNA, 20 bp, Unknown
  RNA secondary structure sequence
ggcaataaacagagaggtgt

SEQ ID NO: 22937 - DNA, 20 bp, Unknown
  RNA secondary structure sequence
gaataaagactcacaacaag

SEQ ID NO: 22938 - DNA, 20 bp, Unknown
  RNA secondary structure sequence
aaaccattttagtgtaacat

SEQ ID NO: 22939 - DNA, 20 bp, Unknown
  RNA secondary structure sequence
cttggagatttgggaagagc

SEQ ID NO: 22940 - DNA, 20 bp, Unknown
  RNA secondary structure sequence
aacatagctccatacccctt

SEQ ID NO: 22941 - DNA, 20 bp, Unknown
  RNA secondary structure sequence
cttactgttgtagggttttg

SEQ ID NO: 22942 - DNA, 20 bp, Unknown
  RNA secondary structure sequence
gatggaaaaattgttaatat

SEQ ID NO: 22943 - DNA, 20 bp, Unknown
  RNA secondary structure sequence
ataaccaatgaagtatccat

SEQ ID NO: 22944 - DNA, 20 bp, Unknown
  RNA secondary structure sequence
ttcctaaattactacttgta

SEQ ID NO: 22945 - DNA, 20 bp, Unknown
  RNA secondary structure sequence
atattgggtagttgtagcag

SEQ ID NO: 22946 - DNA, 20 bp, Unknown
  RNA secondary structure sequence
aatccacaaccatttgttaa

SEQ ID NO: 22947 - DNA, 20 bp, Unknown
  RNA secondary structure sequence
ctatatctatttacaataac

SEQ ID NO: 22948 - DNA, 20 bp, Unknown
  RNA secondary structure sequence
atgactacacgagacagtga

SEQ ID NO: 22949 - DNA, 20 bp, Unknown
  RNA secondary structure sequence
ggtcagtttctctcctttgc

SEQ ID NO: 22950 - DNA, 20 bp, Unknown
  RNA secondary structure sequence
ctccatcctcttgcaaggac

SEQ ID NO: 22951 - DNA, 20 bp, Unknown
  RNA secondary structure sequence
catcagaaaaagaacgaaat

SEQ ID NO: 22952 - DNA, 20 bp, Unknown
  RNA secondary structure sequence
aatcctggccatcaagatga

SEQ ID NO: 22953 - DNA, 20 bp, Unknown
  RNA secondary structure sequence
agagatcactctgaaaagaa

SEQ ID NO: 22954 - DNA, 20 bp, Unknown
  RNA secondary structure sequence
tcaaaacgacagaatgccag

SEQ ID NO: 22955 - DNA, 20 bp, Unknown
  RNA secondary structure sequence
agcttgccagaaaagcttgc

SEQ ID NO: 22956 - DNA, 20 bp, Unknown
  RNA secondary structure sequence
tacgttacattaatgataca

SEQ ID NO: 22957 - DNA, 20 bp, Unknown
  RNA secondary structure sequence
gctaatgaagcaaattccaa

SEQ ID NO: 22958 - DNA, 20 bp, Unknown
  RNA secondary structure sequence
tcccctcaggctcctgcgaa

SEQ ID NO: 22959 - DNA, 20 bp, Unknown
  RNA secondary structure sequence
cgaagtgccagaaactctgg

SEQ ID NO: 22960 - DNA, 20 bp, Unknown
  RNA secondary structure sequence
accaaaccaggtccggacaa

SEQ ID NO: 22961 - DNA, 20 bp, Unknown
  RNA secondary structure sequence
ttaatctgtgggttgagaca

SEQ ID NO: 22962 - DNA, 20 bp, Unknown
  RNA secondary structure sequence
aaagttctgctgtcgttgtt

SEQ ID NO: 22963 - DNA, 20 bp, Unknown
  RNA secondary structure sequence
ctccttttagcaaagtacta

SEQ ID NO: 22964 - DNA, 20 bp, Unknown
  RNA secondary structure sequence
aactacgcaactgtaaactc

SEQ ID NO: 22965 - DNA, 20 bp, Unknown
  RNA secondary structure sequence
aacatgccacagttagaggg

SEQ ID NO: 22966 - DNA, 20 bp, Unknown
  RNA secondary structure sequence
gctcagctgtgatgggtgac

SEQ ID NO: 22967 - DNA, 20 bp, Unknown
  RNA secondary structure sequence
gacatatctttccttgcagg

SEQ ID NO: 22968 - DNA, 20 bp, Unknown
  RNA secondary structure sequence
tttggctgaaaccctacgaa

SEQ ID NO: 22969 - DNA, 20 bp, Unknown
  RNA secondary structure sequence
tgaccccttcacattactca

SEQ ID NO: 22970 - DNA, 20 bp, Unknown
  RNA secondary structure sequence
ttatttcagatagcaacaat

SEQ ID NO: 22971 - DNA, 20 bp, Unknown
  RNA secondary structure sequence
gcacaaacaacagtgatggt

SEQ ID NO: 22972 - DNA, 20 bp, Unknown
  RNA secondary structure sequence
gtgctggtgccttactattg

SEQ ID NO: 22973 - DNA, 20 bp, Unknown
  RNA secondary structure sequence
actcagcaagccaaataaca

SEQ ID NO: 22974 - DNA, 20 bp, Unknown
  RNA secondary structure sequence
gagaaaaaggtcaacgataa

SEQ ID NO: 22975 - DNA, 20 bp, Unknown
  RNA secondary structure sequence
agccaaggaagtggctctgt

SEQ ID NO: 22976 - DNA, 20 bp, Unknown
  RNA secondary structure sequence
gtttggaaaaggaggagttg

SEQ ID NO: 22977 - DNA, 20 bp, Unknown
  RNA secondary structure sequence
acatcttaagtgcaaagtcc

SEQ ID NO: 22978 - DNA, 20 bp, Unknown
  RNA secondary structure sequence
aagagatgtaaacaaggaaa

SEQ ID NO: 22979 - DNA, 20 bp, Unknown
  RNA secondary structure sequence
cattggcaagatgtttgagt

SEQ ID NO: 22980 - DNA, 20 bp, Unknown
  RNA secondary structure sequence
tagaatcctaattgggttct

SEQ ID NO: 22981 - DNA, 20 bp, Unknown
  RNA secondary structure sequence
aatagacggaccagacacct

SEQ ID NO: 22982 - DNA, 20 bp, Unknown
  RNA secondary structure sequence
agctgtgcatgctgacatgg

SEQ ID NO: 22983 - DNA, 20 bp, Unknown
  RNA secondary structure sequence
cctgaccttgtttgtggaag

SEQ ID NO: 22984 - DNA, 20 bp, Unknown
  RNA secondary structure sequence
ccacctagccatcatggcag

SEQ ID NO: 22985 - DNA, 20 bp, Unknown
  RNA secondary structure sequence
aaaagccgcactgtctgaag

SEQ ID NO: 22986 - DNA, 20 bp, Unknown
  RNA secondary structure sequence
tgtgaaatcagaacacacag

SEQ ID NO: 22987 - DNA, 20 bp, Unknown
  RNA secondary structure sequence
ggaaatgggagaggcagcag

SEQ ID NO: 22988 - DNA, 20 bp, Unknown
  RNA secondary structure sequence
caacctatctctagcagcca

SEQ ID NO: 22989 - DNA, 20 bp, Unknown
  RNA secondary structure sequence
aataataggcccaggattgc

SEQ ID NO: 22990 - DNA, 20 bp, Unknown
  RNA secondary structure sequence
tccaatggtgactcagttag

SEQ ID NO: 22991 - DNA, 20 bp, Unknown
  RNA secondary structure sequence
gtgcacaagggaagagttca

SEQ ID NO: 22992 - DNA, 20 bp, Unknown
  RNA secondary structure sequence
cgctcatcaccagtggatga

SEQ ID NO: 22993 - DNA, 20 bp, Unknown
  RNA secondary structure sequence
ttgtgccacggtttgagcaa

SEQ ID NO: 22994 - DNA, 20 bp, Unknown
  RNA secondary structure sequence
ttttccaattcaaattacct

SEQ ID NO: 22995 - DNA, 20 bp, Unknown
  RNA secondary structure sequence
aatggtcatacttacgtttg

SEQ ID NO: 22996 - DNA, 20 bp, Unknown
  RNA secondary structure sequence
agtgtggattgctttgttgc

SEQ ID NO: 22997 - DNA, 20 bp, Unknown
  RNA secondary structure sequence
attagtaccggttggtttga

SEQ ID NO: 22998 - DNA, 20 bp, Unknown
  RNA secondary structure sequence
tcagctgttgctgtcgtggg

SEQ ID NO: 22999 - DNA, 20 bp, Unknown
  RNA secondary structure sequence
tatagtaacgagtcttggtt

SEQ ID NO: 23000 - DNA, 20 bp, Unknown
  RNA secondary structure sequence
tttaaaacatatgcttttga

SEQ ID NO: 23001 - DNA, 20 bp, Unknown
  RNA secondary structure sequence
attgaagaagttgaactttt

SEQ ID NO: 23002 - DNA, 20 bp, Unknown
  RNA secondary structure sequence
atttttgacattgagacagt

SEQ ID NO: 23003 - DNA, 20 bp, Unknown
  RNA secondary structure sequence
attgttttgtttactgactc

SEQ ID NO: 23004 - DNA, 20 bp, Unknown
  RNA secondary structure sequence
gttgtgccatccgaaaagga

SEQ ID NO: 23005 - DNA, 20 bp, Unknown
  RNA secondary structure sequence
ccccattttatttcacaagg

SEQ ID NO: 23006 - DNA, 20 bp, Unknown
  RNA secondary structure sequence
attatagtcagtgtcgaaca

SEQ ID NO: 23007 - DNA, 20 bp, Unknown
  RNA secondary structure sequence
ttgtactcagtagttttgct

SEQ ID NO: 23008 - DNA, 20 bp, Unknown
  RNA secondary structure sequence
gttgtgtggaagcatataac

SEQ ID NO: 23009 - DNA, 20 bp, Unknown
  RNA secondary structure sequence
gtgcaacgttcattttatgt

SEQ ID NO: 23010 - DNA, 20 bp, Unknown
  RNA secondary structure sequence
tgttataacacagcgcttat

SEQ ID NO: 23011 - DNA, 20 bp, Unknown
  RNA secondary structure sequence
tgttatgcctatttagcaaa

SEQ ID NO: 23012 - DNA, 20 bp, Unknown
  RNA secondary structure sequence
ggtgcgtgtggttcccctgg

SEQ ID NO: 23013 - DNA, 20 bp, Unknown
  RNA secondary structure sequence
attattgtggctgctattca

SEQ ID NO: 23014 - DNA, 20 bp, Unknown
  RNA secondary structure sequence
tgtacacattggtgcactta

SEQ ID NO: 23015 - DNA, 20 bp, Unknown
  RNA secondary structure sequence
aattcaaaggagtgggcata

SEQ ID NO: 23016 - DNA, 20 bp, Unknown
  RNA secondary structure sequence
gcattcatgtatgcatatgt

SEQ ID NO: 23017 - DNA, 20 bp, Unknown
  RNA secondary structure sequence
agaggtgctgttttgggtta

SEQ ID NO: 23018 - DNA, 20 bp, Unknown
  RNA secondary structure sequence
atgttgactaatggttctgg

SEQ ID NO: 23019 - DNA, 20 bp, Unknown
  RNA secondary structure sequence
gtcaagacttcaaaactttt

SEQ ID NO: 23020 - DNA, 20 bp, Unknown
  RNA secondary structure sequence
atgatcctaaattgatggga

SEQ ID NO: 23021 - DNA, 20 bp, Unknown
  RNA secondary structure sequence
tttttgtggatgacatcact

SEQ ID NO: 23022 - DNA, 20 bp, Unknown
  RNA secondary structure sequence
tggagtctttttctgttaca

SEQ ID NO: 23023 - DNA, 20 bp, Unknown
  RNA secondary structure sequence
gcactaagtgcgcctatgat

SEQ ID NO: 23024 - DNA, 20 bp, Unknown
  RNA secondary structure sequence
atgttagtgatgcttatgca

SEQ ID NO: 23025 - DNA, 20 bp, Unknown
  RNA secondary structure sequence
ctataggacccgatgtcttt

SEQ ID NO: 23026 - DNA, 20 bp, Unknown
  RNA secondary structure sequence
ataggcgtcaacttgatgtt

SEQ ID NO: 23027 - DNA, 20 bp, Unknown
  RNA secondary structure sequence
ctggtagtcatagtttgttc

SEQ ID NO: 23028 - DNA, 20 bp, Unknown
  RNA secondary structure sequence
ctaatgaaaatgccataaac

SEQ ID NO: 23029 - DNA, 20 bp, Unknown
  RNA secondary structure sequence
gttcatttgttggtgctgat

SEQ ID NO: 23030 - DNA, 20 bp, Unknown
  RNA secondary structure sequence
attttgtttctgtattgaag

SEQ ID NO: 23031 - DNA, 20 bp, Unknown
  RNA secondary structure sequence
ctttttggactatgttttgc

SEQ ID NO: 23032 - DNA, 20 bp, Unknown
  RNA secondary structure sequence
tttgttttgcttgttgcata

SEQ ID NO: 23033 - DNA, 20 bp, Unknown
  RNA secondary structure sequence
tcgctacctgtttatcataa

SEQ ID NO: 23034 - DNA, 20 bp, Unknown
  RNA secondary structure sequence
tacgttgctgtttatgccaa

SEQ ID NO: 23035 - DNA, 20 bp, Unknown
  RNA secondary structure sequence
agcgccaggctggagtctgc

SEQ ID NO: 23036 - DNA, 20 bp, Unknown
  RNA secondary structure sequence
agcaaacttgttacttctgg

SEQ ID NO: 23037 - DNA, 20 bp, Unknown
  RNA secondary structure sequence
gatgctattacacaaacttc

SEQ ID NO: 23038 - DNA, 20 bp, Unknown
  RNA secondary structure sequence
aattattatagaatcacatc

SEQ ID NO: 23039 - DNA, 20 bp, Unknown
  RNA secondary structure sequence
ccacatttaccaatcatata

SEQ ID NO: 23040 - DNA, 20 bp, Unknown
  RNA secondary structure sequence
ggacactataaatactccag

SEQ ID NO: 23041 - DNA, 20 bp, Unknown
  RNA secondary structure sequence
atgtacttcgcaaacagttt

SEQ ID NO: 23042 - DNA, 20 bp, Unknown
  RNA secondary structure sequence
tgtgcccaaagaccatccac

SEQ ID NO: 23043 - DNA, 20 bp, Unknown
  RNA secondary structure sequence
acaggtagtgacggaaagct

SEQ ID NO: 23044 - DNA, 20 bp, Unknown
  RNA secondary structure sequence
aagccagataggatcaacaa

SEQ ID NO: 23045 - DNA, 20 bp, Unknown
  RNA secondary structure sequence
aataaaccaccagaatctag

SEQ ID NO: 23046 - DNA, 20 bp, Unknown
  RNA secondary structure sequence
ttgcatgggatctggccgga

SEQ ID NO: 23047 - DNA, 20 bp, Unknown
  RNA secondary structure sequence
ttacgagcgctgagggattt

SEQ ID NO: 23048 - DNA, 20 bp, Unknown
  RNA secondary structure sequence
acatgtgtgaaaggtgaacc

SEQ ID NO: 23049 - DNA, 20 bp, Unknown
  RNA secondary structure sequence
ggcgttgtaatcagcacaga

SEQ ID NO: 23050 - DNA, 20 bp, Unknown
  RNA secondary structure sequence
gtgacctacatagttctaac

SEQ ID NO: 23051 - DNA, 20 bp, Unknown
  RNA secondary structure sequence
caatctggtgaaggggttta

SEQ ID NO: 23052 - DNA, 20 bp, Unknown
  RNA secondary structure sequence
tctgagtatggagttaaaac

SEQ ID NO: 23053 - DNA, 20 bp, Unknown
  RNA secondary structure sequence
gacagtctgatgattacaca

SEQ ID NO: 23054 - DNA, 20 bp, Unknown
  RNA secondary structure sequence
gaggtgactgatagttacga

SEQ ID NO: 23055 - DNA, 20 bp, Unknown
  RNA secondary structure sequence
acggaggggaaggagacaga

SEQ ID NO: 23056 - DNA, 20 bp, Unknown
  RNA secondary structure sequence
gaaccggctttggccactct

SEQ ID NO: 23057 - DNA, 20 bp, Unknown
  RNA secondary structure sequence
gaaataaagccagtgataag

SEQ ID NO: 23058 - DNA, 20 bp, Unknown
  RNA secondary structure sequence
cccttgtttgaagagctcct

SEQ ID NO: 23059 - DNA, 20 bp, Unknown
  RNA secondary structure sequence
ctgaaaaaaggcagaaacat

SEQ ID NO: 23060 - DNA, 20 bp, Unknown
  RNA secondary structure sequence
atacaaaagtactatttcaa

SEQ ID NO: 23061 - DNA, 20 bp, Unknown
  RNA secondary structure sequence
accatagcatatgagaaagc

SEQ ID NO: 23062 - DNA, 20 bp, Unknown
  RNA secondary structure sequence
ctaactcagcaatggctaac

SEQ ID NO: 23063 - DNA, 20 bp, Unknown
  RNA secondary structure sequence
ggactaagttcagatcaagt

SEQ ID NO: 23064 - DNA, 20 bp, Unknown
  RNA secondary structure sequence
agacagtcagttaccttcaa

SEQ ID NO: 23065 - DNA, 20 bp, Unknown
  RNA secondary structure sequence
gatccagcaatcagcaacag

SEQ ID NO: 23066 - DNA, 20 bp, Unknown
  RNA secondary structure sequence
tacctcttacctcatttctt

SEQ ID NO: 23067 - DNA, 20 bp, Unknown
  RNA secondary structure sequence
gtctgatcctgcaaaagact

SEQ ID NO: 23068 - DNA, 20 bp, Unknown
  RNA secondary structure sequence
agcagtgaaggaagaaccac

SEQ ID NO: 23069 - DNA, 20 bp, Unknown
  RNA secondary structure sequence
aagcccggataaaactgaga

SEQ ID NO: 23070 - DNA, 20 bp, Unknown
  RNA secondary structure sequence
tgttcgaggatcacccccct

SEQ ID NO: 23071 - DNA, 20 bp, Unknown
  RNA secondary structure sequence
cttcccgcacgacactgatc

SEQ ID NO: 23072 - DNA, 20 bp, Unknown
  RNA secondary structure sequence
tctaacaacaatctcccaca

SEQ ID NO: 23073 - DNA, 20 bp, Unknown
  RNA secondary structure sequence
ctctgttccctcaaagttac

SEQ ID NO: 23074 - DNA, 20 bp, Unknown
  RNA secondary structure sequence
atcagcaaacggctgtttgc

SEQ ID NO: 23075 - DNA, 20 bp, Unknown
  RNA secondary structure sequence
tcaggcattcggtggaaatt

SEQ ID NO: 23076 - DNA, 20 bp, Unknown
  RNA secondary structure sequence
gatttggtgcatatcattgg

SEQ ID NO: 23077 - DNA, 20 bp, Unknown
  RNA secondary structure sequence
gaatcttatctgcattttca

SEQ ID NO: 23078 - DNA, 20 bp, Unknown
  RNA secondary structure sequence
tacagatcagaagattcggt

SEQ ID NO: 23079 - DNA, 20 bp, Unknown
  RNA secondary structure sequence
tcttgaatatgcccctataa

SEQ ID NO: 23080 - DNA, 20 bp, Unknown
  RNA secondary structure sequence
aagaagattggttgacgttt

SEQ ID NO: 23081 - DNA, 20 bp, Unknown
  RNA secondary structure sequence
gcgtgcatgtcaagtcatag

SEQ ID NO: 23082 - DNA, 20 bp, Unknown
  RNA secondary structure sequence
aatggctatatttgctgaac

SEQ ID NO: 23083 - DNA, 20 bp, Unknown
  RNA secondary structure sequence
aaagaaagagatctgtgcaa

SEQ ID NO: 23084 - DNA, 20 bp, Unknown
  RNA secondary structure sequence
aatgtcaagatgttgctttt

SEQ ID NO: 23085 - DNA, 20 bp, Unknown
  RNA secondary structure sequence
gagaatgattgatcacagta

SEQ ID NO: 23086 - DNA, 20 bp, Unknown
  RNA secondary structure sequence
attgagatctcacatgtgga

SEQ ID NO: 23087 - DNA, 20 bp, Unknown
  RNA secondary structure sequence
attggatcaggtagatagag

SEQ ID NO: 23088 - DNA, 20 bp, Unknown
  RNA secondary structure sequence
tgaggaacttcatgatgtcc

SEQ ID NO: 23089 - DNA, 20 bp, Unknown
  RNA secondary structure sequence
agtttcaggaaatgttgtta

SEQ ID NO: 23090 - DNA, 20 bp, Unknown
  RNA secondary structure sequence
tttagtggcacgtaattatg

SEQ ID NO: 23091 - DNA, 20 bp, Unknown
  RNA secondary structure sequence
aaatttgttagatcagctac

SEQ ID NO: 23092 - DNA, 20 bp, Unknown
  RNA secondary structure sequence
cacattgaaccatgtgaata

SEQ ID NO: 23093 - DNA, 20 bp, Unknown
  RNA secondary structure sequence
tggtatattgtcatttatag

SEQ ID NO: 23094 - DNA, 20 bp, Unknown
  RNA secondary structure sequence
aattctttacgggaagagtc

SEQ ID NO: 23095 - DNA, 20 bp, Unknown
  RNA secondary structure sequence
aaagccaaatcctgagttat

SEQ ID NO: 23096 - DNA, 20 bp, Unknown
  RNA secondary structure sequence
tgcattcagacggcgtttag

SEQ ID NO: 23097 - DNA, 20 bp, Unknown
  RNA secondary structure sequence
atacaagatcactccggaga

SEQ ID NO: 23098 - DNA, 20 bp, Unknown
  RNA secondary structure sequence
catgttcatcccagccagtg

SEQ ID NO: 23099 - DNA, 20 bp, Unknown
  RNA secondary structure sequence
gagcgccgagcgttcagcac

SEQ ID NO: 23100 - DNA, 20 bp, Unknown
  RNA secondary structure sequence
ccatggatgtttccccgttc

SEQ ID NO: 23101 - DNA, 20 bp, Unknown
  RNA secondary structure sequence
gaattctcagattttatcac

SEQ ID NO: 23102 - DNA, 20 bp, Unknown
  RNA secondary structure sequence
tactctcatcaactgtgtat

SEQ ID NO: 23103 - DNA, 20 bp, Unknown
  RNA secondary structure sequence
ggagtggtttgctatttagc

SEQ ID NO: 23104 - DNA, 20 bp, Unknown
  RNA secondary structure sequence
ctaattccaggaggtagtgt

SEQ ID NO: 23105 - DNA, 20 bp, Unknown
  RNA secondary structure sequence
tctgtgacatcttcagtata

SEQ ID NO: 23106 - DNA, 20 bp, Unknown
  RNA secondary structure sequence
aacaatgccattgatcccac

SEQ ID NO: 23107 - DNA, 20 bp, Unknown
  RNA secondary structure sequence
caaccaatagaaagtatcct

SEQ ID NO: 23108 - DNA, 20 bp, Unknown
  RNA secondary structure sequence
acggtcgcattgcaattcgt

SEQ ID NO: 23109 - DNA, 20 bp, Unknown
  RNA secondary structure sequence
gacacatctacaatgttgac

SEQ ID NO: 23110 - DNA, 20 bp, Unknown
  RNA secondary structure sequence
agcttgccttattatagtcc

SEQ ID NO: 23111 - DNA, 20 bp, Unknown
  RNA secondary structure sequence
tttggacctgccgaattggc

SEQ ID NO: 23112 - DNA, 20 bp, Unknown
  RNA secondary structure sequence
tttgagccccaacgccttgg

SEQ ID NO: 23113 - DNA, 20 bp, Unknown
  RNA secondary structure sequence
tgccaatcggagggcgacag

SEQ ID NO: 23114 - DNA, 20 bp, Unknown
  RNA secondary structure sequence
ctaggggctaaggatgtcct

SEQ ID NO: 23115 - DNA, 20 bp, Unknown
  RNA secondary structure sequence
gacaatggcaggcaacatgg

SEQ ID NO: 23116 - DNA, 20 bp, Unknown
  RNA secondary structure sequence
agtcaaaatggcttcttcat

SEQ ID NO: 23117 - DNA, 20 bp, Unknown
  RNA secondary structure sequence
caattctggtacaatcgtga

SEQ ID NO: 23118 - DNA, 20 bp, Unknown
  RNA secondary structure sequence
tctctacccacaccagtttc

SEQ ID NO: 23119 - DNA, 20 bp, Unknown
  RNA secondary structure sequence
aaccatgaccataaccccca

SEQ ID NO: 23120 - DNA, 20 bp, Unknown
  RNA secondary structure sequence
gtttactgactttttgcagg

SEQ ID NO: 23121 - DNA, 20 bp, Unknown
  RNA secondary structure sequence
tttggctctcaattacaccc

SEQ ID NO: 23122 - DNA, 20 bp, Unknown
  RNA secondary structure sequence
ttctagctttaaatttgtta

SEQ ID NO: 23123 - DNA, 20 bp, Unknown
  RNA secondary structure sequence
gaacgcccgccccttgacgc

SEQ ID NO: 23124 - DNA, 20 bp, Unknown
  RNA secondary structure sequence
cgaatccaacccagggccta

SEQ ID NO: 23125 - DNA, 20 bp, Unknown
  RNA secondary structure sequence
ggacggtgaaccagaagttc

SEQ ID NO: 23126 - DNA, 20 bp, Unknown
  RNA secondary structure sequence
agacgaacagtataagacag

SEQ ID NO: 23127 - DNA, 20 bp, Unknown
  RNA secondary structure sequence
tttttctcttgtgatttatt

SEQ ID NO: 23128 - DNA, 20 bp, Unknown
  RNA secondary structure sequence
agtggatgtgattgatcaat

SEQ ID NO: 23129 - DNA, 20 bp, Unknown
  RNA secondary structure sequence
tcacggtacttacattggat

SEQ ID NO: 23130 - DNA, 20 bp, Unknown
  RNA secondary structure sequence
caatggacccatttcagagt

SEQ ID NO: 23131 - DNA, 20 bp, Unknown
  RNA secondary structure sequence
caactacgaggaaggtgacc

SEQ ID NO: 23132 - DNA, 20 bp, Unknown
  RNA secondary structure sequence
aaggctcttccgcccgtttg

SEQ ID NO: 23133 - DNA, 20 bp, Unknown
  RNA secondary structure sequence
ccgttaccctaaaattccct

SEQ ID NO: 23134 - DNA, 20 bp, Unknown
  RNA secondary structure sequence
acattcctgatacccttaat

SEQ ID NO: 23135 - DNA, 20 bp, Unknown
  RNA secondary structure sequence
tggtgggagacattggcaag

SEQ ID NO: 23136 - DNA, 20 bp, Unknown
  RNA secondary structure sequence
caaggaaacagcagggagct

SEQ ID NO: 23137 - DNA, 20 bp, Unknown
  RNA secondary structure sequence
tcaacccccccataccgcaa

SEQ ID NO: 23138 - DNA, 20 bp, Unknown
  RNA secondary structure sequence
ccaaaacccgccaaaaacga

SEQ ID NO: 23139 - DNA, 20 bp, Unknown
  RNA secondary structure sequence
atctgcttctgcatgatgca

SEQ ID NO: 23140 - DNA, 20 bp, Unknown
  RNA secondary structure sequence
cctatgtaatccgttatcac

SEQ ID NO: 23141 - DNA, 20 bp, Unknown
  RNA secondary structure sequence
ttgaaaggctctctatctta

SEQ ID NO: 23142 - DNA, 20 bp, Unknown
  RNA secondary structure sequence
aagcccccttcacaataatg

SEQ ID NO: 23143 - DNA, 20 bp, Unknown
  RNA secondary structure sequence
agttatcacccctgaacttg

SEQ ID NO: 23144 - DNA, 20 bp, Unknown
  RNA secondary structure sequence
aaaagcccttgataaggatg

SEQ ID NO: 23145 - DNA, 20 bp, Unknown
  RNA secondary structure sequence
tcctatgcccaatccattta

SEQ ID NO: 23146 - DNA, 20 bp, Unknown
  RNA secondary structure sequence
gaggttaattaaatgtggtg

SEQ ID NO: 23147 - DNA, 20 bp, Unknown
  RNA secondary structure sequence
atcttgttgtgttagaagtg

SEQ ID NO: 23148 - DNA, 20 bp, Unknown
  RNA secondary structure sequence
actaggagtgtcatccacag

SEQ ID NO: 23149 - DNA, 20 bp, Unknown
  RNA secondary structure sequence
tagtggagagaatcctccac

SEQ ID NO: 23150 - DNA, 20 bp, Unknown
  RNA secondary structure sequence
agttgcattcataatacata

SEQ ID NO: 23151 - DNA, 20 bp, Unknown
  RNA secondary structure sequence
tactcttcacaatgacggat

SEQ ID NO: 23152 - DNA, 20 bp, Unknown
  RNA secondary structure sequence
ggaggaagaactaggtgtga

SEQ ID NO: 23153 - DNA, 20 bp, Unknown
  RNA secondary structure sequence
caagaactggacaaatgaca

SEQ ID NO: 23154 - DNA, 20 bp, Unknown
  RNA secondary structure sequence
ggcaaacaataaacgagaca

SEQ ID NO: 23155 - DNA, 20 bp, Unknown
  RNA secondary structure sequence
tacaagcccacagaaattgg

SEQ ID NO: 23156 - DNA, 20 bp, Unknown
  RNA secondary structure sequence
attaccaacccaagtccaga

SEQ ID NO: 23157 - DNA, 20 bp, Unknown
  RNA secondary structure sequence
catggtagattcgatccatg

SEQ ID NO: 23158 - DNA, 20 bp, Unknown
  RNA secondary structure sequence
ggatgtaaatccacatatga

SEQ ID NO: 23159 - DNA, 20 bp, Unknown
  RNA secondary structure sequence
cccattagctctaaatcgta

SEQ ID NO: 23160 - DNA, 20 bp, Unknown
  RNA secondary structure sequence
atctgccacaaatttcctag

SEQ ID NO: 23161 - DNA, 20 bp, Unknown
  RNA secondary structure sequence
cagacaagaagtaatatcaa

SEQ ID NO: 23162 - DNA, 20 bp, Unknown
  RNA secondary structure sequence
ttcatcaaacttaatcactc

SEQ ID NO: 23163 - DNA, 20 bp, Unknown
  RNA secondary structure sequence
aaggggttatcagttatgct

SEQ ID NO: 23164 - DNA, 20 bp, Unknown
  RNA secondary structure sequence
tgtaggaagtgggataaaaa

SEQ ID NO: 23165 - DNA, 20 bp, Unknown
  RNA secondary structure sequence
tggtgaggatgtatataata

SEQ ID NO: 23166 - DNA, 20 bp, Unknown
  RNA secondary structure sequence
ttcaaatgggtattgggatg

SEQ ID NO: 23167 - DNA, 20 bp, Unknown
  RNA secondary structure sequence
tgccatacgtatcccttatt

SEQ ID NO: 23168 - DNA, 20 bp, Unknown
  RNA secondary structure sequence
cttgtgtagtttggcagaga

SEQ ID NO: 23169 - DNA, 20 bp, Unknown
  RNA secondary structure sequence
agtattaagagatacaatct

SEQ ID NO: 23170 - DNA, 20 bp, Unknown
  RNA secondary structure sequence
ggatggaccatgggtgtgat

SEQ ID NO: 23171 - DNA, 20 bp, Unknown
  RNA secondary structure sequence
ctaccatcatttgcaaccaa

SEQ ID NO: 23172 - DNA, 20 bp, Unknown
  RNA secondary structure sequence
atggccagcaaagaattctg

SEQ ID NO: 23173 - DNA, 20 bp, Unknown
  RNA secondary structure sequence
agtattgtgggctgcgctaa

SEQ ID NO: 23174 - DNA, 20 bp, Unknown
  RNA secondary structure sequence
caaggaactctgatcactac

SEQ ID NO: 23175 - DNA, 20 bp, Unknown
  RNA secondary structure sequence
cataaaacaattgtcgttgg

SEQ ID NO: 23176 - DNA, 20 bp, Unknown
  RNA secondary structure sequence
ccagatgatccagagacatt

SEQ ID NO: 23177 - DNA, 20 bp, Unknown
  RNA secondary structure sequence
ccccttaaattcaccatgga

SEQ ID NO: 23178 - DNA, 20 bp, Unknown
  RNA secondary structure sequence
atgctgcttggccttatgtt

SEQ ID NO: 23179 - DNA, 20 bp, Unknown
  RNA secondary structure sequence
gtgggaatgatagcaacaga

SEQ ID NO: 23180 - DNA, 20 bp, Unknown
  RNA secondary structure sequence
agaattacagcagcctccat

SEQ ID NO: 23181 - DNA, 20 bp, Unknown
  RNA secondary structure sequence
atggcaaaagtccttagagg

SEQ ID NO: 23182 - DNA, 20 bp, Unknown
  RNA secondary structure sequence
ttgaagcctgttgagaaagg

SEQ ID NO: 23183 - DNA, 20 bp, Unknown
  RNA secondary structure sequence
aaagtggcttcagatggcaa

SEQ ID NO: 23184 - DNA, 20 bp, Unknown
  RNA secondary structure sequence
cttcttactgtgatgcaagc

SEQ ID NO: 23185 - DNA, 20 bp, Unknown
  RNA secondary structure sequence
aaactggacacattgaatgg

SEQ ID NO: 23186 - DNA, 20 bp, Unknown
  RNA secondary structure sequence
gaaccatgggcaatgcttga

SEQ ID NO: 23187 - DNA, 20 bp, Unknown
  RNA secondary structure sequence
catgcggtctccagaggaac

SEQ ID NO: 23188 - DNA, 20 bp, Unknown
  RNA secondary structure sequence
atcaaggctgagaaatcagg

SEQ ID NO: 23189 - DNA, 20 bp, Unknown
  RNA secondary structure sequence
ttcatccaaaaagtaagatc

SEQ ID NO: 23190 - DNA, 20 bp, Unknown
  RNA secondary structure sequence
gcaacttttgaggacttcgg

SEQ ID NO: 23191 - DNA, 20 bp, Unknown
  RNA secondary structure sequence
ggctgtctagccaaggcgta

SEQ ID NO: 23192 - DNA, 20 bp, Unknown
  RNA secondary structure sequence
cctctgcattcttgtaaata

SEQ ID NO: 23193 - DNA, 20 bp, Unknown
  RNA secondary structure sequence
tcctccggactctgctaaac

SEQ ID NO: 23194 - DNA, 20 bp, Unknown
  RNA secondary structure sequence
acaggctaaaacgatcgctg

SEQ ID NO: 23195 - DNA, 20 bp, Unknown
  RNA secondary structure sequence
gcttcagtgatagaggctgg

SEQ ID NO: 23196 - DNA, 20 bp, Unknown
  RNA secondary structure sequence
ctagtaactcttaccatctc

SEQ ID NO: 23197 - DNA, 20 bp, Unknown
  RNA secondary structure sequence
actggtttctggaagatcag

SEQ ID NO: 23198 - DNA, 20 bp, Unknown
  RNA secondary structure sequence
ccacccaaggaggggtaaca

SEQ ID NO: 23199 - DNA, 20 bp, Unknown
  RNA secondary structure sequence
gagttctctctgtgatgttg

SEQ ID NO: 23200 - DNA, 20 bp, Unknown
  RNA secondary structure sequence
ttttggattccttgggcttt

SEQ ID NO: 23201 - DNA, 20 bp, Unknown
  RNA secondary structure sequence
gagcagccatttgcaaaaat

SEQ ID NO: 23202 - DNA, 20 bp, Unknown
  RNA secondary structure sequence
acatctgtgggaggaaaatc

SEQ ID NO: 23203 - DNA, 20 bp, Unknown
  RNA secondary structure sequence
cacaaccaaagacacttgaa

SEQ ID NO: 23204 - DNA, 20 bp, Unknown
  RNA secondary structure sequence
agatggaaagtgctctcaaa

SEQ ID NO: 23205 - DNA, 20 bp, Unknown
  RNA secondary structure sequence
gttatgaatggataacagac

SEQ ID NO: 23206 - DNA, 20 bp, Unknown
  RNA secondary structure sequence
tactcaccactgacatttcg

SEQ ID NO: 23207 - DNA, 20 bp, Unknown
  RNA secondary structure sequence
cagtggttagtggattaaca

SEQ ID NO: 23208 - DNA, 20 bp, Unknown
  RNA secondary structure sequence
gccgcggcggctggagctac

SEQ ID NO: 23209 - DNA, 20 bp, Unknown
  RNA secondary structure sequence
ccaggttttggaatatggtg

SEQ ID NO: 23210 - DNA, 20 bp, Unknown
  RNA secondary structure sequence
tggtaaacgcatgtgatgaa

SEQ ID NO: 23211 - DNA, 20 bp, Unknown
  RNA secondary structure sequence
tggtcgtcccctgcaggagt

SEQ ID NO: 23212 - DNA, 20 bp, Unknown
  RNA secondary structure sequence
ccagaggacaagacatgtgt

SEQ ID NO: 23213 - DNA, 20 bp, Unknown
  RNA secondary structure sequence
gagcaacttgggccaaactc

SEQ ID NO: 23214 - DNA, 20 bp, Unknown
  RNA secondary structure sequence
gtaagaggaacaccaggacc

SEQ ID NO: 23215 - DNA, 20 bp, Unknown
  RNA secondary structure sequence
tgctctatggatttgggaac

SEQ ID NO: 23216 - DNA, 20 bp, Unknown
  RNA secondary structure sequence
tgtgtaagcgaggtttcagt

SEQ ID NO: 23217 - DNA, 20 bp, Unknown
  RNA secondary structure sequence
atgaaatctccaagtccaac

SEQ ID NO: 23218 - DNA, 20 bp, Unknown
  RNA secondary structure sequence
agtacacaggtgaaggagcc

SEQ ID NO: 23219 - DNA, 20 bp, Unknown
  RNA secondary structure sequence
agctgacttgtggggatgga

SEQ ID NO: 23220 - DNA, 20 bp, Unknown
  RNA secondary structure sequence
ggaagccatggggtattatg

SEQ ID NO: 23221 - DNA, 20 bp, Unknown
  RNA secondary structure sequence
tgggggctgctgtggccaag

SEQ ID NO: 23222 - DNA, 20 bp, Unknown
  RNA secondary structure sequence
tagaagtcaagaagttgagc

SEQ ID NO: 23223 - DNA, 20 bp, Unknown
  RNA secondary structure sequence
aaaccgaacctgaagtgctg

SEQ ID NO: 23224 - DNA, 20 bp, Unknown
  RNA secondary structure sequence
agatggagcaggcactcaga

SEQ ID NO: 23225 - DNA, 20 bp, Unknown
  RNA secondary structure sequence
cagacccctctagcattgcg

SEQ ID NO: 23226 - DNA, 20 bp, Unknown
  RNA secondary structure sequence
gacgtcaagctgagtacgtc

SEQ ID NO: 23227 - DNA, 20 bp, Unknown
  RNA secondary structure sequence
taactgctggctcagcggtt

SEQ ID NO: 23228 - DNA, 20 bp, Unknown
  RNA secondary structure sequence
ccgctgttgtcgctaatgaa

SEQ ID NO: 23229 - DNA, 20 bp, Unknown
  RNA secondary structure sequence
acgaaattgacagagccgaa

SEQ ID NO: 23230 - DNA, 20 bp, Unknown
  RNA secondary structure sequence
atcatgttgtcaagcttctg

SEQ ID NO: 23231 - DNA, 20 bp, Unknown
  RNA secondary structure sequence
ttggcaaagctctgacatgg

SEQ ID NO: 23232 - DNA, 20 bp, Unknown
  RNA secondary structure sequence
atgaattggttggacggtca

SEQ ID NO: 23233 - DNA, 20 bp, Unknown
  RNA secondary structure sequence
gagcgcagtgggcaaaacta

SEQ ID NO: 23234 - DNA, 20 bp, Unknown
  RNA secondary structure sequence
gtcaccaaatatagatttgg

SEQ ID NO: 23235 - DNA, 20 bp, Unknown
  RNA secondary structure sequence
tttgcgtcttgatatgctgt

SEQ ID NO: 23236 - DNA, 20 bp, Unknown
  RNA secondary structure sequence
aaggacttgcccagaaaagg

SEQ ID NO: 23237 - DNA, 20 bp, Unknown
  RNA secondary structure sequence
ggtagaaccactggcagtga

SEQ ID NO: 23238 - DNA, 20 bp, Unknown
  RNA secondary structure sequence
aggagcttacacggaatatg

SEQ ID NO: 23239 - DNA, 20 bp, Unknown
  RNA secondary structure sequence
ttcaacatagaaccctggat

SEQ ID NO: 23240 - DNA, 20 bp, Unknown
  RNA secondary structure sequence
aacttctccttcgcaggtac

SEQ ID NO: 23241 - DNA, 20 bp, Unknown
  RNA secondary structure sequence
ctggtacttagggcattgag

SEQ ID NO: 23242 - DNA, 20 bp, Unknown
  RNA secondary structure sequence
gcactggcaaggagtaaaag

SEQ ID NO: 23243 - DNA, 20 bp, Unknown
  RNA secondary structure sequence
aagatacactggcgggcctt

SEQ ID NO: 23244 - DNA, 20 bp, Unknown
  RNA secondary structure sequence
caactagtctgccccatagg

SEQ ID NO: 23245 - DNA, 20 bp, Unknown
  RNA secondary structure sequence
aacagggaaggtgttgaaat

SEQ ID NO: 23246 - DNA, 20 bp, Unknown
  RNA secondary structure sequence
atctgtctataccactgctt

SEQ ID NO: 23247 - DNA, 20 bp, Unknown
  RNA secondary structure sequence
cccatgctcatccctttagt

SEQ ID NO: 23248 - DNA, 20 bp, Unknown
  RNA secondary structure sequence
gcagcagtgttccttataag

SEQ ID NO: 23249 - DNA, 20 bp, Unknown
  RNA secondary structure sequence
ctagcggactttgaagagag

SEQ ID NO: 23250 - DNA, 20 bp, Unknown
  RNA secondary structure sequence
gacttttgggcagagtcaag

SEQ ID NO: 23251 - DNA, 20 bp, Unknown
  RNA secondary structure sequence
aagaagatcacaagtcatga

SEQ ID NO: 23252 - DNA, 20 bp, Unknown
  RNA secondary structure sequence
aaggtagggaagaatgaagg

SEQ ID NO: 23253 - DNA, 20 bp, Unknown
  RNA secondary structure sequence
tcctatggatacttctgcca

SEQ ID NO: 23254 - DNA, 20 bp, Unknown
  RNA secondary structure sequence
gtcgagacagcaaagaaatt

SEQ ID NO: 23255 - DNA, 20 bp, Unknown
  RNA secondary structure sequence
taccattatgatctgctaca

SEQ ID NO: 23256 - DNA, 20 bp, Unknown
  RNA secondary structure sequence
tacatctatgccacggaaga

SEQ ID NO: 23257 - DNA, 20 bp, Unknown
  RNA secondary structure sequence
gcactatccaaaagacacat

SEQ ID NO: 23258 - DNA, 20 bp, Unknown
  RNA secondary structure sequence
actataaaaccgtgtttagg

SEQ ID NO: 23259 - DNA, 20 bp, Unknown
  RNA secondary structure sequence
gctacggatgacacaaagat

SEQ ID NO: 23260 - DNA, 20 bp, Unknown
  RNA secondary structure sequence
gttgtgagggcccaaacaga

SEQ ID NO: 23261 - DNA, 20 bp, Unknown
  RNA secondary structure sequence
gtgaagaaagaatgggatca

SEQ ID NO: 23262 - DNA, 20 bp, Unknown
  RNA secondary structure sequence
cccgtaagatgggctgacca

SEQ ID NO: 23263 - DNA, 20 bp, Unknown
  RNA secondary structure sequence
ctaagtatcactaagagacc

SEQ ID NO: 23264 - DNA, 20 bp, Unknown
  RNA secondary structure sequence
actttatgtaaatgcaaggc

SEQ ID NO: 23265 - DNA, 20 bp, Unknown
  RNA secondary structure sequence
caagtagagtagttagagtt

SEQ ID NO: 23266 - DNA, 20 bp, Unknown
  RNA secondary structure sequence
tgagatgctacgtggacgag

SEQ ID NO: 23267 - DNA, 20 bp, Unknown
  RNA secondary structure sequence
cctggctagggaagcaattg

SEQ ID NO: 23268 - DNA, 20 bp, Unknown
  RNA secondary structure sequence
tactaagggccataagggac

SEQ ID NO: 23269 - DNA, 20 bp, Unknown
  RNA secondary structure sequence
ggacgtgcatgagaggtgaa

SEQ ID NO: 23270 - DNA, 20 bp, Unknown
  RNA secondary structure sequence
gtggagtcgtgatcagcaaa

SEQ ID NO: 23271 - DNA, 20 bp, Unknown
  RNA secondary structure sequence
tggttgtctacatgatcctg

SEQ ID NO: 23272 - DNA, 20 bp, Unknown
  RNA secondary structure sequence
tctttcatgctatgaccaac

SEQ ID NO: 23273 - DNA, 20 bp, Unknown
  RNA secondary structure sequence
ccacataccctttgataata

SEQ ID NO: 23274 - DNA, 20 bp, Unknown
  RNA secondary structure sequence
aagccgtatatctgttcccc

SEQ ID NO: 23275 - DNA, 20 bp, Unknown
  RNA secondary structure sequence
atgaggaagaggtctatggg

SEQ ID NO: 23276 - DNA, 20 bp, Unknown
  RNA secondary structure sequence
gagtgaaaacggactcaggt

SEQ ID NO: 23277 - DNA, 20 bp, Unknown
  RNA secondary structure sequence
gaggggagtttaagcagatc

SEQ ID NO: 23278 - DNA, 20 bp, Unknown
  RNA secondary structure sequence
taggaaaaattcacaggttt

SEQ ID NO: 23279 - DNA, 20 bp, Unknown
  RNA secondary structure sequence
tgatcacgcaactagaaatc

SEQ ID NO: 23280 - DNA, 20 bp, Unknown
  RNA secondary structure sequence
acagctatgacagctattcg

SEQ ID NO: 23281 - DNA, 20 bp, Unknown
  RNA secondary structure sequence
aagaaactgagctaaaagaa

SEQ ID NO: 23282 - DNA, 20 bp, Unknown
  RNA secondary structure sequence
ctgcaaccgacttagttgta

SEQ ID NO: 23283 - DNA, 20 bp, Unknown
  RNA secondary structure sequence
ttgcttgtctgccctacgct

SEQ ID NO: 23284 - DNA, 20 bp, Unknown
  RNA secondary structure sequence
gagtcgtcaccaggtgcaga

SEQ ID NO: 23285 - DNA, 20 bp, Unknown
  RNA secondary structure sequence
gggatgaacccaaccacaaa

SEQ ID NO: 23286 - DNA, 20 bp, Unknown
  RNA secondary structure sequence
tcccggaacgaactgtaaca

SEQ ID NO: 23287 - DNA, 20 bp, Unknown
  RNA secondary structure sequence
ccaaaaatatgaccaccggg

SEQ ID NO: 23288 - DNA, 20 bp, Unknown
  RNA secondary structure sequence
tggtgataggttccaataag

SEQ ID NO: 23289 - DNA, 20 bp, Unknown
  RNA secondary structure sequence
aagaacttctgctacagtgc

SEQ ID NO: 23290 - DNA, 20 bp, Unknown
  RNA secondary structure sequence
agcttatagaagagtacaac

SEQ ID NO: 23291 - DNA, 20 bp, Unknown
  RNA secondary structure sequence
gaagacctatcaagtattac

SEQ ID NO: 23292 - DNA, 20 bp, Unknown
  RNA secondary structure sequence
caggaaaggtctacttgcaa

SEQ ID NO: 23293 - DNA, 20 bp, Unknown
  RNA secondary structure sequence
tcgtgctgtcgcgcatgctg

SEQ ID NO: 23294 - DNA, 20 bp, Unknown
  RNA secondary structure sequence
acatgggagagtggtgtgaa

SEQ ID NO: 23295 - DNA, 20 bp, Unknown
  RNA secondary structure sequence
tcctcttggcgttgagtcta

SEQ ID NO: 23296 - DNA, 20 bp, Unknown
  RNA secondary structure sequence
acatttttcaggaaagcccg

SEQ ID NO: 23297 - DNA, 20 bp, Unknown
  RNA secondary structure sequence
ttggattcatccctaagatg

SEQ ID NO: 23298 - DNA, 20 bp, Unknown
  RNA secondary structure sequence
gctgtggagaagggcttgtt

SEQ ID NO: 23299 - DNA, 20 bp, Unknown
  RNA secondary structure sequence
ctccggaactcaacttggtg

SEQ ID NO: 23300 - DNA, 20 bp, Unknown
  RNA secondary structure sequence
ccgtgaagaatggaaaagcc

SEQ ID NO: 23301 - DNA, 20 bp, Unknown
  RNA secondary structure sequence
tccacttggaattgggacca

SEQ ID NO: 23302 - DNA, 20 bp, Unknown
  RNA secondary structure sequence
gtgaggtaagcttgaaggtc

SEQ ID NO: 23303 - DNA, 20 bp, Unknown
  RNA secondary structure sequence
aatgccagccaggaaagctg

SEQ ID NO: 23304 - DNA, 20 bp, Unknown
  RNA secondary structure sequence
aggtggccataatggatgag

SEQ ID NO: 23305 - DNA, 20 bp, Unknown
  RNA secondary structure sequence
aacccattcccgaaggagag

SEQ ID NO: 23306 - DNA, 20 bp, Unknown
  RNA secondary structure sequence
aacgcagagggcgagttgga

SEQ ID NO: 23307 - DNA, 20 bp, Unknown
  RNA secondary structure sequence
atggtccaggcggcgaactg

SEQ ID NO: 23308 - DNA, 20 bp, Unknown
  RNA secondary structure sequence
gagaggataaccgactggcc

SEQ ID NO: 23309 - DNA, 20 bp, Unknown
  RNA secondary structure sequence
ctgcccgatcctggggaact

SEQ ID NO: 23310 - DNA, 20 bp, Unknown
  RNA secondary structure sequence
tggcactcggtgtgacctct

SEQ ID NO: 23311 - DNA, 20 bp, Unknown
  RNA secondary structure sequence
agatcatcaaccccattccg

SEQ ID NO: 23312 - DNA, 20 bp, Unknown
  RNA secondary structure sequence
actcatgcaccaaagaagaa

SEQ ID NO: 23313 - DNA, 20 bp, Unknown
  RNA secondary structure sequence
ggagagaccagaggggatca

SEQ ID NO: 23314 - DNA, 20 bp, Unknown
  RNA secondary structure sequence
gagaccttcgcacccttggt

SEQ ID NO: 23315 - DNA, 20 bp, Unknown
  RNA secondary structure sequence
cccccgagcataactcggga

SEQ ID NO: 23316 - DNA, 20 bp, Unknown
  RNA secondary structure sequence
gggatttttccgcctcctat

SEQ ID NO: 23317 - DNA, 20 bp, Unknown
  RNA secondary structure sequence
ttgcgggtccaaatgccaaa

SEQ ID NO: 23318 - DNA, 20 bp, Unknown
  RNA secondary structure sequence
gtaggcctgcaccgccgagg

SEQ ID NO: 23319 - DNA, 20 bp, Unknown
  RNA secondary structure sequence
ggcacttgtgtcattcttgc

SEQ ID NO: 23320 - DNA, 20 bp, Unknown
  RNA secondary structure sequence
tccaggcgctccgtgctgat

SEQ ID NO: 23321 - DNA, 20 bp, Unknown
  RNA secondary structure sequence
gacctgaaccatcagtggtt

SEQ ID NO: 23322 - DNA, 20 bp, Unknown
  RNA secondary structure sequence
gacacagagcgaatggagct

SEQ ID NO: 23323 - DNA, 20 bp, Unknown
  RNA secondary structure sequence
atggccatgtggagaagctc

SEQ ID NO: 23324 - DNA, 20 bp, Unknown
  RNA secondary structure sequence
gcgtcggtgagaagcactac

SEQ ID NO: 23325 - DNA, 20 bp, Unknown
  RNA secondary structure sequence
gtagcagtcggtctggtgtt

SEQ ID NO: 23326 - DNA, 20 bp, Unknown
  RNA secondary structure sequence
ggcattccagtgaagggtct

SEQ ID NO: 23327 - DNA, 20 bp, Unknown
  RNA secondary structure sequence
accatttcggagatgcttgg

SEQ ID NO: 23328 - DNA, 20 bp, Unknown
  RNA secondary structure sequence
gtgctacacaccatgtggca

SEQ ID NO: 23329 - DNA, 20 bp, Unknown
  RNA secondary structure sequence
gtcagcagcatagcacaggg

SEQ ID NO: 23330 - DNA, 20 bp, Unknown
  RNA secondary structure sequence
gggagacaaaactgggaggt

SEQ ID NO: 23331 - DNA, 20 bp, Unknown
  RNA secondary structure sequence
atagccagtgaggagagaca

SEQ ID NO: 23332 - DNA, 20 bp, Unknown
  RNA secondary structure sequence
tttgacaaggagtactcaag

SEQ ID NO: 23333 - DNA, 20 bp, Unknown
  RNA secondary structure sequence
accgcgtctgctgcacagcg

SEQ ID NO: 23334 - DNA, 20 bp, Unknown
  RNA secondary structure sequence
ctgggagttgtctggtgttt

SEQ ID NO: 23335 - DNA, 20 bp, Unknown
  RNA secondary structure sequence
aatttggacatccagccggc

SEQ ID NO: 23336 - DNA, 20 bp, Unknown
  RNA secondary structure sequence
atgcagttgctgagacctga

SEQ ID NO: 23337 - DNA, 20 bp, Unknown
  RNA secondary structure sequence
gcaggcatggatgtgttctc

SEQ ID NO: 23338 - DNA, 20 bp, Unknown
  RNA secondary structure sequence
gctccttatcgtcccgaggt

SEQ ID NO: 23339 - DNA, 20 bp, Unknown
  RNA secondary structure sequence
agctacttccacaggaggga

SEQ ID NO: 23340 - DNA, 20 bp, Unknown
  RNA secondary structure sequence
caacacacaagaaaaatggt

SEQ ID NO: 23341 - DNA, 20 bp, Unknown
  RNA secondary structure sequence
caggccacgaagggtatttg

SEQ ID NO: 23342 - DNA, 20 bp, Unknown
  RNA secondary structure sequence
acccctgtaagtagttgatc

SEQ ID NO: 23343 - DNA, 20 bp, Unknown
  RNA secondary structure sequence
gaaaagttttgaaacttttc

SEQ ID NO: 23344 - DNA, 20 bp, Unknown
  RNA secondary structure sequence
ccgcagagaacttgcaatcg

SEQ ID NO: 23345 - DNA, 20 bp, Unknown
  RNA secondary structure sequence
taacaatagaaccatcggaa

SEQ ID NO: 23346 - DNA, 20 bp, Unknown
  RNA secondary structure sequence
agcaaagtgtttttaacgcc

SEQ ID NO: 23347 - DNA, 20 bp, Unknown
  RNA secondary structure sequence
ttgaaacagcgtgtgaagga

SEQ ID NO: 23348 - DNA, 20 bp, Unknown
  RNA secondary structure sequence
gtatttttgtaaatatagct

SEQ ID NO: 23349 - DNA, 20 bp, Unknown
  RNA secondary structure sequence
atagtccattagtaagtaag

SEQ ID NO: 23350 - DNA, 20 bp, Unknown
  RNA secondary structure sequence
cctccccaactaccatttgg

SEQ ID NO: 23351 - DNA, 20 bp, Unknown
  RNA secondary structure sequence
tcaatgaagggtgggtaggc

SEQ ID NO: 23352 - DNA, 20 bp, Unknown
  RNA secondary structure sequence
caaccctaagtgtaatagcg

SEQ ID NO: 23353 - DNA, 20 bp, Unknown
  RNA secondary structure sequence
tgcgtataactctggtatca

SEQ ID NO: 23354 - DNA, 20 bp, Unknown
  RNA secondary structure sequence
ttgaatcggatttgaaaaat

SEQ ID NO: 23355 - DNA, 20 bp, Unknown
  RNA secondary structure sequence
gcttcccaagtggaagagtt

SEQ ID NO: 23356 - DNA, 20 bp, Unknown
  RNA secondary structure sequence
tcggatcgactgaagaagat

SEQ ID NO: 23357 - DNA, 20 bp, Unknown
  RNA secondary structure sequence
aggataaagatgcgactgtg

SEQ ID NO: 23358 - DNA, 20 bp, Unknown
  RNA secondary structure sequence
agaagtaagaaaattcctag

SEQ ID NO: 23359 - DNA, 20 bp, Unknown
  RNA secondary structure sequence
acgaatctcaaacctagttt

SEQ ID NO: 23360 - DNA, 20 bp, Unknown
  RNA secondary structure sequence
tatgacaagttagatggttt

SEQ ID NO: 23361 - DNA, 20 bp, Unknown
  RNA secondary structure sequence
ccgcatgttcaactcgacat

SEQ ID NO: 23362 - DNA, 20 bp, Unknown
  RNA secondary structure sequence
cagaaaggttctgatatctt

SEQ ID NO: 23363 - DNA, 20 bp, Unknown
  RNA secondary structure sequence
ggtaatgttgatggtgtaga

SEQ ID NO: 23364 - DNA, 20 bp, Unknown
  RNA secondary structure sequence
gatactctgtggtcaactgc

SEQ ID NO: 23365 - DNA, 20 bp, Unknown
  RNA secondary structure sequence
agacctgaaatcaaccctct

SEQ ID NO: 23366 - DNA, 20 bp, Unknown
  RNA secondary structure sequence
gagtgccctaacagcaccgg

SEQ ID NO: 23367 - DNA, 20 bp, Unknown
  RNA secondary structure sequence
gcgtaattcactcactaccg

SEQ ID NO: 23368 - DNA, 20 bp, Unknown
  RNA secondary structure sequence
tgagttcgcaagaatctctt

SEQ ID NO: 23369 - DNA, 20 bp, Unknown
  RNA secondary structure sequence
caaaagtacactatcttatc

SEQ ID NO: 23370 - DNA, 20 bp, Unknown
  RNA secondary structure sequence
atctgcatgggagtattcac

SEQ ID NO: 23371 - DNA, 20 bp, Unknown
  RNA secondary structure sequence
agctcataaaacaagagctt

SEQ ID NO: 23372 - DNA, 20 bp, Unknown
  RNA secondary structure sequence
tgcttatttaaaaagaagtt

SEQ ID NO: 23373 - DNA, 20 bp, Unknown
  RNA secondary structure sequence
ctggttttacatcttttagt

SEQ ID NO: 23374 - DNA, 20 bp, Unknown
  RNA secondary structure sequence
atgaatacgtctatcgtgta

SEQ ID NO: 23375 - DNA, 20 bp, Unknown
  RNA secondary structure sequence
ttcttgattcttcctgaggg

SEQ ID NO: 23376 - DNA, 20 bp, Unknown
  RNA secondary structure sequence
ttaagattcttgacctcaca

SEQ ID NO: 23377 - DNA, 20 bp, Unknown
  RNA secondary structure sequence
cacaaagtggccctgttatg

SEQ ID NO: 23378 - DNA, 20 bp, Unknown
  RNA secondary structure sequence
ttacaatgagctttatgaga

SEQ ID NO: 23379 - DNA, 20 bp, Unknown
  RNA secondary structure sequence
caaaacacatggaaaatgct

SEQ ID NO: 23380 - DNA, 20 bp, Unknown
  RNA secondary structure sequence
attttggtgatgctaaaata

SEQ ID NO: 23381 - DNA, 20 bp, Unknown
  RNA secondary structure sequence
attgttatactttcgtggaa

SEQ ID NO: 23382 - DNA, 20 bp, Unknown
  RNA secondary structure sequence
ggatacctggagaagactat

SEQ ID NO: 23383 - DNA, 20 bp, Unknown
  RNA secondary structure sequence
cgagacaagggaagatattg

SEQ ID NO: 23384 - DNA, 20 bp, Unknown
  RNA secondary structure sequence
tagaccatatttccgtgggg

SEQ ID NO: 23385 - DNA, 20 bp, Unknown
  RNA secondary structure sequence
acattgtaactaatgtattc

SEQ ID NO: 23386 - DNA, 20 bp, Unknown
  RNA secondary structure sequence
tttcaggttatgagtagttt

SEQ ID NO: 23387 - DNA, 20 bp, Unknown
  RNA secondary structure sequence
ccttatgcattccatggaca

SEQ ID NO: 23388 - DNA, 20 bp, Unknown
  RNA secondary structure sequence
catttacctttcctcaaatc

SEQ ID NO: 23389 - DNA, 20 bp, Unknown
  RNA secondary structure sequence
aagggagtcgcagagttcca

SEQ ID NO: 23390 - DNA, 20 bp, Unknown
  RNA secondary structure sequence
tccatctttatcggtacgcc

SEQ ID NO: 23391 - DNA, 20 bp, Unknown
  RNA secondary structure sequence
tgagctcctttagagggagg

SEQ ID NO: 23392 - DNA, 20 bp, Unknown
  RNA secondary structure sequence
caaccaacaacatcaactcc

SEQ ID NO: 23393 - DNA, 20 bp, Unknown
  RNA secondary structure sequence
tggaaaactctctaccgaca

SEQ ID NO: 23394 - DNA, 20 bp, Unknown
  RNA secondary structure sequence
ttatggcaggaaaatctctg

SEQ ID NO: 23395 - DNA, 20 bp, Unknown
  RNA secondary structure sequence
aagttggcaaagaacttgaa

SEQ ID NO: 23396 - DNA, 20 bp, Unknown
  RNA secondary structure sequence
gtcgtgcatatcagtggcta

SEQ ID NO: 23397 - DNA, 20 bp, Unknown
  RNA secondary structure sequence
atatcaaagataccatgagt

SEQ ID NO: 23398 - DNA, 20 bp, Unknown
  RNA secondary structure sequence
ttatttacgaaatgctaaac

SEQ ID NO: 23399 - DNA, 20 bp, Unknown
  RNA secondary structure sequence
aattgtatacagccaatttc

SEQ ID NO: 23400 - DNA, 20 bp, Unknown
  RNA secondary structure sequence
aagcagagagaacgcaagag

SEQ ID NO: 23401 - DNA, 20 bp, Unknown
  RNA secondary structure sequence
ctgcagtgacgaccacagtt

SEQ ID NO: 23402 - DNA, 20 bp, Unknown
  RNA secondary structure sequence
cacttcagtaggggctgtac

SEQ ID NO: 23403 - DNA, 20 bp, Unknown
  RNA secondary structure sequence
agcggattacccctagtggt

SEQ ID NO: 23404 - DNA, 20 bp, Unknown
  RNA secondary structure sequence
catgggggcagtctcgttat

SEQ ID NO: 23405 - DNA, 20 bp, Unknown
  RNA secondary structure sequence
tactcgacttggattttcag

SEQ ID NO: 23406 - DNA, 20 bp, Unknown
  RNA secondary structure sequence
tctcacctgttaattgggtt

SEQ ID NO: 23407 - DNA, 20 bp, Unknown
  RNA secondary structure sequence
aaggcgcctacacacaggat

SEQ ID NO: 23408 - DNA, 20 bp, Unknown
  RNA secondary structure sequence
ccggacttggttctctcttc

SEQ ID NO: 23409 - DNA, 20 bp, Unknown
  RNA secondary structure sequence
caggccctgacattgagttg

SEQ ID NO: 23410 - DNA, 20 bp, Unknown
  RNA secondary structure sequence
ctcttctttcattgcttgct

SEQ ID NO: 23411 - DNA, 20 bp, Unknown
  RNA secondary structure sequence
agattttggtgcggcttttg

SEQ ID NO: 23412 - DNA, 20 bp, Unknown
  RNA secondary structure sequence
tctggaaaattgctgagaat

SEQ ID NO: 23413 - DNA, 20 bp, Unknown
  RNA secondary structure sequence
tgaaacaaatcacggcagtt

SEQ ID NO: 23414 - DNA, 20 bp, Unknown
  RNA secondary structure sequence
agctctcattagtgaaaacc

SEQ ID NO: 23415 - DNA, 20 bp, Unknown
  RNA secondary structure sequence
tgcatggcacattcaaggtt

SEQ ID NO: 23416 - DNA, 20 bp, Unknown
  RNA secondary structure sequence
atcccagtcccttgaatggt

SEQ ID NO: 23417 - DNA, 20 bp, Unknown
  RNA secondary structure sequence
aaccgcaagcaattgcctgt

SEQ ID NO: 23418 - DNA, 20 bp, Unknown
  RNA secondary structure sequence
tgctcgtaatgagagcacat

SEQ ID NO: 23419 - DNA, 20 bp, Unknown
  RNA secondary structure sequence
ctactgctgtgaagaatgtc

SEQ ID NO: 23420 - DNA, 20 bp, Unknown
  RNA secondary structure sequence
tgcgagcagactctactagc

SEQ ID NO: 23421 - DNA, 20 bp, Unknown
  RNA secondary structure sequence
tatgactttgagtcattggg

SEQ ID NO: 23422 - DNA, 20 bp, Unknown
  RNA secondary structure sequence
cctcattcacaatcacacgg

SEQ ID NO: 23423 - DNA, 20 bp, Unknown
  RNA secondary structure sequence
gctgcgccaaaaacgcgcga

SEQ ID NO: 23424 - DNA, 20 bp, Unknown
  RNA secondary structure sequence
tcccctgtggacatgcatgt

SEQ ID NO: 23425 - DNA, 20 bp, Unknown
  RNA secondary structure sequence
ttcttctccgacttggagtt

SEQ ID NO: 23426 - DNA, 20 bp, Unknown
  RNA secondary structure sequence
tctatattgctgacatctga

SEQ ID NO: 23427 - DNA, 20 bp, Unknown
  RNA secondary structure sequence
tttaaacttgcaacactggc

SEQ ID NO: 23428 - DNA, 20 bp, Unknown
  RNA secondary structure sequence
aaaggcctcttttccctgct

SEQ ID NO: 23429 - DNA, 20 bp, Unknown
  RNA secondary structure sequence
tcccctgttgttatttgtac

SEQ ID NO: 23430 - DNA, 20 bp, Unknown
  RNA secondary structure sequence
tcgtggtctgacttgtttaa

SEQ ID NO: 23431 - DNA, 20 bp, Unknown
  RNA secondary structure sequence
cctgcccgcatcattggcat

SEQ ID NO: 23432 - DNA, 20 bp, Unknown
  RNA secondary structure sequence
cgggtctttgcccgtattgg

SEQ ID NO: 23433 - DNA, 20 bp, Unknown
  RNA secondary structure sequence
tttgtggcaaagtttcatga

SEQ ID NO: 23434 - DNA, 20 bp, Unknown
  RNA secondary structure sequence
attcttgcagctatgatgaa

SEQ ID NO: 23435 - DNA, 20 bp, Unknown
  RNA secondary structure sequence
gaaccagaacagtatgagcg

SEQ ID NO: 23436 - DNA, 20 bp, Unknown
  RNA secondary structure sequence
ttacgtttcagcttgcacag

SEQ ID NO: 23437 - DNA, 20 bp, Unknown
  RNA secondary structure sequence
ctgatttcctgcaagtagct

SEQ ID NO: 23438 - DNA, 20 bp, Unknown
  RNA secondary structure sequence
ttcagtacacccagtataga

SEQ ID NO: 23439 - DNA, 20 bp, Unknown
  RNA secondary structure sequence
acataacagcagaatttgtg

SEQ ID NO: 23440 - DNA, 20 bp, Unknown
  RNA secondary structure sequence
gggatgttgaacttaacccc

SEQ ID NO: 23441 - DNA, 20 bp, Unknown
  RNA secondary structure sequence
agtccgaagatggagaaccg

SEQ ID NO: 23442 - DNA, 20 bp, Unknown
  RNA secondary structure sequence
aggggatttcctccactctc

SEQ ID NO: 23443 - DNA, 20 bp, Unknown
  RNA secondary structure sequence
ttagcgcagatgatcagtat

SEQ ID NO: 23444 - DNA, 20 bp, Unknown
  RNA secondary structure sequence
cttttcattttaaggaaact

SEQ ID NO: 23445 - DNA, 20 bp, Unknown
  RNA secondary structure sequence
tggaggcagtggatgtaatt

SEQ ID NO: 23446 - DNA, 20 bp, Unknown
  RNA secondary structure sequence
gcgacgtggaaccagccgtc

SEQ ID NO: 23447 - DNA, 20 bp, Unknown
  RNA secondary structure sequence
gtactgacaatggaatcatt

SEQ ID NO: 23448 - DNA, 20 bp, Unknown
  RNA secondary structure sequence
ctaacaatggattaggcatt

SEQ ID NO: 23449 - DNA, 20 bp, Unknown
  RNA secondary structure sequence
gcggctggccgtctgtactt

SEQ ID NO: 23450 - DNA, 20 bp, Unknown
  RNA secondary structure sequence
caacactggagtgatcaatt

SEQ ID NO: 23451 - DNA, 20 bp, Unknown
  RNA secondary structure sequence
gtttgtgacccttagggccc

SEQ ID NO: 23452 - DNA, 20 bp, Unknown
  RNA secondary structure sequence
cacttttgatgatacagata

SEQ ID NO: 23453 - DNA, 20 bp, Unknown
  RNA secondary structure sequence
ccactgtccctgggctattg

SEQ ID NO: 23454 - DNA, 20 bp, Unknown
  RNA secondary structure sequence
taacgcaccaatgccaacca

SEQ ID NO: 23455 - DNA, 20 bp, Unknown
  RNA secondary structure sequence
aaacatggattctccacttc

SEQ ID NO: 23456 - DNA, 20 bp, Unknown
  RNA secondary structure sequence
tgacccgcaatacttgcggt

SEQ ID NO: 23457 - DNA, 20 bp, Unknown
  RNA secondary structure sequence
ccctgatgaactgaaccctt

SEQ ID NO: 23458 - DNA, 20 bp, Unknown
  RNA secondary structure sequence
catgtttcctgaatttgacc

SEQ ID NO: 23459 - DNA, 20 bp, Unknown
  RNA secondary structure sequence
agccaatatggaaatggaaa

SEQ ID NO: 23460 - DNA, 20 bp, Unknown
  RNA secondary structure sequence
cagttatatctggtctggtg

SEQ ID NO: 23461 - DNA, 20 bp, Unknown
  RNA secondary structure sequence
agatggtgccataggtgcag

SEQ ID NO: 23462 - DNA, 20 bp, Unknown
  RNA secondary structure sequence
aggatcagctgttggagtta

SEQ ID NO: 23463 - DNA, 20 bp, Unknown
  RNA secondary structure sequence
ttcctatattgattctctct

SEQ ID NO: 23464 - DNA, 20 bp, Unknown
  RNA secondary structure sequence
tagtctcgtgcgaccagtca

SEQ ID NO: 23465 - DNA, 20 bp, Unknown
  RNA secondary structure sequence
gctggatatgaaatccccag

SEQ ID NO: 23466 - DNA, 20 bp, Unknown
  RNA secondary structure sequence
ctgatagggtcgcggctggc

SEQ ID NO: 23467 - DNA, 20 bp, Unknown
  RNA secondary structure sequence
ctcagacatgattatgaaag

SEQ ID NO: 23468 - DNA, 20 bp, Unknown
  RNA secondary structure sequence
taattcttgcataacaacac

SEQ ID NO: 23469 - DNA, 20 bp, Unknown
  RNA secondary structure sequence
tgcatataccccacctggtg

SEQ ID NO: 23470 - DNA, 20 bp, Unknown
  RNA secondary structure sequence
atgggtaactgtattccagc

SEQ ID NO: 23471 - DNA, 20 bp, Unknown
  RNA secondary structure sequence
agcctcatttagaataccat

SEQ ID NO: 23472 - DNA, 20 bp, Unknown
  RNA secondary structure sequence
gaccaaatgggctaactatt

SEQ ID NO: 23473 - DNA, 20 bp, Unknown
  RNA secondary structure sequence
ctttactacttacttaaagg

SEQ ID NO: 23474 - DNA, 20 bp, Unknown
  RNA secondary structure sequence
accgttaaccgcccacctac

SEQ ID NO: 23475 - DNA, 20 bp, Unknown
  RNA secondary structure sequence
tctttaatcaatcttatggt

SEQ ID NO: 23476 - DNA, 20 bp, Unknown
  RNA secondary structure sequence
taatatcaattattatagag

SEQ ID NO: 23477 - DNA, 20 bp, Unknown
  RNA secondary structure sequence
ggtgtctaatgctgataggg

SEQ ID NO: 23478 - DNA, 20 bp, Unknown
  RNA secondary structure sequence
ccaagggctgccagtactca

SEQ ID NO: 23479 - DNA, 20 bp, Unknown
  RNA secondary structure sequence
gatttcgcaagacggatttc

SEQ ID NO: 23480 - DNA, 20 bp, Unknown
  RNA secondary structure sequence
gaacataaagactgttacca

SEQ ID NO: 23481 - DNA, 20 bp, Unknown
  RNA secondary structure sequence
ccgagattattgcagacgaa

SEQ ID NO: 23482 - DNA, 20 bp, Unknown
  RNA secondary structure sequence
tagggttcttggcatacatg

SEQ ID NO: 23483 - DNA, 20 bp, Unknown
  RNA secondary structure sequence
gatgatagcatatggtgatg

SEQ ID NO: 23484 - DNA, 20 bp, Unknown
  RNA secondary structure sequence
agatgagagatttcctttcc

SEQ ID NO: 23485 - DNA, 20 bp, Unknown
  RNA secondary structure sequence
cacagaaccatcctaaccat

SEQ ID NO: 23486 - DNA, 20 bp, Unknown
  RNA secondary structure sequence
gtgtatccgtcttggcacac

SEQ ID NO: 23487 - DNA, 20 bp, Unknown
  RNA secondary structure sequence
tattgatcagcgtgagtgga

SEQ ID NO: 23488 - DNA, 20 bp, Unknown
  RNA secondary structure sequence
ggcagggggtctcatagcag

SEQ ID NO: 23489 - DNA, 20 bp, Unknown
  RNA secondary structure sequence
cattgtcaatttggctaatt

SEQ ID NO: 23490 - DNA, 20 bp, Unknown
  RNA secondary structure sequence
gccaggcactcagatctggt

SEQ ID NO: 23491 - DNA, 20 bp, Unknown
  RNA secondary structure sequence
gtccctctggccttatgcaa

SEQ ID NO: 23492 - DNA, 20 bp, Unknown
  RNA secondary structure sequence
ccaactgtatcgtggttctc

SEQ ID NO: 23493 - DNA, 20 bp, Unknown
  RNA secondary structure sequence
acgcatagataggacactca

SEQ ID NO: 23494 - DNA, 20 bp, Unknown
  RNA secondary structure sequence
caactcaccattcattatag

SEQ ID NO: 23495 - DNA, 20 bp, Unknown
  RNA secondary structure sequence
caatcacttttctactgagg

SEQ ID NO: 23496 - DNA, 20 bp, Unknown
  RNA secondary structure sequence
caagaccagagccatagagg

SEQ ID NO: 23497 - DNA, 20 bp, Unknown
  RNA secondary structure sequence
tgtccatggttctatgccat

SEQ ID NO: 23498 - DNA, 20 bp, Unknown
  RNA secondary structure sequence
tatttctgaggagactgttt

SEQ ID NO: 23499 - DNA, 20 bp, Unknown
  RNA secondary structure sequence
tccaacttacaaagagctgg

SEQ ID NO: 23500 - DNA, 20 bp, Unknown
  RNA secondary structure sequence
tttccgcctgcctggtcgtt

SEQ ID NO: 23501 - DNA, 20 bp, Unknown
  RNA secondary structure sequence
acaggctaaggatgcccttc

SEQ ID NO: 23502 - DNA, 20 bp, Unknown
  RNA secondary structure sequence
acctttcttcgactgggtct

SEQ ID NO: 23503 - DNA, 20 bp, Unknown
  RNA secondary structure sequence
ggtatgcatggttgacggta

SEQ ID NO: 23504 - DNA, 20 bp, Unknown
  RNA secondary structure sequence
ggaccgcatcctcaccacga

SEQ ID NO: 23505 - DNA, 20 bp, Unknown
  RNA secondary structure sequence
aatctacggacatgtgtaca

SEQ ID NO: 23506 - DNA, 20 bp, Unknown
  RNA secondary structure sequence
tgcagcacactgttaccatt

SEQ ID NO: 23507 - DNA, 20 bp, Unknown
  RNA secondary structure sequence
tctccttgaccgcagcacac

SEQ ID NO: 23508 - DNA, 20 bp, Unknown
  RNA secondary structure sequence
cggtgcgccacgcacaaccc

SEQ ID NO: 23509 - DNA, 20 bp, Unknown
  RNA secondary structure sequence
ggcgcggaaatactcttccg

SEQ ID NO: 23510 - DNA, 20 bp, Unknown
  RNA secondary structure sequence
ccggttggtgaccgcatttg

SEQ ID NO: 23511 - DNA, 20 bp, Unknown
  RNA secondary structure sequence
gcgtgatctcaatgatccgt

SEQ ID NO: 23512 - DNA, 20 bp, Unknown
  RNA secondary structure sequence
tggccaaggtaaaagtttcc

SEQ ID NO: 23513 - DNA, 20 bp, Unknown
  RNA secondary structure sequence
cttcaagtacttcgcccaaa

SEQ ID NO: 23514 - DNA, 20 bp, Unknown
  RNA secondary structure sequence
tcaaccaccaattctcaacg

SEQ ID NO: 23515 - DNA, 20 bp, Unknown
  RNA secondary structure sequence
accatacgaggggccagtga

SEQ ID NO: 23516 - DNA, 20 bp, Unknown
  RNA secondary structure sequence
accacaccacgaggggttaa

SEQ ID NO: 23517 - DNA, 20 bp, Unknown
  RNA secondary structure sequence
ccattttgcccagtacaaaa

SEQ ID NO: 23518 - DNA, 20 bp, Unknown
  RNA secondary structure sequence
tgattacgatctggactttg

SEQ ID NO: 23519 - DNA, 20 bp, Unknown
  RNA secondary structure sequence
gcgttgggtgaacgccgtgt

SEQ ID NO: 23520 - DNA, 20 bp, Unknown
  RNA secondary structure sequence
ctaaaggagctgtggctata

SEQ ID NO: 23521 - DNA, 20 bp, Unknown
  RNA secondary structure sequence
tgtgtgtcgatttcaacaat

SEQ ID NO: 23522 - DNA, 20 bp, Unknown
  RNA secondary structure sequence
aagtttgtggattcatgggg

SEQ ID NO: 23523 - DNA, 20 bp, Unknown
  RNA secondary structure sequence
tgacaacattccttaaacat

SEQ ID NO: 23524 - DNA, 20 bp, Unknown
  RNA secondary structure sequence
taactttaattggtcttgat

SEQ ID NO: 23525 - DNA, 20 bp, Unknown
  RNA secondary structure sequence
actgggttgattgtaacact

SEQ ID NO: 23526 - DNA, 20 bp, Unknown
  RNA secondary structure sequence
taataacgtcaattgtctca

SEQ ID NO: 23527 - DNA, 20 bp, Unknown
  RNA secondary structure sequence
atggcactctcaccacccaa

SEQ ID NO: 23528 - DNA, 20 bp, Unknown
  RNA secondary structure sequence
tgggtgagaacccttccttt

SEQ ID NO: 23529 - DNA, 20 bp, Unknown
  RNA secondary structure sequence
gttgtgaattgttctcaatt

SEQ ID NO: 23530 - DNA, 20 bp, Unknown
  RNA secondary structure sequence
tagttgtggaaacagtttgt

SEQ ID NO: 23531 - DNA, 20 bp, Unknown
  RNA secondary structure sequence
gggaaattggagacttattt

SEQ ID NO: 23532 - DNA, 20 bp, Unknown
  RNA secondary structure sequence
atgaacaggtgctacatgct

SEQ ID NO: 23533 - DNA, 20 bp, Unknown
  RNA secondary structure sequence
agaagttcaaatgggttcaa

SEQ ID NO: 23534 - DNA, 20 bp, Unknown
  RNA secondary structure sequence
acaccaatgagagatcaaat

SEQ ID NO: 23535 - DNA, 20 bp, Unknown
  RNA secondary structure sequence
tttccgcctacttggtcgtc

SEQ ID NO: 23536 - DNA, 20 bp, Unknown
  RNA secondary structure sequence
gttctaccgtcgttcccgac

SEQ ID NO: 23537 - DNA, 20 bp, Unknown
  RNA secondary structure sequence
tagcggagcatggtggccgt

SEQ ID NO: 23538 - DNA, 20 bp, Unknown
  RNA secondary structure sequence
atgcccttcaggtaccccga

SEQ ID NO: 23539 - DNA, 20 bp, Unknown
  RNA secondary structure sequence
tctgctatacgctctcagag

SEQ ID NO: 23540 - DNA, 20 bp, Unknown
  RNA secondary structure sequence
cctcgaatgggtctacgact

SEQ ID NO: 23541 - DNA, 20 bp, Unknown
  RNA secondary structure sequence
cgatcaagaaccattcaacg

SEQ ID NO: 23542 - DNA, 20 bp, Unknown
  RNA secondary structure sequence
cagtgacccgtttgggcggt

SEQ ID NO: 23543 - DNA, 20 bp, Unknown
  RNA secondary structure sequence
gctagctagtgctggcaaag

SEQ ID NO: 23544 - DNA, 20 bp, Unknown
  RNA secondary structure sequence
cgtgaaagtcaagccaaagg

SEQ ID NO: 23545 - DNA, 20 bp, Unknown
  RNA secondary structure sequence
actggacaacactaccaacc

SEQ ID NO: 23546 - DNA, 20 bp, Unknown
  RNA secondary structure sequence
caccttcgtggtaaagaaga

SEQ ID NO: 23547 - DNA, 20 bp, Unknown
  RNA secondary structure sequence
tgacatcaacgacatatttg

SEQ ID NO: 23548 - DNA, 20 bp, Unknown
  RNA secondary structure sequence
atacaaggaggccaaggaat

SEQ ID NO: 23549 - DNA, 20 bp, Unknown
  RNA secondary structure sequence
gaacgttctcgcgcaggcaa

SEQ ID NO: 23550 - DNA, 20 bp, Unknown
  RNA secondary structure sequence
atccaccacggggttcatcc

SEQ ID NO: 23551 - DNA, 20 bp, Unknown
  RNA secondary structure sequence
agacgggtacaagatcaaca

SEQ ID NO: 23552 - DNA, 20 bp, Unknown
  RNA secondary structure sequence
cgacgtaactcttggcgacg

SEQ ID NO: 23553 - DNA, 20 bp, Unknown
  RNA secondary structure sequence
cgacaagatcatgttggacg

SEQ ID NO: 23554 - DNA, 20 bp, Unknown
  RNA secondary structure sequence
gaagggaacccccgtcgtcg

SEQ ID NO: 23555 - DNA, 20 bp, Unknown
  RNA secondary structure sequence
ccacgtgatgcgcaaaacca

SEQ ID NO: 23556 - DNA, 20 bp, Unknown
  RNA secondary structure sequence
cgccctgatcgacttcgaaa

SEQ ID NO: 23557 - DNA, 20 bp, Unknown
  RNA secondary structure sequence
acacattctctacaccagaa

SEQ ID NO: 23558 - DNA, 20 bp, Unknown
  RNA secondary structure sequence
aagcatcatcaacacaattt

SEQ ID NO: 23559 - DNA, 20 bp, Unknown
  RNA secondary structure sequence
gtgcggctccggtccctgga

SEQ ID NO: 23560 - DNA, 20 bp, Unknown
  RNA secondary structure sequence
ggaggttctctaccaggagt

SEQ ID NO: 23561 - DNA, 20 bp, Unknown
  RNA secondary structure sequence
ccttcttttttcctttcttt

SEQ ID NO: 23562 - DNA, 20 bp, Unknown
  RNA secondary structure sequence
cggtgtgggttctcttcagc

SEQ ID NO: 23563 - DNA, 20 bp, Unknown
  RNA secondary structure sequence
tacagtatgagtgtgttact

SEQ ID NO: 23564 - DNA, 20 bp, Unknown
  RNA secondary structure sequence
caacactgtggctgaaatgg

SEQ ID NO: 23565 - DNA, 20 bp, Unknown
  RNA secondary structure sequence
tgaagctaaagggaacaact

SEQ ID NO: 23566 - DNA, 20 bp, Unknown
  RNA secondary structure sequence
gaagtttgattacatcaaat

SEQ ID NO: 23567 - DNA, 20 bp, Unknown
  RNA secondary structure sequence
aggacccagaaacattcctg

SEQ ID NO: 23568 - DNA, 20 bp, Unknown
  RNA secondary structure sequence
atgaagtgaatggaactgtg

SEQ ID NO: 23569 - DNA, 20 bp, Unknown
  RNA secondary structure sequence
aacaaaacaagtgtccctgg

SEQ ID NO: 23570 - DNA, 20 bp, Unknown
  RNA secondary structure sequence
aagggaattggggaccttcc

SEQ ID NO: 23571 - DNA, 20 bp, Unknown
  RNA secondary structure sequence
ctgggtttgctgtagggttc

SEQ ID NO: 23572 - DNA, 20 bp, Unknown
  RNA secondary structure sequence
gacagagttatctctatgtc

SEQ ID NO: 23573 - DNA, 20 bp, Unknown
  RNA secondary structure sequence
ttcttttctttctttttcag

SEQ ID NO: 23574 - DNA, 20 bp, Unknown
  RNA secondary structure sequence
gaagtctgattgatgtgatg

SEQ ID NO: 23575 - DNA, 20 bp, Unknown
  RNA secondary structure sequence
ggattgcgaaaaccttaagg

SEQ ID NO: 23576 - DNA, 20 bp, Unknown
  RNA secondary structure sequence
aagatttggctgggttcata

SEQ ID NO: 23577 - DNA, 20 bp, Unknown
  RNA secondary structure sequence
ttttgatatcatttattttg

SEQ ID NO: 23578 - DNA, 20 bp, Unknown
  RNA secondary structure sequence
ctcaaactagtcctagtgtg

SEQ ID NO: 23579 - DNA, 20 bp, Unknown
  RNA secondary structure sequence
gaaaggagagtgcaatggaa

SEQ ID NO: 23580 - DNA, 20 bp, Unknown
  RNA secondary structure sequence
tgtggaaaccttcagcaggt

SEQ ID NO: 23581 - DNA, 20 bp, Unknown
  RNA secondary structure sequence
ctgcttgtttagctaaggca

SEQ ID NO: 23582 - DNA, 20 bp, Unknown
  RNA secondary structure sequence
gctcaatgggtgtgacgacc

SEQ ID NO: 23583 - DNA, 20 bp, Unknown
  RNA secondary structure sequence
catctctggtatcaaatttc

SEQ ID NO: 23584 - DNA, 20 bp, Unknown
  RNA secondary structure sequence
ccaaactagcatcaactata

SEQ ID NO: 23585 - DNA, 20 bp, Unknown
  RNA secondary structure sequence
acacagaactattttcagca

SEQ ID NO: 23586 - DNA, 20 bp, Unknown
  RNA secondary structure sequence
cttggagctgggacccaagt

SEQ ID NO: 23587 - DNA, 20 bp, Unknown
  RNA secondary structure sequence
aaattgagaatcccagacaa

SEQ ID NO: 23588 - DNA, 20 bp, Unknown
  RNA secondary structure sequence
atgctggaataacaccagca

SEQ ID NO: 23589 - DNA, 20 bp, Unknown
  RNA secondary structure sequence
gctacaaaggagtaagctgt

SEQ ID NO: 23590 - DNA, 20 bp, Unknown
  RNA secondary structure sequence
ccatgcaaatatgaagtgcg

SEQ ID NO: 23591 - DNA, 20 bp, Unknown
  RNA secondary structure sequence
actaataaactatatgaaac

SEQ ID NO: 23592 - DNA, 20 bp, Unknown
  RNA secondary structure sequence
attgaaggatggtgtcaaaa

SEQ ID NO: 23593 - DNA, 20 bp, Unknown
  RNA secondary structure sequence
cgcttagcagtaaaaatgct

SEQ ID NO: 23594 - DNA, 20 bp, Unknown
  RNA secondary structure sequence
atcaatagaacagcagttac

SEQ ID NO: 23595 - DNA, 20 bp, Unknown
  RNA secondary structure sequence
ttactcaacaagatctgtct

SEQ ID NO: 23596 - DNA, 20 bp, Unknown
  RNA secondary structure sequence
ttatgtagttggggatctca

SEQ ID NO: 23597 - DNA, 20 bp, Unknown
  RNA secondary structure sequence
gaaggagcaggaaattggat

SEQ ID NO: 23598 - DNA, 20 bp, Unknown
  RNA secondary structure sequence
attgggaagatcaaggaaac

SEQ ID NO: 23599 - DNA, 20 bp, Unknown
  RNA secondary structure sequence
tttctctcatttgcgagttt

SEQ ID NO: 23600 - DNA, 20 bp, Unknown
  RNA secondary structure sequence
ttcttgattaaatatttact

SEQ ID NO: 23601 - DNA, 20 bp, Unknown
  RNA secondary structure sequence
cctttggcccgaacagccaa

SEQ ID NO: 23602 - DNA, 20 bp, Unknown
  RNA secondary structure sequence
gatcatctggaggatgatcc

SEQ ID NO: 23603 - DNA, 20 bp, Unknown
  RNA secondary structure sequence
acgaccgccaatcgaagact

SEQ ID NO: 23604 - DNA, 20 bp, Unknown
  RNA secondary structure sequence
gtaccagatgctgtgcaaga

SEQ ID NO: 23605 - DNA, 20 bp, Unknown
  RNA secondary structure sequence
tgctcttcgtcctgggctct

SEQ ID NO: 23606 - DNA, 20 bp, Unknown
  RNA secondary structure sequence
atttcgttcaggtgtgcctc

SEQ ID NO: 23607 - DNA, 20 bp, Unknown
  RNA secondary structure sequence
gatcagagcccggcgggaac

SEQ ID NO: 23608 - DNA, 20 bp, Unknown
  RNA secondary structure sequence
gcgaacccaatgacaaccac

SEQ ID NO: 23609 - DNA, 20 bp, Unknown
  RNA secondary structure sequence
tccgcccagagcccacagac

SEQ ID NO: 23610 - DNA, 20 bp, Unknown
  RNA secondary structure sequence
acaggaccaagctgattctg

SEQ ID NO: 23611 - DNA, 20 bp, Unknown
  RNA secondary structure sequence
cttggggagacaaaaagagg

SEQ ID NO: 23612 - DNA, 20 bp, Unknown
  RNA secondary structure sequence
tcaaaacaaatgactttgct

SEQ ID NO: 23613 - DNA, 20 bp, Unknown
  RNA secondary structure sequence
tatcacgttaaagatttaga

SEQ ID NO: 23614 - DNA, 20 bp, Unknown
  RNA secondary structure sequence
tgggcggcttccatttttac

SEQ ID NO: 23615 - DNA, 20 bp, Unknown
  RNA secondary structure sequence
tcatgatgcagcctttcttg

SEQ ID NO: 23616 - DNA, 20 bp, Unknown
  RNA secondary structure sequence
aagggtgccggaacaatttc

SEQ ID NO: 23617 - DNA, 20 bp, Unknown
  RNA secondary structure sequence
aaccgtattgtctgtttttc

SEQ ID NO: 23618 - DNA, 20 bp, Unknown
  RNA secondary structure sequence
caggacaccgagtggtaaac

SEQ ID NO: 23619 - DNA, 20 bp, Unknown
  RNA secondary structure sequence
tgatatagaaggaatattat

SEQ ID NO: 23620 - DNA, 20 bp, Unknown
  RNA secondary structure sequence
tgttatcagagatgctttgc

SEQ ID NO: 23621 - DNA, 20 bp, Unknown
  RNA secondary structure sequence
gtcgtcagttattagacatt

SEQ ID NO: 23622 - DNA, 20 bp, Unknown
  RNA secondary structure sequence
gtataaaataaatttaatta

SEQ ID NO: 23623 - DNA, 20 bp, Unknown
  RNA secondary structure sequence
aagatttgtgtcttaattag

SEQ ID NO: 23624 - DNA, 20 bp, Unknown
  RNA secondary structure sequence
gttgacattgacgttcacca

SEQ ID NO: 23625 - DNA, 20 bp, Unknown
  RNA secondary structure sequence
agaacagtgttgaccctaac

SEQ ID NO: 23626 - DNA, 20 bp, Unknown
  RNA secondary structure sequence
aatggtgtgtgctgctaatc

SEQ ID NO: 23627 - DNA, 20 bp, Unknown
  RNA secondary structure sequence
agcttcgaaaggtaccgggc

SEQ ID NO: 23628 - DNA, 20 bp, Unknown
  RNA secondary structure sequence
tgcttattcttactgtaatg

SEQ ID NO: 23629 - DNA, 20 bp, Unknown
  RNA secondary structure sequence
caaatcctgataatatcatg

SEQ ID NO: 23630 - DNA, 20 bp, Unknown
  RNA secondary structure sequence
atttaacttactatgatact

SEQ ID NO: 23631 - DNA, 20 bp, Unknown
  RNA secondary structure sequence
atatttcatagggagtgaag

SEQ ID NO: 23632 - DNA, 20 bp, Unknown
  RNA secondary structure sequence
aatgatcgatccagtttata

SEQ ID NO: 23633 - DNA, 20 bp, Unknown
  RNA secondary structure sequence
attcaacttagttgatgatg

SEQ ID NO: 23634 - DNA, 20 bp, Unknown
  RNA secondary structure sequence
caagggtggtacatcatctg

SEQ ID NO: 23635 - DNA, 20 bp, Unknown
  RNA secondary structure sequence
tgttaggttattaagttcaa

SEQ ID NO: 23636 - DNA, 20 bp, Unknown
  RNA secondary structure sequence
agtgtacaagacgttagatg

SEQ ID NO: 23637 - DNA, 20 bp, Unknown
  RNA secondary structure sequence
cataacatccagcttgtcaa

SEQ ID NO: 23638 - DNA, 20 bp, Unknown
  RNA secondary structure sequence
catattcaaacccaaaacag

SEQ ID NO: 23639 - DNA, 20 bp, Unknown
  RNA secondary structure sequence
ataaattaaagttatttgaa

SEQ ID NO: 23640 - DNA, 20 bp, Unknown
  RNA secondary structure sequence
cctcatattacttcaaaaaa

SEQ ID NO: 23641 - DNA, 20 bp, Unknown
  RNA secondary structure sequence
cacggtacagaagcctaatt

SEQ ID NO: 23642 - DNA, 20 bp, Unknown
  RNA secondary structure sequence
tgactattgatggaactaca

SEQ ID NO: 23643 - DNA, 20 bp, Unknown
  RNA secondary structure sequence
gagtgtatattaaagaccca

SEQ ID NO: 23644 - DNA, 20 bp, Unknown
  RNA secondary structure sequence
cagcgagaaggatatcttcg

SEQ ID NO: 23645 - DNA, 20 bp, Unknown
  RNA secondary structure sequence
tgactttgttaacgccatca

SEQ ID NO: 23646 - DNA, 20 bp, Unknown
  RNA secondary structure sequence
aattaacaggattcgtgaga

SEQ ID NO: 23647 - DNA, 20 bp, Unknown
  RNA secondary structure sequence
taagcaaaatatcgctggat

SEQ ID NO: 23648 - DNA, 20 bp, Unknown
  RNA secondary structure sequence
taaaccgtaagtaaattatc

SEQ ID NO: 23649 - DNA, 20 bp, Unknown
  RNA secondary structure sequence
caacgcagaggtggtgtttg

SEQ ID NO: 23650 - DNA, 20 bp, Unknown
  RNA secondary structure sequence
cagttgaatgttgaagtcaa

SEQ ID NO: 23651 - DNA, 20 bp, Unknown
  RNA secondary structure sequence
ggatcacgttatatgtctgc

SEQ ID NO: 23652 - DNA, 20 bp, Unknown
  RNA secondary structure sequence
gttattgttaatgaaagcac

SEQ ID NO: 23653 - DNA, 20 bp, Unknown
  RNA secondary structure sequence
attctcatctcagaatgaga

SEQ ID NO: 23654 - DNA, 20 bp, Unknown
  RNA secondary structure sequence
cattagtgcgtgtttatcac

SEQ ID NO: 23655 - DNA, 20 bp, Unknown
  RNA secondary structure sequence
gctattgtgggcttgtcggg

SEQ ID NO: 23656 - DNA, 20 bp, Unknown
  RNA secondary structure sequence
ttctcgccacagacatgggg

SEQ ID NO: 23657 - DNA, 20 bp, Unknown
  RNA secondary structure sequence
tgtcgattccagtgcatgct

SEQ ID NO: 23658 - DNA, 20 bp, Unknown
  RNA secondary structure sequence
ggttcattgtcataacagtg

SEQ ID NO: 23659 - DNA, 20 bp, Unknown
  RNA secondary structure sequence
atcgaaaaacggcatctttt

SEQ ID NO: 23660 - DNA, 20 bp, Unknown
  RNA secondary structure sequence
acatagagggcagtaagtac

SEQ ID NO: 23661 - DNA, 20 bp, Unknown
  RNA secondary structure sequence
ttggaggagtgggatttctc

SEQ ID NO: 23662 - DNA, 20 bp, Unknown
  RNA secondary structure sequence
tggagctacgttgtggtgag

SEQ ID NO: 23663 - DNA, 20 bp, Unknown
  RNA secondary structure sequence
gacgtgtggaggctgtgctc

SEQ ID NO: 23664 - DNA, 20 bp, Unknown
  RNA secondary structure sequence
gtgtcccagaatcgccacgg

SEQ ID NO: 23665 - DNA, 20 bp, Unknown
  RNA secondary structure sequence
tgggggctgcagtcaagagc

SEQ ID NO: 23666 - DNA, 20 bp, Unknown
  RNA secondary structure sequence
taagtgaaggtggagtccct

SEQ ID NO: 23667 - DNA, 20 bp, Unknown
  RNA secondary structure sequence
aggcctcactgagcaacatt

SEQ ID NO: 23668 - DNA, 20 bp, Unknown
  RNA secondary structure sequence
ccacggcaatggcggtctgg

SEQ ID NO: 23669 - DNA, 20 bp, Unknown
  RNA secondary structure sequence
tggtgggcgtcatgctcact

SEQ ID NO: 23670 - DNA, 20 bp, Unknown
  RNA secondary structure sequence
atgaggggggagaggtcaat

SEQ ID NO: 23671 - DNA, 20 bp, Unknown
  RNA secondary structure sequence
agatgctgagctcggggcga

SEQ ID NO: 23672 - DNA, 20 bp, Unknown
  RNA secondary structure sequence
ccatgtggcacgtcacaagg

SEQ ID NO: 23673 - DNA, 20 bp, Unknown
  RNA secondary structure sequence
agacacaccaatgtcagccg

SEQ ID NO: 23674 - DNA, 20 bp, Unknown
  RNA secondary structure sequence
tagttcttgcccctacccgg

SEQ ID NO: 23675 - DNA, 20 bp, Unknown
  RNA secondary structure sequence
cagctcaacgccggggcagg

SEQ ID NO: 23676 - DNA, 20 bp, Unknown
  RNA secondary structure sequence
agatgaagatgccagaagtg

SEQ ID NO: 23677 - DNA, 20 bp, Unknown
  RNA secondary structure sequence
tgtggtgctttgtggcaaga

SEQ ID NO: 23678 - DNA, 20 bp, Unknown
  RNA secondary structure sequence
gaagtagcgatgataataga

SEQ ID NO: 23679 - DNA, 20 bp, Unknown
  RNA secondary structure sequence
tccagccagcacgatcctgg

SEQ ID NO: 23680 - DNA, 20 bp, Unknown
  RNA secondary structure sequence
tccatcccgagactgagaca

SEQ ID NO: 23681 - DNA, 20 bp, Unknown
  RNA secondary structure sequence
ggctgaatggttgctctagg

SEQ ID NO: 23682 - DNA, 20 bp, Unknown
  RNA secondary structure sequence
gaccagaggtacttgaggct

SEQ ID NO: 23683 - DNA, 20 bp, Unknown
  RNA secondary structure sequence
accagcggggacctgccaag

SEQ ID NO: 23684 - DNA, 20 bp, Unknown
  RNA secondary structure sequence
taactagaagagaccaacgt

SEQ ID NO: 23685 - DNA, 20 bp, Unknown
  RNA secondary structure sequence
ctcaccatttccatgagctg

SEQ ID NO: 23686 - DNA, 20 bp, Unknown
  RNA secondary structure sequence
acaggagggatctgagaacg

SEQ ID NO: 23687 - DNA, 20 bp, Unknown
  RNA secondary structure sequence
cgggaagctggtcgctcccg

SEQ ID NO: 23688 - DNA, 20 bp, Unknown
  RNA secondary structure sequence
gaactgggaggttatgaagg

SEQ ID NO: 23689 - DNA, 20 bp, Unknown
  RNA secondary structure sequence
gatgttgaaagctattgcta

SEQ ID NO: 23690 - DNA, 20 bp, Unknown
  RNA secondary structure sequence
ggacatgacatacgcacaag

SEQ ID NO: 23691 - DNA, 20 bp, Unknown
  RNA secondary structure sequence
taacgacccggaactattgg

SEQ ID NO: 23692 - DNA, 20 bp, Unknown
  RNA secondary structure sequence
aatcttagctgcacagaatc

SEQ ID NO: 23693 - DNA, 20 bp, Unknown
  RNA secondary structure sequence
agtttaccgcaatcttttca

SEQ ID NO: 23694 - DNA, 20 bp, Unknown
  RNA secondary structure sequence
ctcgttttttgagcatactt

SEQ ID NO: 23695 - DNA, 20 bp, Unknown
  RNA secondary structure sequence
tccaagctgggcgtttatta

SEQ ID NO: 23696 - DNA, 20 bp, Unknown
  RNA secondary structure sequence
ctgacacagatgtaacgttc

SEQ ID NO: 23697 - DNA, 20 bp, Unknown
  RNA secondary structure sequence
ttgttgaagtttctggagca

SEQ ID NO: 23698 - DNA, 20 bp, Unknown
  RNA secondary structure sequence
gtgaagtaggagaatctagt

SEQ ID NO: 23699 - DNA, 20 bp, Unknown
  RNA secondary structure sequence
aagctaatgctggtccagtt

SEQ ID NO: 23700 - DNA, 20 bp, Unknown
  RNA secondary structure sequence
aacttctggcacgttccacc

SEQ ID NO: 23701 - DNA, 20 bp, Unknown
  RNA secondary structure sequence
cgtagtgattgtaagatcct

SEQ ID NO: 23702 - DNA, 20 bp, Unknown
  RNA secondary structure sequence
tccctgtgatcagtatcaac

SEQ ID NO: 23703 - DNA, 20 bp, Unknown
  RNA secondary structure sequence
tcttacgtggaccccgcggt

SEQ ID NO: 23704 - DNA, 20 bp, Unknown
  RNA secondary structure sequence
tctggtgttcttgaccccaa

SEQ ID NO: 23705 - DNA, 20 bp, Unknown
  RNA secondary structure sequence
tcttcccacatctccaaact

SEQ ID NO: 23706 - DNA, 20 bp, Unknown
  RNA secondary structure sequence
accgccccagtggtcgtcgc

SEQ ID NO: 23707 - DNA, 20 bp, Unknown
  RNA secondary structure sequence
aacaccctagccaaccccac

SEQ ID NO: 23708 - DNA, 20 bp, Unknown
  RNA secondary structure sequence
caggtggtggtgaacggtac

SEQ ID NO: 23709 - DNA, 20 bp, Unknown
  RNA secondary structure sequence
ggttgcacacccaataccac

SEQ ID NO: 23710 - DNA, 20 bp, Unknown
  RNA secondary structure sequence
tgctactcaccgccaagcgg

SEQ ID NO: 23711 - DNA, 20 bp, Unknown
  RNA secondary structure sequence
ccctatgacgccacctctcc

SEQ ID NO: 23712 - DNA, 20 bp, Unknown
  RNA secondary structure sequence
gatgtgctcaacaccacgct

SEQ ID NO: 23713 - DNA, 20 bp, Unknown
  RNA secondary structure sequence
aagacgaacgccatcgtcaa

SEQ ID NO: 23714 - DNA, 20 bp, Unknown
  RNA secondary structure sequence
agcgatggaacacgccagat

SEQ ID NO: 23715 - DNA, 20 bp, Unknown
  RNA secondary structure sequence
gtctctaacatcaccggtgt

SEQ ID NO: 23716 - DNA, 20 bp, Unknown
  RNA secondary structure sequence
agaaacaccactctgggcgc

SEQ ID NO: 23717 - DNA, 20 bp, Unknown
  RNA secondary structure sequence
tccctccttgcctctgtcct

SEQ ID NO: 23718 - DNA, 20 bp, Unknown
  RNA secondary structure sequence
gctaggttggatcgggcctc

SEQ ID NO: 23719 - DNA, 20 bp, Unknown
  RNA secondary structure sequence
tattcgggcatgcctcaact

SEQ ID NO: 23720 - DNA, 20 bp, Unknown
  RNA secondary structure sequence
cgctttctgggctcccaccc

SEQ ID NO: 23721 - DNA, 20 bp, Unknown
  RNA secondary structure sequence
tcctgcgcattcagaattgt

SEQ ID NO: 23722 - DNA, 20 bp, Unknown
  RNA secondary structure sequence
ccactgttcgtcctggtaga

SEQ ID NO: 23723 - DNA, 20 bp, Unknown
  RNA secondary structure sequence
agacaagcttttcactatcc

SEQ ID NO: 23724 - DNA, 20 bp, Unknown
  RNA secondary structure sequence
cactactcaagaggcagcga

SEQ ID NO: 23725 - DNA, 20 bp, Unknown
  RNA secondary structure sequence
acttccagacgcactgacag

SEQ ID NO: 23726 - DNA, 20 bp, Unknown
  RNA secondary structure sequence
ttcctaccagttcctcacta

SEQ ID NO: 23727 - DNA, 20 bp, Unknown
  RNA secondary structure sequence
aacggggaagctgctgttag

SEQ ID NO: 23728 - DNA, 20 bp, Unknown
  RNA secondary structure sequence
caatacaaacacagtatcag

SEQ ID NO: 23729 - DNA, 20 bp, Unknown
  RNA secondary structure sequence
tagattcagcgtcccgtttg

SEQ ID NO: 23730 - DNA, 20 bp, Unknown
  RNA secondary structure sequence
gggccagggagtggttggat

SEQ ID NO: 23731 - DNA, 20 bp, Unknown
  RNA secondary structure sequence
tgacggtatggtggagaggt

SEQ ID NO: 23732 - DNA, 20 bp, Unknown
  RNA secondary structure sequence
tttaccattactggaagcgc

SEQ ID NO: 23733 - DNA, 20 bp, Unknown
  RNA secondary structure sequence
gcagcaggccgtggtagtta

SEQ ID NO: 23734 - DNA, 20 bp, Unknown
  RNA secondary structure sequence
taagaaacatgggtttccag

SEQ ID NO: 23735 - DNA, 20 bp, Unknown
  RNA secondary structure sequence
cattgagatgccagaggaaa

SEQ ID NO: 23736 - DNA, 20 bp, Unknown
  RNA secondary structure sequence
gcagagctcttcacttacca

SEQ ID NO: 23737 - DNA, 20 bp, Unknown
  RNA secondary structure sequence
caccccttctcttacgggag

SEQ ID NO: 23738 - DNA, 20 bp, Unknown
  RNA secondary structure sequence
tgacttgatatgaccaagag

SEQ ID NO: 23739 - DNA, 20 bp, Unknown
  RNA secondary structure sequence
cgtatggcgcatgctcatgg

SEQ ID NO: 23740 - DNA, 20 bp, Unknown
  RNA secondary structure sequence
ctaagatggcaatctatgag

SEQ ID NO: 23741 - DNA, 20 bp, Unknown
  RNA secondary structure sequence
ataaacataaaggtgagact

SEQ ID NO: 23742 - DNA, 20 bp, Unknown
  RNA secondary structure sequence
gagagtggacatgccccttg

SEQ ID NO: 23743 - DNA, 20 bp, Unknown
  RNA secondary structure sequence
aacagcaaaacaatgacttc

SEQ ID NO: 23744 - DNA, 20 bp, Unknown
  RNA secondary structure sequence
ataattttgttactttagta

SEQ ID NO: 23745 - DNA, 20 bp, Unknown
  RNA secondary structure sequence
cagactcaattccatctgct

SEQ ID NO: 23746 - DNA, 20 bp, Unknown
  RNA secondary structure sequence
ttataacctcatatcatgct

SEQ ID NO: 23747 - DNA, 20 bp, Unknown
  RNA secondary structure sequence
ttagagatcaccaacagaga

SEQ ID NO: 23748 - DNA, 20 bp, Unknown
  RNA secondary structure sequence
tgttttccattcttgttaag

SEQ ID NO: 23749 - DNA, 20 bp, Unknown
  RNA secondary structure sequence
tccctgtttgtacatccact

SEQ ID NO: 23750 - DNA, 20 bp, Unknown
  RNA secondary structure sequence
caatggggataaggaagaga

SEQ ID NO: 23751 - DNA, 20 bp, Unknown
  RNA secondary structure sequence
ccatttttaattctatcatt

SEQ ID NO: 23752 - DNA, 20 bp, Unknown
  RNA secondary structure sequence
tcacaatgaccccagctgat

SEQ ID NO: 23753 - DNA, 20 bp, Unknown
  RNA secondary structure sequence
caacacaggaacatgtgaca

SEQ ID NO: 23754 - DNA, 20 bp, Unknown
  RNA secondary structure sequence
acaaattttaaagatggttt

SEQ ID NO: 23755 - DNA, 20 bp, Unknown
  RNA secondary structure sequence
ggccgaatttgaacaagttt

SEQ ID NO: 23756 - DNA, 20 bp, Unknown
  RNA secondary structure sequence
atcaggagataatatgactc

SEQ ID NO: 23757 - DNA, 20 bp, Unknown
  RNA secondary structure sequence
atatatattgcgacaaggat

SEQ ID NO: 23758 - DNA, 20 bp, Unknown
  RNA secondary structure sequence
tacatttagtaaaatagatg

SEQ ID NO: 23759 - DNA, 20 bp, Unknown
  RNA secondary structure sequence
gaaaggaactaaaggaaaac

SEQ ID NO: 23760 - DNA, 20 bp, Unknown
  RNA secondary structure sequence
tggagatgataatgtaatta

SEQ ID NO: 23761 - DNA, 20 bp, Unknown
  RNA secondary structure sequence
taccaatgtacataacacga

SEQ ID NO: 23762 - DNA, 20 bp, Unknown
  RNA secondary structure sequence
acaacgccccgttctcattg

SEQ ID NO: 23763 - DNA, 20 bp, Unknown
  RNA secondary structure sequence
tttccaattagacaattcag

SEQ ID NO: 23764 - DNA, 20 bp, Unknown
  RNA secondary structure sequence
gtggttagataacatatctc

SEQ ID NO: 23765 - DNA, 20 bp, Unknown
  RNA secondary structure sequence
agtgggaatgccttgctact

SEQ ID NO: 23766 - DNA, 20 bp, Unknown
  RNA secondary structure sequence
acagtataacaatagagaga

SEQ ID NO: 23767 - DNA, 20 bp, Unknown
  RNA secondary structure sequence
ggagaatttggcgtcaagcg

SEQ ID NO: 23768 - DNA, 20 bp, Unknown
  RNA secondary structure sequence
cagcacaaagagcaatgatg

SEQ ID NO: 23769 - DNA, 20 bp, Unknown
  RNA secondary structure sequence
ttgagagggaagggtactct

SEQ ID NO: 23770 - DNA, 20 bp, Unknown
  RNA secondary structure sequence
gtgtacagcccactttctca

SEQ ID NO: 23771 - DNA, 20 bp, Unknown
  RNA secondary structure sequence
tatagtggagcggattctgg

SEQ ID NO: 23772 - DNA, 20 bp, Unknown
  RNA secondary structure sequence
ctcaactggtgcgcttgcca

SEQ ID NO: 23773 - DNA, 20 bp, Unknown
  RNA secondary structure sequence
cagaatggtactagccagca

SEQ ID NO: 23774 - DNA, 20 bp, Unknown
  RNA secondary structure sequence
acaagcctgggacatcccct

SEQ ID NO: 23775 - DNA, 20 bp, Unknown
  RNA secondary structure sequence
tggccaggactagtcgctgg

SEQ ID NO: 23776 - DNA, 20 bp, Unknown
  RNA secondary structure sequence
tacatgtttgtgtcactggg

SEQ ID NO: 23777 - DNA, 20 bp, Unknown
  RNA secondary structure sequence
gaacttgctgggagcagatg

SEQ ID NO: 23778 - DNA, 20 bp, Unknown
  RNA secondary structure sequence
gcaaggagacgtagtgttgg

SEQ ID NO: 23779 - DNA, 20 bp, Unknown
  RNA secondary structure sequence
gacccaaggtcgccagactt

SEQ ID NO: 23780 - DNA, 20 bp, Unknown
  RNA secondary structure sequence
agagctctcctttacagtta

SEQ ID NO: 23781 - DNA, 20 bp, Unknown
  RNA secondary structure sequence
caagctagttggaatcaaca

SEQ ID NO: 23782 - DNA, 20 bp, Unknown
  RNA secondary structure sequence
ggcaggactgttggtttcag

SEQ ID NO: 23783 - DNA, 20 bp, Unknown
  RNA secondary structure sequence
ggtaatgccagcccatggtc

SEQ ID NO: 23784 - DNA, 20 bp, Unknown
  RNA secondary structure sequence
cagttcatatcggaggccag

SEQ ID NO: 23785 - DNA, 20 bp, Unknown
  RNA secondary structure sequence
ggcatgtgaattgaccgatt

SEQ ID NO: 23786 - DNA, 20 bp, Unknown
  RNA secondary structure sequence
atctcttcaacagattgaga

SEQ ID NO: 23787 - DNA, 20 bp, Unknown
  RNA secondary structure sequence
cgcctacttggtcgtcagcg

SEQ ID NO: 23788 - DNA, 20 bp, Unknown
  RNA secondary structure sequence
gagcatgacggccgtgggaa

SEQ ID NO: 23789 - DNA, 20 bp, Unknown
  RNA secondary structure sequence
ggacggcacggacatgtgcc

SEQ ID NO: 23790 - DNA, 20 bp, Unknown
  RNA secondary structure sequence
agaaccactcaacggagaat

SEQ ID NO: 23791 - DNA, 20 bp, Unknown
  RNA secondary structure sequence
tattagcggaggctccaacg

SEQ ID NO: 23792 - DNA, 20 bp, Unknown
  RNA secondary structure sequence
atcgtttggacactgtcact

SEQ ID NO: 23793 - DNA, 20 bp, Unknown
  RNA secondary structure sequence
acttgacacgcggcagaagt

SEQ ID NO: 23794 - DNA, 20 bp, Unknown
  RNA secondary structure sequence
gtgggacactggtcttaatt

SEQ ID NO: 23795 - DNA, 20 bp, Unknown
  RNA secondary structure sequence
ctccttcaactacggtgctg

SEQ ID NO: 23796 - DNA, 20 bp, Unknown
  RNA secondary structure sequence
gaagaagatctccgactcgc

SEQ ID NO: 23797 - DNA, 20 bp, Unknown
  RNA secondary structure sequence
taaggagtggctcgacaacg

SEQ ID NO: 23798 - DNA, 20 bp, Unknown
  RNA secondary structure sequence
ggaggtgattgaccgggttg

SEQ ID NO: 23799 - DNA, 20 bp, Unknown
  RNA secondary structure sequence
accctacgccgggccgctcg

SEQ ID NO: 23800 - DNA, 20 bp, Unknown
  RNA secondary structure sequence
tttgaaagtgaaagctaaga

SEQ ID NO: 23801 - DNA, 20 bp, Unknown
  RNA secondary structure sequence
tcttttcgctgagaagtatg

SEQ ID NO: 23802 - DNA, 20 bp, Unknown
  RNA secondary structure sequence
ctgtggaggagctgttctcg

SEQ ID NO: 23803 - DNA, 20 bp, Unknown
  RNA secondary structure sequence
agatgtggaagagcgtgtgc

SEQ ID NO: 23804 - DNA, 20 bp, Unknown
  RNA secondary structure sequence
ccaggggaagcgccgcggcg

SEQ ID NO: 23805 - DNA, 20 bp, Unknown
  RNA secondary structure sequence
gtctggctgttccgcaacta

SEQ ID NO: 23806 - DNA, 20 bp, Unknown
  RNA secondary structure sequence
ccacttcaaatctcttggcc

SEQ ID NO: 23807 - DNA, 20 bp, Unknown
  RNA secondary structure sequence
ctttgcacgccgtgggacca

SEQ ID NO: 23808 - DNA, 20 bp, Unknown
  RNA secondary structure sequence
ggtgctatggagtgcccaac

SEQ ID NO: 23809 - DNA, 20 bp, Unknown
  RNA secondary structure sequence
gcccaacggcaggagaagcc

SEQ ID NO: 23810 - DNA, 20 bp, Unknown
  RNA secondary structure sequence
ggaaccaagaaggatccctg

SEQ ID NO: 23811 - DNA, 20 bp, Unknown
  RNA secondary structure sequence
aaacattctcaaatggcgca

SEQ ID NO: 23812 - DNA, 20 bp, Unknown
  RNA secondary structure sequence
gggaatgtctttggcctcca

SEQ ID NO: 23813 - DNA, 20 bp, Unknown
  RNA secondary structure sequence
tgtcaactgtgcacccagct

SEQ ID NO: 23814 - DNA, 20 bp, Unknown
  RNA secondary structure sequence
ccgctcttcttaggaaatgt

SEQ ID NO: 23815 - DNA, 20 bp, Unknown
  RNA secondary structure sequence
caagtgatccattcccggag

SEQ ID NO: 23816 - DNA, 20 bp, Unknown
  RNA secondary structure sequence
ataacatggaaatccctgga

SEQ ID NO: 23817 - DNA, 20 bp, Unknown
  RNA secondary structure sequence
agtacgcaacaacaacacga

SEQ ID NO: 23818 - DNA, 20 bp, Unknown
  RNA secondary structure sequence
taacgacattgtgcttggga

SEQ ID NO: 23819 - DNA, 20 bp, Unknown
  RNA secondary structure sequence
gagcggctgccctttttcag

SEQ ID NO: 23820 - DNA, 20 bp, Unknown
  RNA secondary structure sequence
caaatcgcagaggtggcaca

SEQ ID NO: 23821 - DNA, 20 bp, Unknown
  RNA secondary structure sequence
caataatgagaacaactcta

SEQ ID NO: 23822 - DNA, 20 bp, Unknown
  RNA secondary structure sequence
gagaagagtacaagaagacc

SEQ ID NO: 23823 - DNA, 20 bp, Unknown
  RNA secondary structure sequence
tgactgacacaacaccattt

SEQ ID NO: 23824 - DNA, 20 bp, Unknown
  RNA secondary structure sequence
agaagaaaccatctgaattt

SEQ ID NO: 23825 - DNA, 20 bp, Unknown
  RNA secondary structure sequence
tggttagagagactgcccca

SEQ ID NO: 23826 - DNA, 20 bp, Unknown
  RNA secondary structure sequence
ttcctcacactgtacaaaag

SEQ ID NO: 23827 - DNA, 20 bp, Unknown
  RNA secondary structure sequence
ttgccacagcttggcagact

SEQ ID NO: 23828 - DNA, 20 bp, Unknown
  RNA secondary structure sequence
ggtggctttacatattgagc

SEQ ID NO: 23829 - DNA, 20 bp, Unknown
  RNA secondary structure sequence
gcatggattttgcaatatgt

SEQ ID NO: 23830 - DNA, 20 bp, Unknown
  RNA secondary structure sequence
atgaaacccacagtgggagg

SEQ ID NO: 23831 - DNA, 20 bp, Unknown
  RNA secondary structure sequence
catggcaggttcacagagat

SEQ ID NO: 23832 - DNA, 20 bp, Unknown
  RNA secondary structure sequence
gggaactaaaacaccagtgg

SEQ ID NO: 23833 - DNA, 20 bp, Unknown
  RNA secondary structure sequence
tggacactgaaagaatggaa

SEQ ID NO: 23834 - DNA, 20 bp, Unknown
  RNA secondary structure sequence
atggagagctgctcagcgaa

SEQ ID NO: 23835 - DNA, 20 bp, Unknown
  RNA secondary structure sequence
ttattgctgtgggggtgaca

SEQ ID NO: 23836 - DNA, 20 bp, Unknown
  RNA secondary structure sequence
ttggtctgccgagcgcaaac

SEQ ID NO: 23837 - DNA, 20 bp, Unknown
  RNA secondary structure sequence
gcgtcctccacacaatgtgg

SEQ ID NO: 23838 - DNA, 20 bp, Unknown
  RNA secondary structure sequence
gaagagctcatgaagtgcat

SEQ ID NO: 23839 - DNA, 20 bp, Unknown
  RNA secondary structure sequence
cctttgaaaaagactattcc

SEQ ID NO: 23840 - DNA, 20 bp, Unknown
  RNA secondary structure sequence
tgacaggaatgtcaggggtt

SEQ ID NO: 23841 - DNA, 20 bp, Unknown
  RNA secondary structure sequence
ctggcaagcagaggagcagc

SEQ ID NO: 23842 - DNA, 20 bp, Unknown
  RNA secondary structure sequence
gagtggctggacacgtcctg

SEQ ID NO: 23843 - DNA, 20 bp, Unknown
  RNA secondary structure sequence
atcccatggtggacggagat

SEQ ID NO: 23844 - DNA, 20 bp, Unknown
  RNA secondary structure sequence
cagggcagcttatcaggcct

SEQ ID NO: 23845 - DNA, 20 bp, Unknown
  RNA secondary structure sequence
gggctggaatgaatgtgttt

SEQ ID NO: 23846 - DNA, 20 bp, Unknown
  RNA secondary structure sequence
accgaacgtggcagtactgg

SEQ ID NO: 23847 - DNA, 20 bp, Unknown
  RNA secondary structure sequence
cggacgacacagccggatgg

SEQ ID NO: 23848 - DNA, 20 bp, Unknown
  RNA secondary structure sequence
gtgaccacggagaagaacgc

SEQ ID NO: 23849 - DNA, 20 bp, Unknown
  RNA secondary structure sequence
ttcccttctgctcgcaccat

SEQ ID NO: 23850 - DNA, 20 bp, Unknown
  RNA secondary structure sequence
ggcaacacgccagtgagagt

SEQ ID NO: 23851 - DNA, 20 bp, Unknown
  RNA secondary structure sequence
gtcacatggagagaggactc

SEQ ID NO: 23852 - DNA, 20 bp, Unknown
  RNA secondary structure sequence
caacggcatctctcggacag

SEQ ID NO: 23853 - DNA, 20 bp, Unknown
  RNA secondary structure sequence
accgttgtgtgccccaagtg

SEQ ID NO: 23854 - DNA, 20 bp, Unknown
  RNA secondary structure sequence
ttggcaccatcacgctcacg

SEQ ID NO: 23855 - DNA, 20 bp, Unknown
  RNA secondary structure sequence
gaattacaactgctaatgaa

SEQ ID NO: 23856 - DNA, 20 bp, Unknown
  RNA secondary structure sequence
tcccgagtagctggctggtc

SEQ ID NO: 23857 - DNA, 20 bp, Unknown
  RNA secondary structure sequence
caactctctttgggtcattt

SEQ ID NO: 23858 - DNA, 20 bp, Unknown
  RNA secondary structure sequence
tggaggagccaataggagat

SEQ ID NO: 23859 - DNA, 20 bp, Unknown
  RNA secondary structure sequence
cgaaaacacgggtttctaca

SEQ ID NO: 23860 - DNA, 20 bp, Unknown
  RNA secondary structure sequence
tcggggcctacaacggaata

SEQ ID NO: 23861 - DNA, 20 bp, Unknown
  RNA secondary structure sequence
tctttcttggagccttgtac

SEQ ID NO: 23862 - DNA, 20 bp, Unknown
  RNA secondary structure sequence
tcttcattaatggtgacccc

SEQ ID NO: 23863 - DNA, 20 bp, Unknown
  RNA secondary structure sequence
ttgtcgaggaaaccaaacag

SEQ ID NO: 23864 - DNA, 20 bp, Unknown
  RNA secondary structure sequence
cactgcatcgtgcaaatttc

SEQ ID NO: 23865 - DNA, 20 bp, Unknown
  RNA secondary structure sequence
agcccacgaagatgtcttat

SEQ ID NO: 23866 - DNA, 20 bp, Unknown
  RNA secondary structure sequence
ggtcattcttcacttctcgc

SEQ ID NO: 23867 - DNA, 20 bp, Unknown
  RNA secondary structure sequence
tcagacttgacagaattccg

SEQ ID NO: 23868 - DNA, 20 bp, Unknown
  RNA secondary structure sequence
gtatcgtcctgccccctccc

SEQ ID NO: 23869 - DNA, 20 bp, Unknown
  RNA secondary structure sequence
gatcatttgtgactgatgat

SEQ ID NO: 23870 - DNA, 20 bp, Unknown
  RNA secondary structure sequence
aggatgccgttcaagatcaa

SEQ ID NO: 23871 - DNA, 20 bp, Unknown
  RNA secondary structure sequence
gccgtttcctcgaatttgag

SEQ ID NO: 23872 - DNA, 20 bp, Unknown
  RNA secondary structure sequence
caaaaatcagctctgaggac

SEQ ID NO: 23873 - DNA, 20 bp, Unknown
  RNA secondary structure sequence
tgggacggcgagatcaacga

SEQ ID NO: 23874 - DNA, 20 bp, Unknown
  RNA secondary structure sequence
tggttatagcaggggatgat

SEQ ID NO: 23875 - DNA, 20 bp, Unknown
  RNA secondary structure sequence
taggatttgtagccattacc

SEQ ID NO: 23876 - DNA, 20 bp, Unknown
  RNA secondary structure sequence
cctgggaagatatcccctat

SEQ ID NO: 23877 - DNA, 20 bp, Unknown
  RNA secondary structure sequence
taagacagggggtatttgga

SEQ ID NO: 23878 - DNA, 20 bp, Unknown
  RNA secondary structure sequence
tcccctggaaacagggtggg

SEQ ID NO: 23879 - DNA, 20 bp, Unknown
  RNA secondary structure sequence
tctcttgttagatctttttg

SEQ ID NO: 23880 - DNA, 20 bp, Unknown
  RNA secondary structure sequence
tggattgtcgccgacttctt

SEQ ID NO: 23881 - DNA, 20 bp, Unknown
  RNA secondary structure sequence
tgagaggttgtaatcctaaa

SEQ ID NO: 23882 - DNA, 20 bp, Unknown
  RNA secondary structure sequence
ttatgcctgtgcaatcccgg

SEQ ID NO: 23883 - DNA, 20 bp, Unknown
  RNA secondary structure sequence
ttagtgcctttttacagaaa

SEQ ID NO: 23884 - DNA, 20 bp, Unknown
  RNA secondary structure sequence
ctgtcacaagtgctggacag

SEQ ID NO: 23885 - DNA, 20 bp, Unknown
  RNA secondary structure sequence
atgtttgttttgagttttat

SEQ ID NO: 23886 - DNA, 20 bp, Unknown
  RNA secondary structure sequence
gcttggatgctatgttcttt

SEQ ID NO: 23887 - DNA, 20 bp, Unknown
  RNA secondary structure sequence
agctctttagcttgtttagg

SEQ ID NO: 23888 - DNA, 20 bp, Unknown
  RNA secondary structure sequence
ggaattgcattgattgtgat

SEQ ID NO: 23889 - DNA, 20 bp, Unknown
  RNA secondary structure sequence
ttgtggcagctgatttaggt

SEQ ID NO: 23890 - DNA, 20 bp, Unknown
  RNA secondary structure sequence
agcttacttataataagcag

SEQ ID NO: 23891 - DNA, 20 bp, Unknown
  RNA secondary structure sequence
gtatcgtgcgtactcgttct

SEQ ID NO: 23892 - DNA, 20 bp, Unknown
  RNA secondary structure sequence
ccaatggatttagccaagtt

SEQ ID NO: 23893 - DNA, 20 bp, Unknown
  RNA secondary structure sequence
atcaacaactcgctggtatc

SEQ ID NO: 23894 - DNA, 20 bp, Unknown
  RNA secondary structure sequence
ctactgaatatgcttccaac

SEQ ID NO: 23895 - DNA, 20 bp, Unknown
  RNA secondary structure sequence
gattttggcgggatggaagt

SEQ ID NO: 23896 - DNA, 20 bp, Unknown
  RNA secondary structure sequence
cgatttctttacatttgatg

SEQ ID NO: 23897 - DNA, 20 bp, Unknown
  RNA secondary structure sequence
ggatggtgtgccttttgttg

SEQ ID NO: 23898 - DNA, 20 bp, Unknown
  RNA secondary structure sequence
tatgccaaacctactacgta

SEQ ID NO: 23899 - DNA, 20 bp, Unknown
  RNA secondary structure sequence
tattgttccggccaaggtca

SEQ ID NO: 23900 - DNA, 20 bp, Unknown
  RNA secondary structure sequence
tattcgcgctaagcattatg

SEQ ID NO: 23901 - DNA, 20 bp, Unknown
  RNA secondary structure sequence
agaagctgttaaacgcgtgc

SEQ ID NO: 23902 - DNA, 20 bp, Unknown
  RNA secondary structure sequence
ggctgtggcgaaagctcctc

SEQ ID NO: 23903 - DNA, 20 bp, Unknown
  RNA secondary structure sequence
ttgtctccgctactttgcaa

SEQ ID NO: 23904 - DNA, 20 bp, Unknown
  RNA secondary structure sequence
acataaggactcttttaaag

SEQ ID NO: 23905 - DNA, 20 bp, Unknown
  RNA secondary structure sequence
tatgactttctatcctcgtt

SEQ ID NO: 23906 - DNA, 20 bp, Unknown
  RNA secondary structure sequence
gcatgccaattatttgtttt

SEQ ID NO: 23907 - DNA, 20 bp, Unknown
  RNA secondary structure sequence
agttttagatgttaaaggtg

SEQ ID NO: 23908 - DNA, 20 bp, Unknown
  RNA secondary structure sequence
attcaattataaaatcacca

SEQ ID NO: 23909 - DNA, 20 bp, Unknown
  RNA secondary structure sequence
tttagatgtggtacgtaaag

SEQ ID NO: 23910 - DNA, 20 bp, Unknown
  RNA secondary structure sequence
gtacttcagatactagttat

SEQ ID NO: 23911 - DNA, 20 bp, Unknown
  RNA secondary structure sequence
gtgttgtttcctgtttatat

SEQ ID NO: 23912 - DNA, 20 bp, Unknown
  RNA secondary structure sequence
tagcaccacctactggtgtt

SEQ ID NO: 23913 - DNA, 20 bp, Unknown
  RNA secondary structure sequence
atgcacaacactgtttcaaa

SEQ ID NO: 23914 - DNA, 20 bp, Unknown
  RNA secondary structure sequence
aaagttataaaggcatcaaa

SEQ ID NO: 23915 - DNA, 20 bp, Unknown
  RNA secondary structure sequence
catatgaatattatgtaaaa

SEQ ID NO: 23916 - DNA, 20 bp, Unknown
  RNA secondary structure sequence
ggaatgttgtaccctactat

SEQ ID NO: 23917 - DNA, 20 bp, Unknown
  RNA secondary structure sequence
cgactaggtttccgcctggc

SEQ ID NO: 23918 - DNA, 20 bp, Unknown
  RNA secondary structure sequence
aaaatgataatataagtgtt

SEQ ID NO: 23919 - DNA, 20 bp, Unknown
  RNA secondary structure sequence
cagaaaagtcgagataaggc

SEQ ID NO: 23920 - DNA, 20 bp, Unknown
  RNA secondary structure sequence
gctgcacaaggttttcaggc

SEQ ID NO: 23921 - DNA, 20 bp, Unknown
  RNA secondary structure sequence
aacagcaattatgttcttca

SEQ ID NO: 23922 - DNA, 20 bp, Unknown
  RNA secondary structure sequence
atgtttgtggcatcatcttc

SEQ ID NO: 23923 - DNA, 20 bp, Unknown
  RNA secondary structure sequence
cttgttcgtttgactactga

SEQ ID NO: 23924 - DNA, 20 bp, Unknown
  RNA secondary structure sequence
aagattgttgttattgctgg

SEQ ID NO: 23925 - DNA, 20 bp, Unknown
  RNA secondary structure sequence
tctgctacagatgccattat

SEQ ID NO: 23926 - DNA, 20 bp, Unknown
  RNA secondary structure sequence
gttgaaaagtttaattttgt

SEQ ID NO: 23927 - DNA, 20 bp, Unknown
  RNA secondary structure sequence
tgcatcaaatattatgctgt

SEQ ID NO: 23928 - DNA, 20 bp, Unknown
  RNA secondary structure sequence
gaggttgatataattgaaca

SEQ ID NO: 23929 - DNA, 20 bp, Unknown
  RNA secondary structure sequence
gaagctggtgaagttaaacc

SEQ ID NO: 23930 - DNA, 20 bp, Unknown
  RNA secondary structure sequence
attccacttatgcctcttct

SEQ ID NO: 23931 - DNA, 20 bp, Unknown
  RNA secondary structure sequence
ggttaccctaatgattttgt

SEQ ID NO: 23932 - DNA, 20 bp, Unknown
  RNA secondary structure sequence
gataacggtcactatgtagt

SEQ ID NO: 23933 - DNA, 20 bp, Unknown
  RNA secondary structure sequence
cttgatactggtgcacaaaa

SEQ ID NO: 23934 - DNA, 20 bp, Unknown
  RNA secondary structure sequence
tttgttagacatattattgt

SEQ ID NO: 23935 - DNA, 20 bp, Unknown
  RNA secondary structure sequence
gatggtcttatagaccttct

SEQ ID NO: 23936 - DNA, 20 bp, Unknown
  RNA secondary structure sequence
ggtgctcatgttggttctga

SEQ ID NO: 23937 - DNA, 20 bp, Unknown
  RNA secondary structure sequence
gatggttttaatgaatgggc

SEQ ID NO: 23938 - DNA, 20 bp, Unknown
  RNA secondary structure sequence
agtgctatgcactctttact

SEQ ID NO: 23939 - DNA, 20 bp, Unknown
  RNA secondary structure sequence
tgtgatggttctgttcatta

SEQ ID NO: 23940 - DNA, 20 bp, Unknown
  RNA secondary structure sequence
cttttaactgcttgtgcttt

SEQ ID NO: 23941 - DNA, 20 bp, Unknown
  RNA secondary structure sequence
gcgtctatttgtttgtattg

SEQ ID NO: 23942 - DNA, 20 bp, Unknown
  RNA secondary structure sequence
tgtgaccgtacaactattca

SEQ ID NO: 23943 - DNA, 20 bp, Unknown
  RNA secondary structure sequence
ttcgttttaaaaatgctgat

SEQ ID NO: 23944 - DNA, 20 bp, Unknown
  RNA secondary structure sequence
gacataatcttactaaatat

SEQ ID NO: 23945 - DNA, 20 bp, Unknown
  RNA secondary structure sequence
tttatgcatctcttggcaaa

SEQ ID NO: 23946 - DNA, 20 bp, Unknown
  RNA secondary structure sequence
ttttagatatttgtcaagct

SEQ ID NO: 23947 - DNA, 20 bp, Unknown
  RNA secondary structure sequence
tgttgggctctaagcatgtt

SEQ ID NO: 23948 - DNA, 20 bp, Unknown
  RNA secondary structure sequence
tttcaatgatgattctctct

SEQ ID NO: 23949 - DNA, 20 bp, Unknown
  RNA secondary structure sequence
ctggtagtggtaagtcacat

SEQ ID NO: 23950 - DNA, 20 bp, Unknown
  RNA secondary structure sequence
gtgatccacaacaacttcct

SEQ ID NO: 23951 - DNA, 20 bp, Unknown
  RNA secondary structure sequence
atgcctctggtgatgctgtt

SEQ ID NO: 23952 - DNA, 20 bp, Unknown
  RNA secondary structure sequence
gtgttattcatgacattggt

SEQ ID NO: 23953 - DNA, 20 bp, Unknown
  RNA secondary structure sequence
acagtgattgtgatgttgtg

SEQ ID NO: 23954 - DNA, 20 bp, Unknown
  RNA secondary structure sequence
cttttatagctggtaacact

SEQ ID NO: 23955 - DNA, 20 bp, Unknown
  RNA secondary structure sequence
caattcttcaactattgtta

SEQ ID NO: 23956 - DNA, 20 bp, Unknown
  RNA secondary structure sequence
tgattgtaatggttatactg

SEQ ID NO: 23957 - DNA, 20 bp, Unknown
  RNA secondary structure sequence
ccagttttatattaatggtt

SEQ ID NO: 23958 - DNA, 20 bp, Unknown
  RNA secondary structure sequence
tggtattcgtgagtttagta

SEQ ID NO: 23959 - DNA, 20 bp, Unknown
  RNA secondary structure sequence
ccttgcttgtgctcagtact

SEQ ID NO: 23960 - DNA, 20 bp, Unknown
  RNA secondary structure sequence
gttgcttgttttgttttaaa

SEQ ID NO: 23961 - DNA, 20 bp, Unknown
  RNA secondary structure sequence
ctacaacttatgcgtaaggt

SEQ ID NO: 23962 - DNA, 20 bp, Unknown
  RNA secondary structure sequence
accacaattgtttgtgaccg

SEQ ID NO: 23963 - DNA, 20 bp, Unknown
  RNA secondary structure sequence
tgtaaattgggccgatgaca

SEQ ID NO: 23964 - DNA, 20 bp, Unknown
  RNA secondary structure sequence
ttggaagcgtgttcctacca

SEQ ID NO: 23965 - DNA, 20 bp, Unknown
  RNA secondary structure sequence
taggccagtgatagtaaagt

SEQ ID NO: 23966 - DNA, 20 bp, Unknown
  RNA secondary structure sequence
acaattatggtctagtcaaa

SEQ ID NO: 23967 - DNA, 20 bp, Unknown
  RNA secondary structure sequence
tgtttgaaggaaggcttttc

SEQ ID NO: 23968 - DNA, 20 bp, Unknown
  RNA secondary structure sequence
taactggagacaatagtaaa

SEQ ID NO: 23969 - DNA, 20 bp, Unknown
  RNA secondary structure sequence
atggtgggaaactgatgaac

SEQ ID NO: 23970 - DNA, 20 bp, Unknown
  RNA secondary structure sequence
aaaatgaagcagtagtttca

SEQ ID NO: 23971 - DNA, 20 bp, Unknown
  RNA secondary structure sequence
cagtgtctttacaaaatgag

SEQ ID NO: 23972 - DNA, 20 bp, Unknown
  RNA secondary structure sequence
ttcgacaaatacgtctacca

SEQ ID NO: 23973 - DNA, 20 bp, Unknown
  RNA secondary structure sequence
aaggagagtcagttattgga

SEQ ID NO: 23974 - DNA, 20 bp, Unknown
  RNA secondary structure sequence
ttggagaagctgatgatcac

SEQ ID NO: 23975 - DNA, 20 bp, Unknown
  RNA secondary structure sequence
gttgtcaaaactttattttc

SEQ ID NO: 23976 - DNA, 20 bp, Unknown
  RNA secondary structure sequence
cccctcttgacacaaaaatt

SEQ ID NO: 23977 - DNA, 20 bp, Unknown
  RNA secondary structure sequence
agatgagtttgccaatttct

SEQ ID NO: 23978 - DNA, 20 bp, Unknown
  RNA secondary structure sequence
ttcaagagaaggcgctcaaa

SEQ ID NO: 23979 - DNA, 20 bp, Unknown
  RNA secondary structure sequence
tagtaaaaatcataattgaa

SEQ ID NO: 23980 - DNA, 20 bp, Unknown
  RNA secondary structure sequence
ccatcagccacaatgctcaa

SEQ ID NO: 23981 - DNA, 20 bp, Unknown
  RNA secondary structure sequence
ctgcaaaaatatcgtcagca

SEQ ID NO: 23982 - DNA, 20 bp, Unknown
  RNA secondary structure sequence
tatttggccctattggagtc

SEQ ID NO: 23983 - DNA, 20 bp, Unknown
  RNA secondary structure sequence
gctgcagcaacaggtgacac

SEQ ID NO: 23984 - DNA, 20 bp, Unknown
  RNA secondary structure sequence
cctatcgcaaccagttcccc

SEQ ID NO: 23985 - DNA, 20 bp, Unknown
  RNA secondary structure sequence
cagtgtccagtcacttgctc

SEQ ID NO: 23986 - DNA, 20 bp, Unknown
  RNA secondary structure sequence
aggaatgattacaactgtga

SEQ ID NO: 23987 - DNA, 20 bp, Unknown
  RNA secondary structure sequence
gaaagcaatcatccgcagtg

SEQ ID NO: 23988 - DNA, 20 bp, Unknown
  RNA secondary structure sequence
caatccacgtcaatcaataa

SEQ ID NO: 23989 - DNA, 20 bp, Unknown
  RNA secondary structure sequence
aattgttaagtatccgagaa

SEQ ID NO: 23990 - DNA, 20 bp, Unknown
  RNA secondary structure sequence
tctattggcaggagcaggca

SEQ ID NO: 23991 - DNA, 20 bp, Unknown
  RNA secondary structure sequence
ggcccaattaccaacacgtg

SEQ ID NO: 23992 - DNA, 20 bp, Unknown
  RNA secondary structure sequence
agtggttgggagctttctca

SEQ ID NO: 23993 - DNA, 20 bp, Unknown
  RNA secondary structure sequence
ctcacgatctgatctcagtg

SEQ ID NO: 23994 - DNA, 20 bp, Unknown
  RNA secondary structure sequence
ctgacacttggcccacttct

SEQ ID NO: 23995 - DNA, 20 bp, Unknown
  RNA secondary structure sequence
cctccagaacaacgaattat

SEQ ID NO: 23996 - DNA, 20 bp, Unknown
  RNA secondary structure sequence
accaatgagtgtttagttct

SEQ ID NO: 23997 - DNA, 20 bp, Unknown
  RNA secondary structure sequence
tatctcaacacagcaactca

SEQ ID NO: 23998 - DNA, 20 bp, Unknown
  RNA secondary structure sequence
tcctcatctctcttaggaca

SEQ ID NO: 23999 - DNA, 20 bp, Unknown
  RNA secondary structure sequence
tggcatgactcagactggaa

SEQ ID NO: 24000 - DNA, 20 bp, Unknown
  RNA secondary structure sequence
gagaatcatacactaacata

SEQ ID NO: 24001 - DNA, 20 bp, Unknown
  RNA secondary structure sequence
actaatttgatatccccatt

SEQ ID NO: 24002 - DNA, 20 bp, Unknown
  RNA secondary structure sequence
ttcaagaaatgttttgatgc

SEQ ID NO: 24003 - DNA, 20 bp, Unknown
  RNA secondary structure sequence
aacttattagggagaaaacc

SEQ ID NO: 24004 - DNA, 20 bp, Unknown
  RNA secondary structure sequence
tccaataggaagcttaatga

SEQ ID NO: 24005 - DNA, 20 bp, Unknown
  RNA secondary structure sequence
atccgtgtaccgtacattgg

SEQ ID NO: 24006 - DNA, 20 bp, Unknown
  RNA secondary structure sequence
agagttaacatcacacttga

SEQ ID NO: 24007 - DNA, 20 bp, Unknown
  RNA secondary structure sequence
caaatgtattatctgagggt

SEQ ID NO: 24008 - DNA, 20 bp, Unknown
  RNA secondary structure sequence
tttgcatctctggactacat

SEQ ID NO: 24009 - DNA, 20 bp, Unknown
  RNA secondary structure sequence
aggtaccttgagcgattaaa

SEQ ID NO: 24010 - DNA, 20 bp, Unknown
  RNA secondary structure sequence
gtacatgtagatttggaatc

SEQ ID NO: 24011 - DNA, 20 bp, Unknown
  RNA secondary structure sequence
atagaatttgaacaattgat

SEQ ID NO: 24012 - DNA, 20 bp, Unknown
  RNA secondary structure sequence
taacctggctcctcctacaa

SEQ ID NO: 24013 - DNA, 20 bp, Unknown
  RNA secondary structure sequence
tcctttgccagtttgtttct

SEQ ID NO: 24014 - DNA, 20 bp, Unknown
  RNA secondary structure sequence
atcaagttcctactaataca

SEQ ID NO: 24015 - DNA, 20 bp, Unknown
  RNA secondary structure sequence
gcccacgggagcacgctggc

SEQ ID NO: 24016 - DNA, 20 bp, Unknown
  RNA secondary structure sequence
tctgatgataatcctgatga

SEQ ID NO: 24017 - DNA, 20 bp, Unknown
  RNA secondary structure sequence
ccagacagggggcagagcaa

SEQ ID NO: 24018 - DNA, 20 bp, Unknown
  RNA secondary structure sequence
actctccagagtatgacccc

SEQ ID NO: 24019 - DNA, 20 bp, Unknown
  RNA secondary structure sequence
gagcccattgcttttagcac

SEQ ID NO: 24020 - DNA, 20 bp, Unknown
  RNA secondary structure sequence
cctagacataattcatgcag

SEQ ID NO: 24021 - DNA, 20 bp, Unknown
  RNA secondary structure sequence
aaccagcccaaagggcctcc

SEQ ID NO: 24022 - DNA, 20 bp, Unknown
  RNA secondary structure sequence
gggtacacttgccaatacgc

SEQ ID NO: 24023 - DNA, 20 bp, Unknown
  RNA secondary structure sequence
aatgggctgaaaattgctac

SEQ ID NO: 24024 - DNA, 20 bp, Unknown
  RNA secondary structure sequence
caccaggaagtattcggacc

SEQ ID NO: 24025 - DNA, 20 bp, Unknown
  RNA secondary structure sequence
caaccatatgcagatctcca

SEQ ID NO: 24026 - DNA, 20 bp, Unknown
  RNA secondary structure sequence
aacaacagaagcacccactc

SEQ ID NO: 24027 - DNA, 20 bp, Unknown
  RNA secondary structure sequence
taagtgcaatcccaacttac

SEQ ID NO: 24028 - DNA, 20 bp, Unknown
  RNA secondary structure sequence
atattgatgaagattaagaa

SEQ ID NO: 24029 - DNA, 20 bp, Unknown
  RNA secondary structure sequence
cctgcaccaggggaatatac

SEQ ID NO: 24030 - DNA, 20 bp, Unknown
  RNA secondary structure sequence
attatacagtctaaacttgt

SEQ ID NO: 24031 - DNA, 20 bp, Unknown
  RNA secondary structure sequence
agccacaggccggtacaact

SEQ ID NO: 24032 - DNA, 20 bp, Unknown
  RNA secondary structure sequence
cctctattttatgatggcta

SEQ ID NO: 24033 - DNA, 20 bp, Unknown
  RNA secondary structure sequence
aaaatacaatctggccttca

SEQ ID NO: 24034 - DNA, 20 bp, Unknown
  RNA secondary structure sequence
tttctctgttcggatcttac

SEQ ID NO: 24035 - DNA, 20 bp, Unknown
  RNA secondary structure sequence
tttccttcgtcagattgtca

SEQ ID NO: 24036 - DNA, 20 bp, Unknown
  RNA secondary structure sequence
agcaattcaaccaattaagt

SEQ ID NO: 24037 - DNA, 20 bp, Unknown
  RNA secondary structure sequence
aaacaattctagtccatatg

SEQ ID NO: 24038 - DNA, 20 bp, Unknown
  RNA secondary structure sequence
caactgcaacttatcgattg

SEQ ID NO: 24039 - DNA, 20 bp, Unknown
  RNA secondary structure sequence
tcaacagcaagtacaaagag

SEQ ID NO: 24040 - DNA, 20 bp, Unknown
  RNA secondary structure sequence
ttcaaggtttctaagacgcc

SEQ ID NO: 24041 - DNA, 20 bp, Unknown
  RNA secondary structure sequence
gaagaggaccagtgcgattc

SEQ ID NO: 24042 - DNA, 20 bp, Unknown
  RNA secondary structure sequence
ggggcacaaaaaagaagaga

SEQ ID NO: 24043 - DNA, 20 bp, Unknown
  RNA secondary structure sequence
gaagcaacaatggacaaagg

SEQ ID NO: 24044 - DNA, 20 bp, Unknown
  RNA secondary structure sequence
acaagccgaccattgacatt

SEQ ID NO: 24045 - DNA, 20 bp, Unknown
  RNA secondary structure sequence
tccttgtccatagagaatgg

SEQ ID NO: 24046 - DNA, 20 bp, Unknown
  RNA secondary structure sequence
ctgttccagtgtctttctcg

SEQ ID NO: 24047 - DNA, 20 bp, Unknown
  RNA secondary structure sequence
agtacacgggatctgacgga

SEQ ID NO: 24048 - DNA, 20 bp, Unknown
  RNA secondary structure sequence
aggtctttggaggagccttc

SEQ ID NO: 24049 - DNA, 20 bp, Unknown
  RNA secondary structure sequence
ccgtctcacgtctggaacac

SEQ ID NO: 24050 - DNA, 20 bp, Unknown
  RNA secondary structure sequence
acactactgactgcgacagc

SEQ ID NO: 24051 - DNA, 20 bp, Unknown
  RNA secondary structure sequence
gcgtcagtgcccatcggagt

SEQ ID NO: 24052 - DNA, 20 bp, Unknown
  RNA secondary structure sequence
tctttcagatggcggccacc

SEQ ID NO: 24053 - DNA, 20 bp, Unknown
  RNA secondary structure sequence
gaatcactctcatcatcatc

SEQ ID NO: 24054 - DNA, 20 bp, Unknown
  RNA secondary structure sequence
ttcttcacaccctgtggcac

SEQ ID NO: 24055 - DNA, 20 bp, Unknown
  RNA secondary structure sequence
gaaaggcagccataaacatc

SEQ ID NO: 24056 - DNA, 20 bp, Unknown
  RNA secondary structure sequence
atgtcagtgccatcgtgcaa

SEQ ID NO: 24057 - DNA, 20 bp, Unknown
  RNA secondary structure sequence
cagctgtgctggctccaacc

SEQ ID NO: 24058 - DNA, 20 bp, Unknown
  RNA secondary structure sequence
caaactacaacctctttgtg

SEQ ID NO: 24059 - DNA, 20 bp, Unknown
  RNA secondary structure sequence
ctagtgctagtgctgcccag

SEQ ID NO: 24060 - DNA, 20 bp, Unknown
  RNA secondary structure sequence
gaccaaggtcaaacatcatt

SEQ ID NO: 24061 - DNA, 20 bp, Unknown
  RNA secondary structure sequence
ttgaagtcctggggagaatg

SEQ ID NO: 24062 - DNA, 20 bp, Unknown
  RNA secondary structure sequence
cagcaggagttttcttgctc

SEQ ID NO: 24063 - DNA, 20 bp, Unknown
  RNA secondary structure sequence
ccatgaacgctttggcattg

SEQ ID NO: 24064 - DNA, 20 bp, Unknown
  RNA secondary structure sequence
gaatcatgaaaaatgctgtg

SEQ ID NO: 24065 - DNA, 20 bp, Unknown
  RNA secondary structure sequence
tatcagcggcactcctgact

SEQ ID NO: 24066 - DNA, 20 bp, Unknown
  RNA secondary structure sequence
ggaaccttgtcactatgaag

SEQ ID NO: 24067 - DNA, 20 bp, Unknown
  RNA secondary structure sequence
accatgacaaggaccaccca

SEQ ID NO: 24068 - DNA, 20 bp, Unknown
  RNA secondary structure sequence
ctggcacagatgggaagacc

SEQ ID NO: 24069 - DNA, 20 bp, Unknown
  RNA secondary structure sequence
tgagagccattattggccag

SEQ ID NO: 24070 - DNA, 20 bp, Unknown
  RNA secondary structure sequence
tcagaaccgtttcggagagg

SEQ ID NO: 24071 - DNA, 20 bp, Unknown
  RNA secondary structure sequence
aaggactagaggttagagga

SEQ ID NO: 24072 - DNA, 20 bp, Unknown
  RNA secondary structure sequence
tacaagaggacttcatttga

SEQ ID NO: 24073 - DNA, 20 bp, Unknown
  RNA secondary structure sequence
tcaagtgcaatccaatcaaa

SEQ ID NO: 24074 - DNA, 20 bp, Unknown
  RNA secondary structure sequence
agctggtgttccaaccacca

SEQ ID NO: 24075 - DNA, 20 bp, Unknown
  RNA secondary structure sequence
tgatgtagagtttttcttct

SEQ ID NO: 24076 - DNA, 20 bp, Unknown
  RNA secondary structure sequence
tctggagccgctagaagaga

SEQ ID NO: 24077 - DNA, 20 bp, Unknown
  RNA secondary structure sequence
gaaaatacttgagtcaaaga

SEQ ID NO: 24078 - DNA, 20 bp, Unknown
  RNA secondary structure sequence
gttgactggttacagaaggg

SEQ ID NO: 24079 - DNA, 20 bp, Unknown
  RNA secondary structure sequence
gcatgaccaacgcatcattg

SEQ ID NO: 24080 - DNA, 20 bp, Unknown
  RNA secondary structure sequence
actctggccaacatctgagc

SEQ ID NO: 24081 - DNA, 20 bp, Unknown
  RNA secondary structure sequence
aacttcacttcaaccatcgg

SEQ ID NO: 24082 - DNA, 20 bp, Unknown
  RNA secondary structure sequence
tctggtcttggacacctaca

SEQ ID NO: 24083 - DNA, 20 bp, Unknown
  RNA secondary structure sequence
gccaaagaaaatctgggagg

SEQ ID NO: 24084 - DNA, 20 bp, Unknown
  RNA secondary structure sequence
atagcccctcctaatgaggt

SEQ ID NO: 24085 - DNA, 20 bp, Unknown
  RNA secondary structure sequence
atgcacaaacgcagtataga

SEQ ID NO: 24086 - DNA, 20 bp, Unknown
  RNA secondary structure sequence
ctgactttccatatgctcca

SEQ ID NO: 24087 - DNA, 20 bp, Unknown
  RNA secondary structure sequence
atcgacaatcatccccaggt

SEQ ID NO: 24088 - DNA, 20 bp, Unknown
  RNA secondary structure sequence
ttgacacgctcaaggatgag

SEQ ID NO: 24089 - DNA, 20 bp, Unknown
  RNA secondary structure sequence
aaaacgtttctcttctggtt

SEQ ID NO: 24090 - DNA, 20 bp, Unknown
  RNA secondary structure sequence
ctcgcgtcgctcttccaatt

SEQ ID NO: 24091 - DNA, 20 bp, Unknown
  RNA secondary structure sequence
ataaagtagataaggcaaga

SEQ ID NO: 24092 - DNA, 20 bp, Unknown
  RNA secondary structure sequence
atagtgtagctttagctttg

SEQ ID NO: 24093 - DNA, 20 bp, Unknown
  RNA secondary structure sequence
acgataaagtggataccgca

SEQ ID NO: 24094 - DNA, 20 bp, Unknown
  RNA secondary structure sequence
ccaatgaagcatcaggaaac

SEQ ID NO: 24095 - DNA, 20 bp, Unknown
  RNA secondary structure sequence
ggtattaaatatgttgcaca

SEQ ID NO: 24096 - DNA, 20 bp, Unknown
  RNA secondary structure sequence
gtaggttgtaaatctattgt

SEQ ID NO: 24097 - DNA, 20 bp, Unknown
  RNA secondary structure sequence
tcatcttatgagtattgtca

SEQ ID NO: 24098 - DNA, 20 bp, Unknown
  RNA secondary structure sequence
ttaaactcttgtaaagagca

SEQ ID NO: 24099 - DNA, 20 bp, Unknown
  RNA secondary structure sequence
gaagatgttgttactggtga

SEQ ID NO: 24100 - DNA, 20 bp, Unknown
  RNA secondary structure sequence
gtagatgatattgaaagtat

SEQ ID NO: 24101 - DNA, 20 bp, Unknown
  RNA secondary structure sequence
acattacatttttcattatt

SEQ ID NO: 24102 - DNA, 20 bp, Unknown
  RNA secondary structure sequence
ggagttgcaaaagctatagc

SEQ ID NO: 24103 - DNA, 20 bp, Unknown
  RNA secondary structure sequence
cttcgtcatgatatacaatt

SEQ ID NO: 24104 - DNA, 20 bp, Unknown
  RNA secondary structure sequence
cattttaaatttgatgaacc

SEQ ID NO: 24105 - DNA, 20 bp, Unknown
  RNA secondary structure sequence
gatctttttaatggttataa

SEQ ID NO: 24106 - DNA, 20 bp, Unknown
  RNA secondary structure sequence
ttgaaatgtggttcacctta

SEQ ID NO: 24107 - DNA, 20 bp, Unknown
  RNA secondary structure sequence
agaattgttatgtggataaa

SEQ ID NO: 24108 - DNA, 20 bp, Unknown
  RNA secondary structure sequence
gaagtagatagacgtgtttt

SEQ ID NO: 24109 - DNA, 20 bp, Unknown
  RNA secondary structure sequence
tttgctagtgatagtgttca

SEQ ID NO: 24110 - DNA, 20 bp, Unknown
  RNA secondary structure sequence
tgggttttgaataatgatta

SEQ ID NO: 24111 - DNA, 20 bp, Unknown
  RNA secondary structure sequence
gacaaagtttattgtcctcg

SEQ ID NO: 24112 - DNA, 20 bp, Unknown
  RNA secondary structure sequence
tttagttgtataatttctgc

SEQ ID NO: 24113 - DNA, 20 bp, Unknown
  RNA secondary structure sequence
tatgtaaattatttagttgt

SEQ ID NO: 24114 - DNA, 20 bp, Unknown
  RNA secondary structure sequence
gaacgtgataaagctgtagc

SEQ ID NO: 24115 - DNA, 20 bp, Unknown
  RNA secondary structure sequence
gataatgctgttaaaggttg

SEQ ID NO: 24116 - DNA, 20 bp, Unknown
  RNA secondary structure sequence
gtttgtctcttaaagattta

SEQ ID NO: 24117 - DNA, 20 bp, Unknown
  RNA secondary structure sequence
ctagtaagggttatatagct

SEQ ID NO: 24118 - DNA, 20 bp, Unknown
  RNA secondary structure sequence
ctttgcgttgtggcagttgt

SEQ ID NO: 24119 - DNA, 20 bp, Unknown
  RNA secondary structure sequence
gtttaaagttatttgctgca

SEQ ID NO: 24120 - DNA, 20 bp, Unknown
  RNA secondary structure sequence
tagtttatactgctgctagt

SEQ ID NO: 24121 - DNA, 20 bp, Unknown
  RNA secondary structure sequence
agagagtctctttatggaat

SEQ ID NO: 24122 - DNA, 20 bp, Unknown
  RNA secondary structure sequence
ttttatcgtgccttatattc

SEQ ID NO: 24123 - DNA, 20 bp, Unknown
  RNA secondary structure sequence
ataattttgatgaatctaag

SEQ ID NO: 24124 - DNA, 20 bp, Unknown
  RNA secondary structure sequence
gtcataaaccaccttctgct

SEQ ID NO: 24125 - DNA, 20 bp, Unknown
  RNA secondary structure sequence
attgtgcagggttcggtgtt

SEQ ID NO: 24126 - DNA, 20 bp, Unknown
  RNA secondary structure sequence
agtatggcactttttgtgat

SEQ ID NO: 24127 - DNA, 20 bp, Unknown
  RNA secondary structure sequence
ctcctattttgtctgaatct

SEQ ID NO: 24128 - DNA, 20 bp, Unknown
  RNA secondary structure sequence
ttaatttttgtggtaatggt

SEQ ID NO: 24129 - DNA, 20 bp, Unknown
  RNA secondary structure sequence
ttggtgtcgcaagtttggca

SEQ ID NO: 24130 - DNA, 20 bp, Unknown
  RNA secondary structure sequence
ttgtgccattacaacaggca

SEQ ID NO: 24131 - DNA, 20 bp, Unknown
  RNA secondary structure sequence
caacgactgggccagcaacc

SEQ ID NO: 24132 - DNA, 20 bp, Unknown
  RNA secondary structure sequence
acatcaccaagattgtgtac

SEQ ID NO: 24133 - DNA, 20 bp, Unknown
  RNA secondary structure sequence
gcattgacgttgaccaaacc

SEQ ID NO: 24134 - DNA, 20 bp, Unknown
  RNA secondary structure sequence
agaatgaagggggtgggtac

SEQ ID NO: 24135 - DNA, 20 bp, Unknown
  RNA secondary structure sequence
ttggttccgtgggcggcttc

SEQ ID NO: 24136 - DNA, 20 bp, Unknown
  RNA secondary structure sequence
tggccacaggtggactcatc

SEQ ID NO: 24137 - DNA, 20 bp, Unknown
  RNA secondary structure sequence
ctgcagcgctcgtggaggca

SEQ ID NO: 24138 - DNA, 20 bp, Unknown
  RNA secondary structure sequence
tgcatgtcatggacttgcgt

SEQ ID NO: 24139 - DNA, 20 bp, Unknown
  RNA secondary structure sequence
tgcgcgtgaaacgagaacca

SEQ ID NO: 24140 - DNA, 20 bp, Unknown
  RNA secondary structure sequence
gtgcctggaacctgccaacc

SEQ ID NO: 24141 - DNA, 20 bp, Unknown
  RNA secondary structure sequence
atccaggtgcggggaagact

SEQ ID NO: 24142 - DNA, 20 bp, Unknown
  RNA secondary structure sequence
ggaataacatcaagcctgag

SEQ ID NO: 24143 - DNA, 20 bp, Unknown
  RNA secondary structure sequence
ggaaagaagcccaaatgctg

SEQ ID NO: 24144 - DNA, 20 bp, Unknown
  RNA secondary structure sequence
tggcatggcatgtggctaag

SEQ ID NO: 24145 - DNA, 20 bp, Unknown
  RNA secondary structure sequence
aggggcgtgacatccgagag

SEQ ID NO: 24146 - DNA, 20 bp, Unknown
  RNA secondary structure sequence
atggacatatggcgggggtt

SEQ ID NO: 24147 - DNA, 20 bp, Unknown
  RNA secondary structure sequence
aggctgacttaggccagctt

SEQ ID NO: 24148 - DNA, 20 bp, Unknown
  RNA secondary structure sequence
tggtcaacagtgccgtggtg

SEQ ID NO: 24149 - DNA, 20 bp, Unknown
  RNA secondary structure sequence
ccctggctgtgtccctcaac

SEQ ID NO: 24150 - DNA, 20 bp, Unknown
  RNA secondary structure sequence
gtggagagacaaacatgggg

SEQ ID NO: 24151 - DNA, 20 bp, Unknown
  RNA secondary structure sequence
ccatcggagggaaaggacac

SEQ ID NO: 24152 - DNA, 20 bp, Unknown
  RNA secondary structure sequence
gcagagtgatccagctcatg

SEQ ID NO: 24153 - DNA, 20 bp, Unknown
  RNA secondary structure sequence
tgtactacacgacgggggtt

SEQ ID NO: 24154 - DNA, 20 bp, Unknown
  RNA secondary structure sequence
tggaagagaggatcaacgcc

SEQ ID NO: 24155 - DNA, 20 bp, Unknown
  RNA secondary structure sequence
aaggtgagggcgtcattggg

SEQ ID NO: 24156 - DNA, 20 bp, Unknown
  RNA secondary structure sequence
acatggcgaaagtgagaaag

SEQ ID NO: 24157 - DNA, 20 bp, Unknown
  RNA secondary structure sequence
ctgactgggcacggcacata

SEQ ID NO: 24158 - DNA, 20 bp, Unknown
  RNA secondary structure sequence
ggccgagtgggatgcgtatg

SEQ ID NO: 24159 - DNA, 20 bp, Unknown
  RNA secondary structure sequence
taaaacaggaagaagaccct

SEQ ID NO: 24160 - DNA, 20 bp, Unknown
  RNA secondary structure sequence
cattttccttataattattt

SEQ ID NO: 24161 - DNA, 20 bp, Unknown
  RNA secondary structure sequence
caggattggctttttcaatt

SEQ ID NO: 24162 - DNA, 20 bp, Unknown
  RNA secondary structure sequence
acagacggctcttccaatgg

SEQ ID NO: 24163 - DNA, 20 bp, Unknown
  RNA secondary structure sequence
tatggtgtcaaccctcgagg

SEQ ID NO: 24164 - DNA, 20 bp, Unknown
  RNA secondary structure sequence
tggaaagatccacttaccaa

SEQ ID NO: 24165 - DNA, 20 bp, Unknown
  RNA secondary structure sequence
tgttttggttttgcaacatg

SEQ ID NO: 24166 - DNA, 20 bp, Unknown
  RNA secondary structure sequence
gttttgtgaaaaattacctg

SEQ ID NO: 24167 - DNA, 20 bp, Unknown
  RNA secondary structure sequence
ttgtagacttgttcctgacg

SEQ ID NO: 24168 - DNA, 20 bp, Unknown
  RNA secondary structure sequence
agtcaagccaaccgcggagg

SEQ ID NO: 24169 - DNA, 20 bp, Unknown
  RNA secondary structure sequence
agggtatggtacagagtgta

SEQ ID NO: 24170 - DNA, 20 bp, Unknown
  RNA secondary structure sequence
gtagaaaatattgatagatt

SEQ ID NO: 24171 - DNA, 20 bp, Unknown
  RNA secondary structure sequence
ccttcttcggaccaacaacc

SEQ ID NO: 24172 - DNA, 20 bp, Unknown
  RNA secondary structure sequence
gccatttggaaacgccctga

SEQ ID NO: 24173 - DNA, 20 bp, Unknown
  RNA secondary structure sequence
catcaaccatggtctgtccg

SEQ ID NO: 24174 - DNA, 20 bp, Unknown
  RNA secondary structure sequence
atatggactaaaattcctaa

SEQ ID NO: 24175 - DNA, 20 bp, Unknown
  RNA secondary structure sequence
tgcgccgcgcgatcaggagg

SEQ ID NO: 24176 - DNA, 20 bp, Unknown
  RNA secondary structure sequence
taagtacgtagatactagcc

SEQ ID NO: 24177 - DNA, 20 bp, Unknown
  RNA secondary structure sequence
cgtcaacatggtggcataca

SEQ ID NO: 24178 - DNA, 20 bp, Unknown
  RNA secondary structure sequence
ggctgttgacagcactacca

SEQ ID NO: 24179 - DNA, 20 bp, Unknown
  RNA secondary structure sequence
attggaccatccttacgggt

SEQ ID NO: 24180 - DNA, 20 bp, Unknown
  RNA secondary structure sequence
tgcaggtctatcaaccacta

SEQ ID NO: 24181 - DNA, 20 bp, Unknown
  RNA secondary structure sequence
gccagagtgtagccaaagag

SEQ ID NO: 24182 - DNA, 20 bp, Unknown
  RNA secondary structure sequence
agacgttggtgcatagggtg

SEQ ID NO: 24183 - DNA, 20 bp, Unknown
  RNA secondary structure sequence
agtatgtgagcaaacaagac

SEQ ID NO: 24184 - DNA, 20 bp, Unknown
  RNA secondary structure sequence
atctatccatcattgagaat

SEQ ID NO: 24185 - DNA, 20 bp, Unknown
  RNA secondary structure sequence
ttgcagtatgatggtgatct

SEQ ID NO: 24186 - DNA, 20 bp, Unknown
  RNA secondary structure sequence
cccaactcaatccgattgat

SEQ ID NO: 24187 - DNA, 20 bp, Unknown
  RNA secondary structure sequence
ggcgggcaattgcaacaccc

SEQ ID NO: 24188 - DNA, 20 bp, Unknown
  RNA secondary structure sequence
tcaatatgctgagtacagtc

SEQ ID NO: 24189 - DNA, 20 bp, Unknown
  RNA secondary structure sequence
gcaaactagttggaatcaat

SEQ ID NO: 24190 - DNA, 20 bp, Unknown
  RNA secondary structure sequence
aggcaggactgttggtttca

SEQ ID NO: 24191 - DNA, 20 bp, Unknown
  RNA secondary structure sequence
gtcatgagggggaggggata

SEQ ID NO: 24192 - DNA, 20 bp, Unknown
  RNA secondary structure sequence
ctgttttcaacagtctatat

SEQ ID NO: 24193 - DNA, 20 bp, Unknown
  RNA secondary structure sequence
aaacagcagcacaaagagca

SEQ ID NO: 24194 - DNA, 20 bp, Unknown
  RNA secondary structure sequence
tggtgtttggatcgggagaa

SEQ ID NO: 24195 - DNA, 20 bp, Unknown
  RNA secondary structure sequence
aatttggactagtgggagca

SEQ ID NO: 24196 - DNA, 20 bp, Unknown
  RNA secondary structure sequence
ttatagagggaggatggcag

SEQ ID NO: 24197 - DNA, 20 bp, Unknown
  RNA secondary structure sequence
agcttagggataatgcaaag

SEQ ID NO: 24198 - DNA, 20 bp, Unknown
  RNA secondary structure sequence
ggtgcacttgccagttgtat

SEQ ID NO: 24199 - DNA, 20 bp, Unknown
  RNA secondary structure sequence
agagggccttctacggaagg

SEQ ID NO: 24200 - DNA, 20 bp, Unknown
  RNA secondary structure sequence
ctcaacaggtggaatatgcg

SEQ ID NO: 24201 - DNA, 20 bp, Unknown
  RNA secondary structure sequence
gggtttcatagaaaatggtt

SEQ ID NO: 24202 - DNA, 20 bp, Unknown
  RNA secondary structure sequence
gaagcaactgagggaaaatg

SEQ ID NO: 24203 - DNA, 20 bp, Unknown
  RNA secondary structure sequence
tgcgaccctgacaagtgtta

SEQ ID NO: 24204 - DNA, 20 bp, Unknown
  RNA secondary structure sequence
gtaatgactgatgggagtgc

SEQ ID NO: 24205 - DNA, 20 bp, Unknown
  RNA secondary structure sequence
cgaacggctgcattgagggc

SEQ ID NO: 24206 - DNA, 20 bp, Unknown
  RNA secondary structure sequence
tcccaaggactaaaaacatg

SEQ ID NO: 24207 - DNA, 20 bp, Unknown
  RNA secondary structure sequence
cccaactcaacccaattgat

SEQ ID NO: 24208 - DNA, 20 bp, Unknown
  RNA secondary structure sequence
tcaacatgctaagtacggtt

SEQ ID NO: 24209 - DNA, 20 bp, Unknown
  RNA secondary structure sequence
gtagttcatataggagaccg

SEQ ID NO: 24210 - DNA, 20 bp, Unknown
  RNA secondary structure sequence
cagaatcgcaattaacaata

SEQ ID NO: 24211 - DNA, 20 bp, Unknown
  RNA secondary structure sequence
caagcacagagatgtcaatg

SEQ ID NO: 24212 - DNA, 20 bp, Unknown
  RNA secondary structure sequence
acagaagatacggaccagca

SEQ ID NO: 24213 - DNA, 20 bp, Unknown
  RNA secondary structure sequence
accaaatgccaaactccttt

SEQ ID NO: 24214 - DNA, 20 bp, Unknown
  RNA secondary structure sequence
gtagcaggttctctgtcact

SEQ ID NO: 24215 - DNA, 20 bp, Unknown
  RNA secondary structure sequence
gcaaggagacgtggtgttgg

SEQ ID NO: 24216 - DNA, 20 bp, Unknown
  RNA secondary structure sequence
acgagagaaggaataaatat

SEQ ID NO: 24217 - DNA, 20 bp, Unknown
  RNA secondary structure sequence
cagctgggctgactcacatg

SEQ ID NO: 24218 - DNA, 20 bp, Unknown
  RNA secondary structure sequence
ggaacccaggaaatgctgag

SEQ ID NO: 24219 - DNA, 20 bp, Unknown
  RNA secondary structure sequence
catggttgcatgtttgtgtc

SEQ ID NO: 24220 - DNA, 20 bp, Unknown
  RNA secondary structure sequence
cttcaggaagagccgatact

SEQ ID NO: 24221 - DNA, 20 bp, Unknown
  RNA secondary structure sequence
ggtgcttttatgtggagttg

SEQ ID NO: 24222 - DNA, 20 bp, Unknown
  RNA secondary structure sequence
aagatatcaccattgattta

SEQ ID NO: 24223 - DNA, 20 bp, Unknown
  RNA secondary structure sequence
taaaagaaatggctgcacat

SEQ ID NO: 24224 - DNA, 20 bp, Unknown
  RNA secondary structure sequence
catatcctttagactataaa

SEQ ID NO: 24225 - DNA, 20 bp, Unknown
  RNA secondary structure sequence
ttcgggatactccaatcata

SEQ ID NO: 24226 - DNA, 20 bp, Unknown
  RNA secondary structure sequence
cgataatgtcaatatggaaa

SEQ ID NO: 24227 - DNA, 20 bp, Unknown
  RNA secondary structure sequence
ttttatcgctcaacattcat

SEQ ID NO: 24228 - DNA, 20 bp, Unknown
  RNA secondary structure sequence
agggctaaacatcttctatg

SEQ ID NO: 24229 - DNA, 20 bp, Unknown
  RNA secondary structure sequence
tacattctcctacaacatac

SEQ ID NO: 24230 - DNA, 20 bp, Unknown
  RNA secondary structure sequence
gcggccaagcaagaagagag

SEQ ID NO: 24231 - DNA, 20 bp, Unknown
  RNA secondary structure sequence
cattgtgagggctctagatg

SEQ ID NO: 24232 - DNA, 20 bp, Unknown
  RNA secondary structure sequence
ggacttcaaggtgatgaaga

SEQ ID NO: 24233 - DNA, 20 bp, Unknown
  RNA secondary structure sequence
cggatggggtaacggatgtg

SEQ ID NO: 24234 - DNA, 20 bp, Unknown
  RNA secondary structure sequence
ggactggtttcacgacttga

SEQ ID NO: 24235 - DNA, 20 bp, Unknown
  RNA secondary structure sequence
tgttagcagctcaaccctaa

SEQ ID NO: 24236 - DNA, 20 bp, Unknown
  RNA secondary structure sequence
aagcaacggaccctgccgag

SEQ ID NO: 24237 - DNA, 20 bp, Unknown
  RNA secondary structure sequence
caccacccagattaactacc

SEQ ID NO: 24238 - DNA, 20 bp, Unknown
  RNA secondary structure sequence
atgcgattcggcaatcatcg

SEQ ID NO: 24239 - DNA, 20 bp, Unknown
  RNA secondary structure sequence
gggagcgtcgctgcgcacaa

SEQ ID NO: 24240 - DNA, 20 bp, Unknown
  RNA secondary structure sequence
tggagttgcaggagggatgg

SEQ ID NO: 24241 - DNA, 20 bp, Unknown
  RNA secondary structure sequence
ggcggccaatgacttgaagc

SEQ ID NO: 24242 - DNA, 20 bp, Unknown
  RNA secondary structure sequence
gttgataattgggattgtaa

SEQ ID NO: 24243 - DNA, 20 bp, Unknown
  RNA secondary structure sequence
gttttggctacttggcaaac

SEQ ID NO: 24244 - DNA, 20 bp, Unknown
  RNA secondary structure sequence
ccaggttccggataaggcgt

SEQ ID NO: 24245 - DNA, 20 bp, Unknown
  RNA secondary structure sequence
agcacagcgcagaggccgca

SEQ ID NO: 24246 - DNA, 20 bp, Unknown
  RNA secondary structure sequence
gcgagataaggttttcacca

SEQ ID NO: 24247 - DNA, 20 bp, Unknown
  RNA secondary structure sequence
cacaatcctggaagacaaca

SEQ ID NO: 24248 - DNA, 20 bp, Unknown
  RNA secondary structure sequence
tagaatgccaaatcacttct

SEQ ID NO: 24249 - DNA, 20 bp, Unknown
  RNA secondary structure sequence
tatggatctatcggtgccat

SEQ ID NO: 24250 - DNA, 20 bp, Unknown
  RNA secondary structure sequence
agagatctggaagtcaagac

SEQ ID NO: 24251 - DNA, 20 bp, Unknown
  RNA secondary structure sequence
aagaggattcgtcaaaccca

SEQ ID NO: 24252 - DNA, 20 bp, Unknown
  RNA secondary structure sequence
taaaacctacatggatgtca

SEQ ID NO: 24253 - DNA, 20 bp, Unknown
  RNA secondary structure sequence
agcggtcgagtggctgagga

SEQ ID NO: 24254 - DNA, 20 bp, Unknown
  RNA secondary structure sequence
gcacaactggcaagaggtgc

SEQ ID NO: 24255 - DNA, 20 bp, Unknown
  RNA secondary structure sequence
gtatctagaccagcgcatgc

SEQ ID NO: 24256 - DNA, 20 bp, Unknown
  RNA secondary structure sequence
gagagcgaaggacagcgaag

SEQ ID NO: 24257 - DNA, 20 bp, Unknown
  RNA secondary structure sequence
gaaggagggtggggtcccta

SEQ ID NO: 24258 - DNA, 20 bp, Unknown
  RNA secondary structure sequence
aaagggagaagtgcacctgg

SEQ ID NO: 24259 - DNA, 20 bp, Unknown
  RNA secondary structure sequence
cctacagttgcaaaccctga

SEQ ID NO: 24260 - DNA, 20 bp, Unknown
  RNA secondary structure sequence
acagtacccccaggcttatc

SEQ ID NO: 24261 - DNA, 20 bp, Unknown
  RNA secondary structure sequence
tgaggtccaacgttactctg

SEQ ID NO: 24262 - DNA, 20 bp, Unknown
  RNA secondary structure sequence
tgggagggtgcttctcctac

SEQ ID NO: 24263 - DNA, 20 bp, Unknown
  RNA secondary structure sequence
ggttcactgcaccatgaacg

SEQ ID NO: 24264 - DNA, 20 bp, Unknown
  RNA secondary structure sequence
ggcccctgactcatcacccc

SEQ ID NO: 24265 - DNA, 20 bp, Unknown
  RNA secondary structure sequence
aggccaacttcctgtttacc

SEQ ID NO: 24266 - DNA, 20 bp, Unknown
  RNA secondary structure sequence
tcaagacttccgagctgtca

SEQ ID NO: 24267 - DNA, 20 bp, Unknown
  RNA secondary structure sequence
gcccaccacagtctccggac

SEQ ID NO: 24268 - DNA, 20 bp, Unknown
  RNA secondary structure sequence
atgtaaaggccaccaggtat

SEQ ID NO: 24269 - DNA, 20 bp, Unknown
  RNA secondary structure sequence
actgatggccatgaggtcct

SEQ ID NO: 24270 - DNA, 20 bp, Unknown
  RNA secondary structure sequence
caaaggtaaatcaggcgcac

SEQ ID NO: 24271 - DNA, 20 bp, Unknown
  RNA secondary structure sequence
aggatggaggaaggtcctaa

SEQ ID NO: 24272 - DNA, 20 bp, Unknown
  RNA secondary structure sequence
taggactctgaatggtaaaa

SEQ ID NO: 24273 - DNA, 20 bp, Unknown
  RNA secondary structure sequence
cctcaaggtagtctcacaca

SEQ ID NO: 24274 - DNA, 20 bp, Unknown
  RNA secondary structure sequence
tgatcaagtcaaagcagaga

SEQ ID NO: 24275 - DNA, 20 bp, Unknown
  RNA secondary structure sequence
tcgcgctgttgtctcacaac

SEQ ID NO: 24276 - DNA, 20 bp, Unknown
  RNA secondary structure sequence
tgaaatcattcgagcaggaa

SEQ ID NO: 24277 - DNA, 20 bp, Unknown
  RNA secondary structure sequence
ggctgttggggtgtataaga

SEQ ID NO: 24278 - DNA, 20 bp, Unknown
  RNA secondary structure sequence
tgtgaaagcgacaggacaag

SEQ ID NO: 24279 - DNA, 20 bp, Unknown
  RNA secondary structure sequence
ggcaggaccacctgtctatg

SEQ ID NO: 24280 - DNA, 20 bp, Unknown
  RNA secondary structure sequence
ttcgcaactagattctggct

SEQ ID NO: 24281 - DNA, 20 bp, Unknown
  RNA secondary structure sequence
tccgttccctagcacaaatc

SEQ ID NO: 24282 - DNA, 20 bp, Unknown
  RNA secondary structure sequence
tcattaccgactggaaaagt

SEQ ID NO: 24283 - DNA, 20 bp, Unknown
  RNA secondary structure sequence
tcaacgagaacatgatgata

SEQ ID NO: 24284 - DNA, 20 bp, Unknown
  RNA secondary structure sequence
atcttcaaaattgacttcac

SEQ ID NO: 24285 - DNA, 20 bp, Unknown
  RNA secondary structure sequence
gagtagcgtagagtgggctt

SEQ ID NO: 24286 - DNA, 20 bp, Unknown
  RNA secondary structure sequence
accgacgcagtgacagaaat

SEQ ID NO: 24287 - DNA, 20 bp, Unknown
  RNA secondary structure sequence
tctgtgttgacgactatgta

SEQ ID NO: 24288 - DNA, 20 bp, Unknown
  RNA secondary structure sequence
ctcacaagactgacctcgtt

SEQ ID NO: 24289 - DNA, 20 bp, Unknown
  RNA secondary structure sequence
cagacaatcaacatctcaat

SEQ ID NO: 24290 - DNA, 20 bp, Unknown
  RNA secondary structure sequence
cagacagccggctcgggcga

SEQ ID NO: 24291 - DNA, 20 bp, Unknown
  RNA secondary structure sequence
atggcgcagtccgctgctgc

SEQ ID NO: 24292 - DNA, 20 bp, Unknown
  RNA secondary structure sequence
acagtctcagattgcgcttt

SEQ ID NO: 24293 - DNA, 20 bp, Unknown
  RNA secondary structure sequence
gggggcagcccttagctaac

SEQ ID NO: 24294 - DNA, 20 bp, Unknown
  RNA secondary structure sequence
cgactgagcagtccacccca

SEQ ID NO: 24295 - DNA, 20 bp, Unknown
  RNA secondary structure sequence
cccagccagcgccggcgcag

SEQ ID NO: 24296 - DNA, 20 bp, Unknown
  RNA secondary structure sequence
tgcctctccgtttctgactt

SEQ ID NO: 24297 - DNA, 20 bp, Unknown
  RNA secondary structure sequence
accatgtcctcggaggcctt

SEQ ID NO: 24298 - DNA, 20 bp, Unknown
  RNA secondary structure sequence
cctataggcctggagctcct

SEQ ID NO: 24299 - DNA, 20 bp, Unknown
  RNA secondary structure sequence
aaaggaaattaatgagacag

SEQ ID NO: 24300 - DNA, 20 bp, Unknown
  RNA secondary structure sequence
cgaggtatggcagatatgct

SEQ ID NO: 24301 - DNA, 20 bp, Unknown
  RNA secondary structure sequence
tcaggttgcctctgtggatt

SEQ ID NO: 24302 - DNA, 20 bp, Unknown
  RNA secondary structure sequence
agctggtatggcatgcatgc

SEQ ID NO: 24303 - DNA, 20 bp, Unknown
  RNA secondary structure sequence
accatgctctggtgtaatga

SEQ ID NO: 24304 - DNA, 20 bp, Unknown
  RNA secondary structure sequence
cactaattcagccattgcca

SEQ ID NO: 24305 - DNA, 20 bp, Unknown
  RNA secondary structure sequence
gaatccaccacaggagccaa

SEQ ID NO: 24306 - DNA, 20 bp, Unknown
  RNA secondary structure sequence
tcggttctttgcctattttt

SEQ ID NO: 24307 - DNA, 20 bp, Unknown
  RNA secondary structure sequence
gacaattgacgttgagggga

SEQ ID NO: 24308 - DNA, 20 bp, Unknown
  RNA secondary structure sequence
tattttgattttgaaccgag

SEQ ID NO: 24309 - DNA, 20 bp, Unknown
  RNA secondary structure sequence
tgagtttgtctctcatttgc

SEQ ID NO: 24310 - DNA, 20 bp, Unknown
  RNA secondary structure sequence
taaagaaatagccaaattaa

SEQ ID NO: 24311 - DNA, 20 bp, Unknown
  RNA secondary structure sequence
tccaaaagcaagtgtagagg

SEQ ID NO: 24312 - DNA, 20 bp, Unknown
  RNA secondary structure sequence
tttggatgtggcaacagcca

SEQ ID NO: 24313 - DNA, 20 bp, Unknown
  RNA secondary structure sequence
cattgaaaaactagaaactg

SEQ ID NO: 24314 - DNA, 20 bp, Unknown
  RNA secondary structure sequence
ccagtatatggtgcaagatg

SEQ ID NO: 24315 - DNA, 20 bp, Unknown
  RNA secondary structure sequence
tgtgagtagtgatgttatac

SEQ ID NO: 24316 - DNA, 20 bp, Unknown
  RNA secondary structure sequence
aaacctccaaccttataatt

SEQ ID NO: 24317 - DNA, 20 bp, Unknown
  RNA secondary structure sequence
atggcaggtagaaggaggga

SEQ ID NO: 24318 - DNA, 20 bp, Unknown
  RNA secondary structure sequence
ggaagggaagatacagtggt

SEQ ID NO: 24319 - DNA, 20 bp, Unknown
  RNA secondary structure sequence
agcacatctcagccggtctc

SEQ ID NO: 24320 - DNA, 20 bp, Unknown
  RNA secondary structure sequence
attgatcgacgcttgcgctc

SEQ ID NO: 24321 - DNA, 20 bp, Unknown
  RNA secondary structure sequence
tggatgcgtgaattgctcgc

SEQ ID NO: 24322 - DNA, 20 bp, Unknown
  RNA secondary structure sequence
gaagttttggtgaaaaacat

SEQ ID NO: 24323 - DNA, 20 bp, Unknown
  RNA secondary structure sequence
ttcggatacgacggagtggt

SEQ ID NO: 24324 - DNA, 20 bp, Unknown
  RNA secondary structure sequence
ccgacccgggaacattcagt

SEQ ID NO: 24325 - DNA, 20 bp, Unknown
  RNA secondary structure sequence
ctggccggatcgtttgtgaa

SEQ ID NO: 24326 - DNA, 20 bp, Unknown
  RNA secondary structure sequence
atgacatcaatgttcgggac

SEQ ID NO: 24327 - DNA, 20 bp, Unknown
  RNA secondary structure sequence
gtactgctgaactatgttgt

SEQ ID NO: 24328 - DNA, 20 bp, Unknown
  RNA secondary structure sequence
gggttgtacgtgctctcaac

SEQ ID NO: 24329 - DNA, 20 bp, Unknown
  RNA secondary structure sequence
acaacacttccgtctggatt

SEQ ID NO: 24330 - DNA, 20 bp, Unknown
  RNA secondary structure sequence
aacgcgcccgagtggctacc

SEQ ID NO: 24331 - DNA, 20 bp, Unknown
  RNA secondary structure sequence
attgacagcattcgattctc

SEQ ID NO: 24332 - DNA, 20 bp, Unknown
  RNA secondary structure sequence
cgcaagcaggagacacagtt

SEQ ID NO: 24333 - DNA, 20 bp, Unknown
  RNA secondary structure sequence
gcgcctgaaagtcgaccccg

SEQ ID NO: 24334 - DNA, 20 bp, Unknown
  RNA secondary structure sequence
attgagattctccatgaaat

SEQ ID NO: 24335 - DNA, 20 bp, Unknown
  RNA secondary structure sequence
acaactgcacaacaaagccc

SEQ ID NO: 24336 - DNA, 20 bp, Unknown
  RNA secondary structure sequence
agcgctaataacgtgcaccg

SEQ ID NO: 24337 - DNA, 20 bp, Unknown
  RNA secondary structure sequence
atcggaggcatccagctcgc

SEQ ID NO: 24338 - DNA, 20 bp, Unknown
  RNA secondary structure sequence
aagacagacgcttgcggact

SEQ ID NO: 24339 - DNA, 20 bp, Unknown
  RNA secondary structure sequence
gtgtacgcgactgagccgcg

SEQ ID NO: 24340 - DNA, 20 bp, Unknown
  RNA secondary structure sequence
aatgacccggtgcagcagga

SEQ ID NO: 24341 - DNA, 20 bp, Unknown
  RNA secondary structure sequence
aactaccacgggtcatttgt

SEQ ID NO: 24342 - DNA, 20 bp, Unknown
  RNA secondary structure sequence
ttgagtggaatggtcgtggc

SEQ ID NO: 24343 - DNA, 20 bp, Unknown
  RNA secondary structure sequence
taccatcctctcgtgctgca

SEQ ID NO: 24344 - DNA, 20 bp, Unknown
  RNA secondary structure sequence
ccagtgaagacatggtcaga

SEQ ID NO: 24345 - DNA, 20 bp, Unknown
  RNA secondary structure sequence
ttgcggatacttgggcgata

SEQ ID NO: 24346 - DNA, 20 bp, Unknown
  RNA secondary structure sequence
aggttatgggagaataaccc

SEQ ID NO: 24347 - DNA, 20 bp, Unknown
  RNA secondary structure sequence
cccgcgacgctcgagaaggt

SEQ ID NO: 24348 - DNA, 20 bp, Unknown
  RNA secondary structure sequence
ttcagctgactggaagagaa

SEQ ID NO: 24349 - DNA, 20 bp, Unknown
  RNA secondary structure sequence
ggccactgacctgccactgc

SEQ ID NO: 24350 - DNA, 20 bp, Unknown
  RNA secondary structure sequence
ccgatggcaccagcctggga

SEQ ID NO: 24351 - DNA, 20 bp, Unknown
  RNA secondary structure sequence
attcggaggggttaattgga

SEQ ID NO: 24352 - DNA, 20 bp, Unknown
  RNA secondary structure sequence
gaaggagctgaaatgcggtg

SEQ ID NO: 24353 - DNA, 20 bp, Unknown
  RNA secondary structure sequence
aatcggattcctagactgga

SEQ ID NO: 24354 - DNA, 20 bp, Unknown
  RNA secondary structure sequence
cgcaattttgcaaaagcggg

SEQ ID NO: 24355 - DNA, 20 bp, Unknown
  RNA secondary structure sequence
cgtgacaacaacgcctggag

SEQ ID NO: 24356 - DNA, 20 bp, Unknown
  RNA secondary structure sequence
cgctcaggctgactcatgtg

SEQ ID NO: 24357 - DNA, 20 bp, Unknown
  RNA secondary structure sequence
caaggtggtgctgacagaga

SEQ ID NO: 24358 - DNA, 20 bp, Unknown
  RNA secondary structure sequence
agggctcatgaaggacaact

SEQ ID NO: 24359 - DNA, 20 bp, Unknown
  RNA secondary structure sequence
gctcgctccaaagggaacgt

SEQ ID NO: 24360 - DNA, 20 bp, Unknown
  RNA secondary structure sequence
ggataactacttggcatatt

SEQ ID NO: 24361 - DNA, 20 bp, Unknown
  RNA secondary structure sequence
atgggcagtttatgcctttg

SEQ ID NO: 24362 - DNA, 20 bp, Unknown
  RNA secondary structure sequence
gccggtttggaacacgcaag

SEQ ID NO: 24363 - DNA, 20 bp, Unknown
  RNA secondary structure sequence
taaaaaacagtttgagtcct

SEQ ID NO: 24364 - DNA, 20 bp, Unknown
  RNA secondary structure sequence
cctggagtttgaagccctag

SEQ ID NO: 24365 - DNA, 20 bp, Unknown
  RNA secondary structure sequence
cctgaggctcatggcaaacg

SEQ ID NO: 24366 - DNA, 20 bp, Unknown
  RNA secondary structure sequence
attgtccggacgcaggaaaa

SEQ ID NO: 24367 - DNA, 20 bp, Unknown
  RNA secondary structure sequence
caataccttggaagccggaa

SEQ ID NO: 24368 - DNA, 20 bp, Unknown
  RNA secondary structure sequence
agtagtcatcgccatactgc

SEQ ID NO: 24369 - DNA, 20 bp, Unknown
  RNA secondary structure sequence
gtggctcagttcaattgtgg

SEQ ID NO: 24370 - DNA, 20 bp, Unknown
  RNA secondary structure sequence
gggcaacggctgtggtcttt

SEQ ID NO: 24371 - DNA, 20 bp, Unknown
  RNA secondary structure sequence
caagtttgttcccacaacag

SEQ ID NO: 24372 - DNA, 20 bp, Unknown
  RNA secondary structure sequence
atcagattcgatggctggca

SEQ ID NO: 24373 - DNA, 20 bp, Unknown
  RNA secondary structure sequence
tggaatgtttgtcttcaaag

SEQ ID NO: 24374 - DNA, 20 bp, Unknown
  RNA secondary structure sequence
tataattgacggaaagagca

SEQ ID NO: 24375 - DNA, 20 bp, Unknown
  RNA secondary structure sequence
cgggcccgttagccgccaca

SEQ ID NO: 24376 - DNA, 20 bp, Unknown
  RNA secondary structure sequence
cctcatgctttttctttgta

SEQ ID NO: 24377 - DNA, 20 bp, Unknown
  RNA secondary structure sequence
aggagatgtgacacacctgg

SEQ ID NO: 24378 - DNA, 20 bp, Unknown
  RNA secondary structure sequence
gctgaatgcagctggcatgt

SEQ ID NO: 24379 - DNA, 20 bp, Unknown
  RNA secondary structure sequence
cagcgtctcaacaagaaagt

SEQ ID NO: 24380 - DNA, 20 bp, Unknown
  RNA secondary structure sequence
gaaggaagccatgcctaaaa

SEQ ID NO: 24381 - DNA, 20 bp, Unknown
  RNA secondary structure sequence
ggacccagctagcattgccg

SEQ ID NO: 24382 - DNA, 20 bp, Unknown
  RNA secondary structure sequence
cagccgcatgtcgatggcaa

SEQ ID NO: 24383 - DNA, 20 bp, Unknown
  RNA secondary structure sequence
tctgcttgttggagtgatga

SEQ ID NO: 24384 - DNA, 20 bp, Unknown
  RNA secondary structure sequence
aacactgcttcccctgtttg

SEQ ID NO: 24385 - DNA, 20 bp, Unknown
  RNA secondary structure sequence
tgctgtagcattcactgggc

SEQ ID NO: 24386 - DNA, 20 bp, Unknown
  RNA secondary structure sequence
ctggagctattattcggctg

SEQ ID NO: 24387 - DNA, 20 bp, Unknown
  RNA secondary structure sequence
ttgtgacataggggaatcat

SEQ ID NO: 24388 - DNA, 20 bp, Unknown
  RNA secondary structure sequence
ttcatccatgctgaatggca

SEQ ID NO: 24389 - DNA, 20 bp, Unknown
  RNA secondary structure sequence
agttgtcaactcctggctgt

SEQ ID NO: 24390 - DNA, 20 bp, Unknown
  RNA secondary structure sequence
gcttgtggatgaagaacgga

SEQ ID NO: 24391 - DNA, 20 bp, Unknown
  RNA secondary structure sequence
gtcagcccgtcataatgacg

SEQ ID NO: 24392 - DNA, 20 bp, Unknown
  RNA secondary structure sequence
caattgtaccggttttacat

SEQ ID NO: 24393 - DNA, 20 bp, Unknown
  RNA secondary structure sequence
tagtacgaacagtcgaggaa

SEQ ID NO: 24394 - DNA, 20 bp, Unknown
  RNA secondary structure sequence
tattgatgtctgcatagata

SEQ ID NO: 24395 - DNA, 20 bp, Unknown
  RNA secondary structure sequence
tgagtttacgaaggaaggat

SEQ ID NO: 24396 - DNA, 20 bp, Unknown
  RNA secondary structure sequence
tttagatatgtgtttggaga

SEQ ID NO: 24397 - DNA, 20 bp, Unknown
  RNA secondary structure sequence
tgtcataaacttcagtgatg

SEQ ID NO: 24398 - DNA, 20 bp, Unknown
  RNA secondary structure sequence
acacaatacggaactcgctt

SEQ ID NO: 24399 - DNA, 20 bp, Unknown
  RNA secondary structure sequence
cctgcgatgtgatgttcagg

SEQ ID NO: 24400 - DNA, 20 bp, Unknown
  RNA secondary structure sequence
gcatgtcttgactggctatg

SEQ ID NO: 24401 - DNA, 20 bp, Unknown
  RNA secondary structure sequence
aggtccaccccagctacaag

SEQ ID NO: 24402 - DNA, 20 bp, Unknown
  RNA secondary structure sequence
tgaagggaaacccacactag

SEQ ID NO: 24403 - DNA, 20 bp, Unknown
  RNA secondary structure sequence
catcgtcattggggtcggag

SEQ ID NO: 24404 - DNA, 20 bp, Unknown
  RNA secondary structure sequence
aaggtcaaaagtctccgctg

SEQ ID NO: 24405 - DNA, 20 bp, Unknown
  RNA secondary structure sequence
ggcttgtttcttacacctcg

SEQ ID NO: 24406 - DNA, 20 bp, Unknown
  RNA secondary structure sequence
aactttcagaatggcagtgg

SEQ ID NO: 24407 - DNA, 20 bp, Unknown
  RNA secondary structure sequence
tgaaggggtgtttcacacca

SEQ ID NO: 24408 - DNA, 20 bp, Unknown
  RNA secondary structure sequence
cataacagacacagaagctc

SEQ ID NO: 24409 - DNA, 20 bp, Unknown
  RNA secondary structure sequence
agctcaattgtatggccctg

SEQ ID NO: 24410 - DNA, 20 bp, Unknown
  RNA secondary structure sequence
tgatggaccagacaacaatt

SEQ ID NO: 24411 - DNA, 20 bp, Unknown
  RNA secondary structure sequence
aggccttctagaaggagttg

SEQ ID NO: 24412 - DNA, 20 bp, Unknown
  RNA secondary structure sequence
actcctgactcctccggatt

SEQ ID NO: 24413 - DNA, 20 bp, Unknown
  RNA secondary structure sequence
attctcaaaaatggactggg

SEQ ID NO: 24414 - DNA, 20 bp, Unknown
  RNA secondary structure sequence
cgctgcagccgccacgcttt

SEQ ID NO: 24415 - DNA, 20 bp, Unknown
  RNA secondary structure sequence
tctaggggagaaatggaaac

SEQ ID NO: 24416 - DNA, 20 bp, Unknown
  RNA secondary structure sequence
agtgttgtgcccgtacagac

SEQ ID NO: 24417 - DNA, 20 bp, Unknown
  RNA secondary structure sequence
tgaggaggagcatcaatggc

SEQ ID NO: 24418 - DNA, 20 bp, Unknown
  RNA secondary structure sequence
gatgtacgctgatgacacag

SEQ ID NO: 24419 - DNA, 20 bp, Unknown
  RNA secondary structure sequence
aaaaacatacatggacatca

SEQ ID NO: 24420 - DNA, 20 bp, Unknown
  RNA secondary structure sequence
agctcttctcctatggttgg

SEQ ID NO: 24421 - DNA, 20 bp, Unknown
  RNA secondary structure sequence
ttatgcgcaaatgtggaagt

SEQ ID NO: 24422 - DNA, 20 bp, Unknown
  RNA secondary structure sequence
cggaaggaataaccgcagtc

SEQ ID NO: 24423 - DNA, 20 bp, Unknown
  RNA secondary structure sequence
ggactagaggttagaggaga

SEQ ID NO: 24424 - DNA, 20 bp, Unknown
  RNA secondary structure sequence
ggacgtaggctacacttgcg

SEQ ID NO: 24425 - DNA, 20 bp, Unknown
  RNA secondary structure sequence
aagaatggaagccaaggacc

SEQ ID NO: 24426 - DNA, 20 bp, Unknown
  RNA secondary structure sequence
tctggatctaccctggactg

SEQ ID NO: 24427 - DNA, 20 bp, Unknown
  RNA secondary structure sequence
acgtcgtgagctgaaatgtg

SEQ ID NO: 24428 - DNA, 20 bp, Unknown
  RNA secondary structure sequence
aaccgaaacagccaactcca

SEQ ID NO: 24429 - DNA, 20 bp, Unknown
  RNA secondary structure sequence
gattggaacagccgtcaagg

SEQ ID NO: 24430 - DNA, 20 bp, Unknown
  RNA secondary structure sequence
gattattccaatcacgctgg

SEQ ID NO: 24431 - DNA, 20 bp, Unknown
  RNA secondary structure sequence
taggacaacaacagcaagtg

SEQ ID NO: 24432 - DNA, 20 bp, Unknown
  RNA secondary structure sequence
gaccattgagcccttccaac

SEQ ID NO: 24433 - DNA, 20 bp, Unknown
  RNA secondary structure sequence
agccgtgggcatgactttcg

SEQ ID NO: 24434 - DNA, 20 bp, Unknown
  RNA secondary structure sequence
agtcgtcgccgctgaaatgg

SEQ ID NO: 24435 - DNA, 20 bp, Unknown
  RNA secondary structure sequence
ggatgaagcccacttcactg

SEQ ID NO: 24436 - DNA, 20 bp, Unknown
  RNA secondary structure sequence
caatgactgggacttcgtca

SEQ ID NO: 24437 - DNA, 20 bp, Unknown
  RNA secondary structure sequence
tcaccggaggggtctgggca

SEQ ID NO: 24438 - DNA, 20 bp, Unknown
  RNA secondary structure sequence
taaccatttggcaatctttc

SEQ ID NO: 24439 - DNA, 20 bp, Unknown
  RNA secondary structure sequence
cactgcatgggcaggttatg

SEQ ID NO: 24440 - DNA, 20 bp, Unknown
  RNA secondary structure sequence
ccacggaagctacgaggttc

SEQ ID NO: 24441 - DNA, 20 bp, Unknown
  RNA secondary structure sequence
cccagacccagcggtgggag

SEQ ID NO: 24442 - DNA, 20 bp, Unknown
  RNA secondary structure sequence
ggctagagaagcagtggaag

SEQ ID NO: 24443 - DNA, 20 bp, Unknown
  RNA secondary structure sequence
ctgggataccagaatcacga

SEQ ID NO: 24444 - DNA, 20 bp, Unknown
  RNA secondary structure sequence
cagggaggaccagagaggga

SEQ ID NO: 24445 - DNA, 20 bp, Unknown
  RNA secondary structure sequence
tggaagagagaggctttcgc

SEQ ID NO: 24446 - DNA, 20 bp, Unknown
  RNA secondary structure sequence
catggtgtcccagcacaggt

SEQ ID NO: 24447 - DNA, 20 bp, Unknown
  RNA secondary structure sequence
taggcccccacggcccattt

SEQ ID NO: 24448 - DNA, 20 bp, Unknown
  RNA secondary structure sequence
gagtggggtttccataattg

SEQ ID NO: 24449 - DNA, 20 bp, Unknown
  RNA secondary structure sequence
gggcgaggattgtgaggaca

SEQ ID NO: 24450 - DNA, 20 bp, Unknown
  RNA secondary structure sequence
gatagccaaatcgatggcag

SEQ ID NO: 24451 - DNA, 20 bp, Unknown
  RNA secondary structure sequence
gctctttgggaaaggtagca

SEQ ID NO: 24452 - DNA, 20 bp, Unknown
  RNA secondary structure sequence
ccttccatggataggaggag

SEQ ID NO: 24453 - DNA, 20 bp, Unknown
  RNA secondary structure sequence
tataaatagtggacatctaa

SEQ ID NO: 24454 - DNA, 20 bp, Unknown
  RNA secondary structure sequence
gcccatatcaatgtctgtga

SEQ ID NO: 24455 - DNA, 20 bp, Unknown
  RNA secondary structure sequence
ctggaggaaatcaggaagca

SEQ ID NO: 24456 - DNA, 20 bp, Unknown
  RNA secondary structure sequence
agccaatgctagggagataa

SEQ ID NO: 24457 - DNA, 20 bp, Unknown
  RNA secondary structure sequence
ggtcaaaggagaattagccg

SEQ ID NO: 24458 - DNA, 20 bp, Unknown
  RNA secondary structure sequence
caagagtagagcaggcccag

SEQ ID NO: 24459 - DNA, 20 bp, Unknown
  RNA secondary structure sequence
cctctttggagccctggcgg

SEQ ID NO: 24460 - DNA, 20 bp, Unknown
  RNA secondary structure sequence
ccacgtgagcctagatgttc

SEQ ID NO: 24461 - DNA, 20 bp, Unknown
  RNA secondary structure sequence
agctctttgggacatccctt

SEQ ID NO: 24462 - DNA, 20 bp, Unknown
  RNA secondary structure sequence
cagtgagggagaaatcgggg

SEQ ID NO: 24463 - DNA, 20 bp, Unknown
  RNA secondary structure sequence
agccttaagaggagagccta

SEQ ID NO: 24464 - DNA, 20 bp, Unknown
  RNA secondary structure sequence
tggagacatctatgcttaca

SEQ ID NO: 24465 - DNA, 20 bp, Unknown
  RNA secondary structure sequence
gcaaggacaaaggagagtgt

SEQ ID NO: 24466 - DNA, 20 bp, Unknown
  RNA secondary structure sequence
tgggatggtttccatcggcg

SEQ ID NO: 24467 - DNA, 20 bp, Unknown
  RNA secondary structure sequence
agcgaccatcctaggagggg

SEQ ID NO: 24468 - DNA, 20 bp, Unknown
  RNA secondary structure sequence
tcccctttttcagcatttga

SEQ ID NO: 24469 - DNA, 20 bp, Unknown
  RNA secondary structure sequence
tattctcgcatgcgtgctct

SEQ ID NO: 24470 - DNA, 20 bp, Unknown
  RNA secondary structure sequence
catcatggaagttgaccgag

SEQ ID NO: 24471 - DNA, 20 bp, Unknown
  RNA secondary structure sequence
ccaggtgaacggcgtggtca

SEQ ID NO: 24472 - DNA, 20 bp, Unknown
  RNA secondary structure sequence
catcatggaatacatggaaa

SEQ ID NO: 24473 - DNA, 20 bp, Unknown
  RNA secondary structure sequence
agtggtaccatgtcgttctc

SEQ ID NO: 24474 - DNA, 20 bp, Unknown
  RNA secondary structure sequence
ggttgccacaccttgtaaat

SEQ ID NO: 24475 - DNA, 20 bp, Unknown
  RNA secondary structure sequence
ttagaggagacccgtgatta

SEQ ID NO: 24476 - DNA, 20 bp, Unknown
  RNA secondary structure sequence
tgggagacgtcccaggatca

SEQ ID NO: 24477 - DNA, 20 bp, Unknown
  RNA secondary structure sequence
ccaagatcgctgttgtctct

SEQ ID NO: 24478 - DNA, 20 bp, Unknown
  RNA secondary structure sequence
cggcgccgggccaggcgccc

SEQ ID NO: 24479 - DNA, 20 bp, Unknown
  RNA secondary structure sequence
ccccggcgtgtactgggagg

SEQ ID NO: 24480 - DNA, 20 bp, Unknown
  RNA secondary structure sequence
tttaaaggctttagaagttg

SEQ ID NO: 24481 - DNA, 20 bp, Unknown
  RNA secondary structure sequence
gcgagctggagagcttggct

SEQ ID NO: 24482 - DNA, 20 bp, Unknown
  RNA secondary structure sequence
ggcaggagaatatgggcagc

SEQ ID NO: 24483 - DNA, 20 bp, Unknown
  RNA secondary structure sequence
ccttcctctgcacctggcct

SEQ ID NO: 24484 - DNA, 20 bp, Unknown
  RNA secondary structure sequence
gaagaaccaaaactggtatg

SEQ ID NO: 24485 - DNA, 20 bp, Unknown
  RNA secondary structure sequence
aggggaagtacagctaaagg

SEQ ID NO: 24486 - DNA, 20 bp, Unknown
  RNA secondary structure sequence
ccggagctcacccctggcct

SEQ ID NO: 24487 - DNA, 20 bp, Unknown
  RNA secondary structure sequence
tccgagagactgagtcgccc

SEQ ID NO: 24488 - DNA, 20 bp, Unknown
  RNA secondary structure sequence
tagcatcttcgcggtaaaga

SEQ ID NO: 24489 - DNA, 20 bp, Unknown
  RNA secondary structure sequence
ttcacgggttctatccgtga

SEQ ID NO: 24490 - DNA, 20 bp, Unknown
  RNA secondary structure sequence
agtagcagcggactcccctc

SEQ ID NO: 24491 - DNA, 20 bp, Unknown
  RNA secondary structure sequence
ctccaactcctcggacaaaa

SEQ ID NO: 24492 - DNA, 20 bp, Unknown
  RNA secondary structure sequence
acagcatgcaaattggacca

SEQ ID NO: 24493 - DNA, 20 bp, Unknown
  RNA secondary structure sequence
gatatcgtacacaccacctg

SEQ ID NO: 24494 - DNA, 20 bp, Unknown
  RNA secondary structure sequence
caatattctcttgacaccat

SEQ ID NO: 24495 - DNA, 20 bp, Unknown
  RNA secondary structure sequence
ttcgtttgttctgccttata

SEQ ID NO: 24496 - DNA, 20 bp, Unknown
  RNA secondary structure sequence
tgctacgataatcactcagg

SEQ ID NO: 24497 - DNA, 20 bp, Unknown
  RNA secondary structure sequence
cgtcctttcacgttacgacc

SEQ ID NO: 24498 - DNA, 20 bp, Unknown
  RNA secondary structure sequence
tacgcggccgttctgacgtt

SEQ ID NO: 24499 - DNA, 20 bp, Unknown
  RNA secondary structure sequence
gctatgggaaaacccctttg

SEQ ID NO: 24500 - DNA, 20 bp, Unknown
  RNA secondary structure sequence
ccacggcggaggccaatcca

SEQ ID NO: 24501 - DNA, 20 bp, Unknown
  RNA secondary structure sequence
tcatctgtggatgatatagt

SEQ ID NO: 24502 - DNA, 20 bp, Unknown
  RNA secondary structure sequence
tggcgaaaaagcacacgtga

SEQ ID NO: 24503 - DNA, 20 bp, Unknown
  RNA secondary structure sequence
cagggtgattccaatcagct

SEQ ID NO: 24504 - DNA, 20 bp, Unknown
  RNA secondary structure sequence
gtgcctgaccggggtcatgc

SEQ ID NO: 24505 - DNA, 20 bp, Unknown
  RNA secondary structure sequence
gcgaactctgccaagaatat

SEQ ID NO: 24506 - DNA, 20 bp, Unknown
  RNA secondary structure sequence
gcctttgagctccatttgga

SEQ ID NO: 24507 - DNA, 20 bp, Unknown
  RNA secondary structure sequence
ttggttgagatggtctctgg

SEQ ID NO: 24508 - DNA, 20 bp, Unknown
  RNA secondary structure sequence
ggtgttgggaagagtttttt

SEQ ID NO: 24509 - DNA, 20 bp, Unknown
  RNA secondary structure sequence
attaggccccttcagaaata

SEQ ID NO: 24510 - DNA, 20 bp, Unknown
  RNA secondary structure sequence
caggttagacatgaagtggc

SEQ ID NO: 24511 - DNA, 20 bp, Unknown
  RNA secondary structure sequence
tttggacattctaagtttac

SEQ ID NO: 24512 - DNA, 20 bp, Unknown
  RNA secondary structure sequence
cgaggtaatggctggttggt

SEQ ID NO: 24513 - DNA, 20 bp, Unknown
  RNA secondary structure sequence
gaaatacaaccatggggtgt

SEQ ID NO: 24514 - DNA, 20 bp, Unknown
  RNA secondary structure sequence
tgatttagttagtatttagt

SEQ ID NO: 24515 - DNA, 20 bp, Unknown
  RNA secondary structure sequence
tgcccggccatttgggcgtg

SEQ ID NO: 24516 - DNA, 20 bp, Unknown
  RNA secondary structure sequence
cgtcgcccacaagacgttaa

SEQ ID NO: 24517 - DNA, 20 bp, Unknown
  RNA secondary structure sequence
ctcatggggtacatccctgt

SEQ ID NO: 24518 - DNA, 20 bp, Unknown
  RNA secondary structure sequence
cagcggcccggcgccctcac

SEQ ID NO: 24519 - DNA, 20 bp, Unknown
  RNA secondary structure sequence
tccatctaccctggtaccat

SEQ ID NO: 24520 - DNA, 20 bp, Unknown
  RNA secondary structure sequence
acttacctcaaatgcggctc

SEQ ID NO: 24521 - DNA, 20 bp, Unknown
  RNA secondary structure sequence
cgttgcaacttggaggacag

SEQ ID NO: 24522 - DNA, 20 bp, Unknown
  RNA secondary structure sequence
ctcacaaaatacatcgtccg

SEQ ID NO: 24523 - DNA, 20 bp, Unknown
  RNA secondary structure sequence
atgatcactctctttactct

SEQ ID NO: 24524 - DNA, 20 bp, Unknown
  RNA secondary structure sequence
ggtgtggtgtttgacataac

SEQ ID NO: 24525 - DNA, 20 bp, Unknown
  RNA secondary structure sequence
cctgggactaaatctttgga

SEQ ID NO: 24526 - DNA, 20 bp, Unknown
  RNA secondary structure sequence
aggggccacgctgtcggagt

SEQ ID NO: 24527 - DNA, 20 bp, Unknown
  RNA secondary structure sequence
gctacagctacgccccctgg

SEQ ID NO: 24528 - DNA, 20 bp, Unknown
  RNA secondary structure sequence
gcggcccttcggggtatggg

SEQ ID NO: 24529 - DNA, 20 bp, Unknown
  RNA secondary structure sequence
tacgacgcaggggccgcatg

SEQ ID NO: 24530 - DNA, 20 bp, Unknown
  RNA secondary structure sequence
tcgggggaaaatttcgcata

SEQ ID NO: 24531 - DNA, 20 bp, Unknown
  RNA secondary structure sequence
gcgccggacaaggaggtcct

SEQ ID NO: 24532 - DNA, 20 bp, Unknown
  RNA secondary structure sequence
attttggggggctggctagc

SEQ ID NO: 24533 - DNA, 20 bp, Unknown
  RNA secondary structure sequence
atgtctggcgagaagccctc

SEQ ID NO: 24534 - DNA, 20 bp, Unknown
  RNA secondary structure sequence
aatcacgtcgcccccaccca

SEQ ID NO: 24535 - DNA, 20 bp, Unknown
  RNA secondary structure sequence
tgcaccatcctaacagactt

SEQ ID NO: 24536 - DNA, 20 bp, Unknown
  RNA secondary structure sequence
tacataacaggactcaccac

SEQ ID NO: 24537 - DNA, 20 bp, Unknown
  RNA secondary structure sequence
acccacggcaaagcctatga

SEQ ID NO: 24538 - DNA, 20 bp, Unknown
  RNA secondary structure sequence
aagaggttcccaccagcttt

SEQ ID NO: 24539 - DNA, 20 bp, Unknown
  RNA secondary structure sequence
ctcgagggggagcttggaga

SEQ ID NO: 24540 - DNA, 20 bp, Unknown
  RNA secondary structure sequence
gcggtgatgggggcttctta

SEQ ID NO: 24541 - DNA, 20 bp, Unknown
  RNA secondary structure sequence
gcggcttgtaaagctgcagg

SEQ ID NO: 24542 - DNA, 20 bp, Unknown
  RNA secondary structure sequence
aagctcaaactcactccatt

SEQ ID NO: 24543 - DNA, 20 bp, Unknown
  RNA secondary structure sequence
acccagaaatttgggcgtgc

SEQ ID NO: 24544 - DNA, 20 bp, Unknown
  RNA secondary structure sequence
tcatggggtacatcccgctc

SEQ ID NO: 24545 - DNA, 20 bp, Unknown
  RNA secondary structure sequence
gtctagagtggcggaatacg

SEQ ID NO: 24546 - DNA, 20 bp, Unknown
  RNA secondary structure sequence
cgctgtacccaggccatctt

SEQ ID NO: 24547 - DNA, 20 bp, Unknown
  RNA secondary structure sequence
ctgatgacagaccatactgc

SEQ ID NO: 24548 - DNA, 20 bp, Unknown
  RNA secondary structure sequence
agaccacgtacagccggtgt

SEQ ID NO: 24549 - DNA, 20 bp, Unknown
  RNA secondary structure sequence
tcggctggtacctggtagct

SEQ ID NO: 24550 - DNA, 20 bp, Unknown
  RNA secondary structure sequence
atccatccttaatttttgac

SEQ ID NO: 24551 - DNA, 20 bp, Unknown
  RNA secondary structure sequence
tgagcattggcagatggttc

SEQ ID NO: 24552 - DNA, 20 bp, Unknown
  RNA secondary structure sequence
tttgcgggctgcccgtctct

SEQ ID NO: 24553 - DNA, 20 bp, Unknown
  RNA secondary structure sequence
tgaccggtgaagtgcaggtg

SEQ ID NO: 24554 - DNA, 20 bp, Unknown
  RNA secondary structure sequence
gcccttcggggcatgttgcg

SEQ ID NO: 24555 - DNA, 20 bp, Unknown
  RNA secondary structure sequence
atgccccgaccggcagcggt

SEQ ID NO: 24556 - DNA, 20 bp, Unknown
  RNA secondary structure sequence
acgttgacttcagcctggac

SEQ ID NO: 24557 - DNA, 20 bp, Unknown
  RNA secondary structure sequence
cctgcttgacacaccccatc

SEQ ID NO: 24558 - DNA, 20 bp, Unknown
  RNA secondary structure sequence
ttaacatactcggggggtgg

SEQ ID NO: 24559 - DNA, 20 bp, Unknown
  RNA secondary structure sequence
agatcatgggaggagaatgc

SEQ ID NO: 24560 - DNA, 20 bp, Unknown
  RNA secondary structure sequence
ggggcaaccacgtctcaccg

SEQ ID NO: 24561 - DNA, 20 bp, Unknown
  RNA secondary structure sequence
gggtttgctcggtgttggcc

SEQ ID NO: 24562 - DNA, 20 bp, Unknown
  RNA secondary structure sequence
tccattacatcacgggggcc

SEQ ID NO: 24563 - DNA, 20 bp, Unknown
  RNA secondary structure sequence
gccagacgcataggcctcat

SEQ ID NO: 24564 - DNA, 20 bp, Unknown
  RNA secondary structure sequence
ggacaattcagctggacggc

SEQ ID NO: 24565 - DNA, 20 bp, Unknown
  RNA secondary structure sequence
catgctcgtctatgcctcct

SEQ ID NO: 24566 - DNA, 20 bp, Unknown
  RNA secondary structure sequence
gcatgctcaccatcgaggaa

SEQ ID NO: 24567 - DNA, 20 bp, Unknown
  RNA secondary structure sequence
tggcgaagaacgaggtgttt

SEQ ID NO: 24568 - DNA, 20 bp, Unknown
  RNA secondary structure sequence
ttcttgtctgcggagatgat

SEQ ID NO: 24569 - DNA, 20 bp, Unknown
  RNA secondary structure sequence
tggatttgtccagctggttt

SEQ ID NO: 24570 - DNA, 20 bp, Unknown
  RNA secondary structure sequence
cgcgtgcccgaacccgccat

SEQ ID NO: 24571 - DNA, 20 bp, Unknown
  RNA secondary structure sequence
tgccgcgcaggggccccaga

SEQ ID NO: 24572 - DNA, 20 bp, Unknown
  RNA secondary structure sequence
atggtgtcagggctttggag

SEQ ID NO: 24573 - DNA, 20 bp, Unknown
  RNA secondary structure sequence
gcatagtgtatgaggccgac

SEQ ID NO: 24574 - DNA, 20 bp, Unknown
  RNA secondary structure sequence
gtccaacaaccaccttagtt

SEQ ID NO: 24575 - DNA, 20 bp, Unknown
  RNA secondary structure sequence
acacccacaagtttaacagc

SEQ ID NO: 24576 - DNA, 20 bp, Unknown
  RNA secondary structure sequence
ccagtgtgtgtggccccgtg

SEQ ID NO: 24577 - DNA, 20 bp, Unknown
  RNA secondary structure sequence
ccgggttcaccaaaacctgt

SEQ ID NO: 24578 - DNA, 20 bp, Unknown
  RNA secondary structure sequence
cctacctatggatgatgttt

SEQ ID NO: 24579 - DNA, 20 bp, Unknown
  RNA secondary structure sequence
gcgggctgtggccctgtttt

SEQ ID NO: 24580 - DNA, 20 bp, Unknown
  RNA secondary structure sequence
tctaccacggggcgggtgcc

SEQ ID NO: 24581 - DNA, 20 bp, Unknown
  RNA secondary structure sequence
caccaggccttcctgtgtgc

SEQ ID NO: 24582 - DNA, 20 bp, Unknown
  RNA secondary structure sequence
tcttggtgggcggcgtcctg

SEQ ID NO: 24583 - DNA, 20 bp, Unknown
  RNA secondary structure sequence
agcacgggttacaactggct

SEQ ID NO: 24584 - DNA, 20 bp, Unknown
  RNA secondary structure sequence
cggaatcggcgcgtcggaga

SEQ ID NO: 24585 - DNA, 20 bp, Unknown
  RNA secondary structure sequence
accgtgatacagaccttacc

SEQ ID NO: 24586 - DNA, 20 bp, Unknown
  RNA secondary structure sequence
agagagcgcttcacgacgtc

SEQ ID NO: 24587 - DNA, 20 bp, Unknown
  RNA secondary structure sequence
gcttcgggaacacgctgacg

SEQ ID NO: 24588 - DNA, 20 bp, Unknown
  RNA secondary structure sequence
tcattcaaagactccatggc

SEQ ID NO: 24589 - DNA, 20 bp, Unknown
  RNA secondary structure sequence
tatgtggcatatacctcttt

SEQ ID NO: 24590 - DNA, 20 bp, Unknown
  RNA secondary structure sequence
gtctcatgcccgaccccgct

SEQ ID NO: 24591 - DNA, 20 bp, Unknown
  RNA secondary structure sequence
ggtggttgctctccccccga

SEQ ID NO: 24592 - DNA, 20 bp, Unknown
  RNA secondary structure sequence
acggtgtgaaggttcttgaa

SEQ ID NO: 24593 - DNA, 20 bp, Unknown
  RNA secondary structure sequence
gggatgtctgcggtccagtc

SEQ ID NO: 24594 - DNA, 20 bp, Unknown
  RNA secondary structure sequence
ggcattacccgtgcaccgta

SEQ ID NO: 24595 - DNA, 20 bp, Unknown
  RNA secondary structure sequence
gcttgggcgtttggccacta

SEQ ID NO: 24596 - DNA, 20 bp, Unknown
  RNA secondary structure sequence
atttcatagcccgagtggag

SEQ ID NO: 24597 - DNA, 20 bp, Unknown
  RNA secondary structure sequence
tccgcgaattaacggtggcc

SEQ ID NO: 24598 - DNA, 20 bp, Unknown
  RNA secondary structure sequence
gttggcgactcctcgcccct

SEQ ID NO: 24599 - DNA, 20 bp, Unknown
  RNA secondary structure sequence
taatcatatgcgacgagtgc

SEQ ID NO: 24600 - DNA, 20 bp, Unknown
  RNA secondary structure sequence
agcgtaggggccgtacaggg

SEQ ID NO: 24601 - DNA, 20 bp, Unknown
  RNA secondary structure sequence
acacccccgggctccctgtc

SEQ ID NO: 24602 - DNA, 20 bp, Unknown
  RNA secondary structure sequence
tggacgaggcacgtgccatc

SEQ ID NO: 24603 - DNA, 20 bp, Unknown
  RNA secondary structure sequence
ctggcctttcgaccttgccg

SEQ ID NO: 24604 - DNA, 20 bp, Unknown
  RNA secondary structure sequence
tcttctcatgccagaagggg

SEQ ID NO: 24605 - DNA, 20 bp, Unknown
  RNA secondary structure sequence
caacagggcccagcgtacct

SEQ ID NO: 24606 - DNA, 20 bp, Unknown
  RNA secondary structure sequence
cggcggaaacggccaagcgc

SEQ ID NO: 24607 - DNA, 20 bp, Unknown
  RNA secondary structure sequence
gcggtgaggacaacgtggtg

SEQ ID NO: 24608 - DNA, 20 bp, Unknown
  RNA secondary structure sequence
gagtccgcgtctgcgagaag

SEQ ID NO: 24609 - DNA, 20 bp, Unknown
  RNA secondary structure sequence
ctgaggctatgaccaggtac

SEQ ID NO: 24610 - DNA, 20 bp, Unknown
  RNA secondary structure sequence
cgctggatcttccagctatc

SEQ ID NO: 24611 - DNA, 20 bp, Unknown
  RNA secondary structure sequence
cgctggcgggggggacattt

SEQ ID NO: 24612 - DNA, 20 bp, Unknown
  RNA secondary structure sequence
ccctgtgaggaactactgtc

SEQ ID NO: 24613 - DNA, 20 bp, Unknown
  RNA secondary structure sequence
aatgcctggagatttgggcg

SEQ ID NO: 24614 - DNA, 20 bp, Unknown
  RNA secondary structure sequence
tgtcaggcaattggttgaag

SEQ ID NO: 24615 - DNA, 20 bp, Unknown
  RNA secondary structure sequence
ataggaccgctctaaactgt

SEQ ID NO: 24616 - DNA, 20 bp, Unknown
  RNA secondary structure sequence
cgtctgaggaccggccctac

SEQ ID NO: 24617 - DNA, 20 bp, Unknown
  RNA secondary structure sequence
aggccacatatcagaagtgt

SEQ ID NO: 24618 - DNA, 20 bp, Unknown
  RNA secondary structure sequence
ttctggtgttgacaatcttt

SEQ ID NO: 24619 - DNA, 20 bp, Unknown
  RNA secondary structure sequence
acccacatctcgggtttgag

SEQ ID NO: 24620 - DNA, 20 bp, Unknown
  RNA secondary structure sequence
tgaggttgggcgcctggact

SEQ ID NO: 24621 - DNA, 20 bp, Unknown
  RNA secondary structure sequence
tgaggggtctccctgtgtcc

SEQ ID NO: 24622 - DNA, 20 bp, Unknown
  RNA secondary structure sequence
acgctccgacgggtagcggt

SEQ ID NO: 24623 - DNA, 20 bp, Unknown
  RNA secondary structure sequence
tgtctaaacaactaacctca

SEQ ID NO: 24624 - DNA, 20 bp, Unknown
  RNA secondary structure sequence
agcaggggggcgagaacttt

SEQ ID NO: 24625 - DNA, 20 bp, Unknown
  RNA secondary structure sequence
tagtaacaacacatccaatc

SEQ ID NO: 24626 - DNA, 20 bp, Unknown
  RNA secondary structure sequence
cggttgtccctgatcgggag

SEQ ID NO: 24627 - DNA, 20 bp, Unknown
  RNA secondary structure sequence
acgggtctatgaagatcaca

SEQ ID NO: 24628 - DNA, 20 bp, Unknown
  RNA secondary structure sequence
ggtctcagctcccttgtgag

SEQ ID NO: 24629 - DNA, 20 bp, Unknown
  RNA secondary structure sequence
gcacggcgaacggagaccac

SEQ ID NO: 24630 - DNA, 20 bp, Unknown
  RNA secondary structure sequence
agtgccatagaccacctagg

SEQ ID NO: 24631 - DNA, 20 bp, Unknown
  RNA secondary structure sequence
agaggctcatacagctggac

SEQ ID NO: 24632 - DNA, 20 bp, Unknown
  RNA secondary structure sequence
gatcctttagctcaatgccc

SEQ ID NO: 24633 - DNA, 20 bp, Unknown
  RNA secondary structure sequence
cccaacgggtagagtacttg

SEQ ID NO: 24634 - DNA, 20 bp, Unknown
  RNA secondary structure sequence
tcacagaacgcctctattgt

SEQ ID NO: 24635 - DNA, 20 bp, Unknown
  RNA secondary structure sequence
tagcccacgatggcaccgga

SEQ ID NO: 24636 - DNA, 20 bp, Unknown
  RNA secondary structure sequence
gcctcaggaagcttggggcg

SEQ ID NO: 24637 - DNA, 20 bp, Unknown
  RNA secondary structure sequence
atttgtcaggctggtttgtc

SEQ ID NO: 24638 - DNA, 20 bp, Unknown
  RNA secondary structure sequence
tgtttccttttattcctata

SEQ ID NO: 24639 - DNA, 20 bp, Unknown
  RNA secondary structure sequence
cggtaaaggatatcatgtta

SEQ ID NO: 24640 - DNA, 20 bp, Unknown
  RNA secondary structure sequence
gatcagggtatacaatacac

SEQ ID NO: 24641 - DNA, 20 bp, Unknown
  RNA secondary structure sequence
acaatgctaacacaaccaca

SEQ ID NO: 24642 - DNA, 20 bp, Unknown
  RNA secondary structure sequence
tggcatattccccaccaggt

SEQ ID NO: 24643 - DNA, 20 bp, Unknown
  RNA secondary structure sequence
tggtggataccaaagctact

SEQ ID NO: 24644 - DNA, 20 bp, Unknown
  RNA secondary structure sequence
gtggtgagggcgttgttggt

SEQ ID NO: 24645 - DNA, 20 bp, Unknown
  RNA secondary structure sequence
aacagcaggctgtcgtgatc

SEQ ID NO: 24646 - DNA, 20 bp, Unknown
  RNA secondary structure sequence
ttgtctctgtggcggggata

SEQ ID NO: 24647 - DNA, 20 bp, Unknown
  RNA secondary structure sequence
taaaaaccgagtacggcgag

SEQ ID NO: 24648 - DNA, 20 bp, Unknown
  RNA secondary structure sequence
actcagtggccatgaggcag

SEQ ID NO: 24649 - DNA, 20 bp, Unknown
  RNA secondary structure sequence
tgagagctggctctcctgcc

SEQ ID NO: 24650 - DNA, 20 bp, Unknown
  RNA secondary structure sequence
aagacctcctcttggctcag

SEQ ID NO: 24651 - DNA, 20 bp, Unknown
  RNA secondary structure sequence
tgacacacacacccctggag

SEQ ID NO: 24652 - DNA, 20 bp, Unknown
  RNA secondary structure sequence
ttcggcaattttagcgaatt

SEQ ID NO: 24653 - DNA, 20 bp, Unknown
  RNA secondary structure sequence
ttcccagagtaattgctgta

SEQ ID NO: 24654 - DNA, 20 bp, Unknown
  RNA secondary structure sequence
gggctactacactcccgaca

SEQ ID NO: 24655 - DNA, 20 bp, Unknown
  RNA secondary structure sequence
tgttaatgccctgagtcttg

SEQ ID NO: 24656 - DNA, 20 bp, Unknown
  RNA secondary structure sequence
cactcatgctttctcatttg

SEQ ID NO: 24657 - DNA, 20 bp, Unknown
  RNA secondary structure sequence
tgcttcagttatcttggaca

SEQ ID NO: 24658 - DNA, 20 bp, Unknown
  RNA secondary structure sequence
agcactaggctttcacgctg

SEQ ID NO: 24659 - DNA, 20 bp, Unknown
  RNA secondary structure sequence
ggctaggtacatttgtgctc

SEQ ID NO: 24660 - DNA, 20 bp, Unknown
  RNA secondary structure sequence
gcaaggggccaatacgattt

SEQ ID NO: 24661 - DNA, 20 bp, Unknown
  RNA secondary structure sequence
ggagctcaaaacaaaagaaa

SEQ ID NO: 24662 - DNA, 20 bp, Unknown
  RNA secondary structure sequence
ggaggtcactgacagtgcag

SEQ ID NO: 24663 - DNA, 20 bp, Unknown
  RNA secondary structure sequence
ccatcgatgtgaagatgatg

SEQ ID NO: 24664 - DNA, 20 bp, Unknown
  RNA secondary structure sequence
acaggggctggggcaacggc

SEQ ID NO: 24665 - DNA, 20 bp, Unknown
  RNA secondary structure sequence
ccacacaggttggagccact

SEQ ID NO: 24666 - DNA, 20 bp, Unknown
  RNA secondary structure sequence
atcgtgagtggttcatggac

SEQ ID NO: 24667 - DNA, 20 bp, Unknown
  RNA secondary structure sequence
tggaattttcaagcaacact

SEQ ID NO: 24668 - DNA, 20 bp, Unknown
  RNA secondary structure sequence
tcggaggagcattccgctca

SEQ ID NO: 24669 - DNA, 20 bp, Unknown
  RNA secondary structure sequence
accgtggacctgccactcgc

SEQ ID NO: 24670 - DNA, 20 bp, Unknown
  RNA secondary structure sequence
aaatggcttatcacgatgcc

SEQ ID NO: 24671 - DNA, 20 bp, Unknown
  RNA secondary structure sequence
tgtacaggatactgctgttg

SEQ ID NO: 24672 - DNA, 20 bp, Unknown
  RNA secondary structure sequence
gcggatggcccgcaactgaa

SEQ ID NO: 24673 - DNA, 20 bp, Unknown
  RNA secondary structure sequence
aaggtgttttccacaccctt

SEQ ID NO: 24674 - DNA, 20 bp, Unknown
  RNA secondary structure sequence
tgagaacagccgtgctagcg

SEQ ID NO: 24675 - DNA, 20 bp, Unknown
  RNA secondary structure sequence
gggtgccgaactacaacctg

SEQ ID NO: 24676 - DNA, 20 bp, Unknown
  RNA secondary structure sequence
cagtgacagcagctagtgcc

SEQ ID NO: 24677 - DNA, 20 bp, Unknown
  RNA secondary structure sequence
ggctcattgaggttctggga

SEQ ID NO: 24678 - DNA, 20 bp, Unknown
  RNA secondary structure sequence
ccttcgtcgatgttggagtg

SEQ ID NO: 24679 - DNA, 20 bp, Unknown
  RNA secondary structure sequence
tcatgaagaacgctgtagtg

SEQ ID NO: 24680 - DNA, 20 bp, Unknown
  RNA secondary structure sequence
ggctggtcgaacggaggttt

SEQ ID NO: 24681 - DNA, 20 bp, Unknown
  RNA secondary structure sequence
agcgagtgttcaaagagaag

SEQ ID NO: 24682 - DNA, 20 bp, Unknown
  RNA secondary structure sequence
ccaagggaagcagagccatt

SEQ ID NO: 24683 - DNA, 20 bp, Unknown
  RNA secondary structure sequence
aaggacccaaagtcaggacc

SEQ ID NO: 24684 - DNA, 20 bp, Unknown
  RNA secondary structure sequence
caactggatggtatgattgg

SEQ ID NO: 24685 - DNA, 20 bp, Unknown
  RNA secondary structure sequence
ttaaagtgcacggcccagcc

SEQ ID NO: 24686 - DNA, 20 bp, Unknown
  RNA secondary structure sequence
ccgtgccacaaaacaccaca

SEQ ID NO: 24687 - DNA, 20 bp, Unknown
  RNA secondary structure sequence
gtggcgtggtgctcttgtat

SEQ ID NO: 24688 - DNA, 20 bp, Unknown
  RNA secondary structure sequence
gaagccataagcatcgttat

SEQ ID NO: 24689 - DNA, 20 bp, Unknown
  RNA secondary structure sequence
gaagccatttaagtgacaag

SEQ ID NO: 24690 - DNA, 20 bp, Unknown
  RNA secondary structure sequence
gcatcttcgggcaaaatctg

SEQ ID NO: 24691 - DNA, 20 bp, Unknown
  RNA secondary structure sequence
ctaaagctgacaattacacc

SEQ ID NO: 24692 - DNA, 20 bp, Unknown
  RNA secondary structure sequence
aaaacccagttgaggactac

SEQ ID NO: 24693 - DNA, 20 bp, Unknown
  RNA secondary structure sequence
ctgttgtcaccaacaacaca

SEQ ID NO: 24694 - DNA, 20 bp, Unknown
  RNA secondary structure sequence
atgcgcacttaaccagcttg

SEQ ID NO: 24695 - DNA, 20 bp, Unknown
  RNA secondary structure sequence
taagaccctattcatgttta

SEQ ID NO: 24696 - DNA, 20 bp, Unknown
  RNA secondary structure sequence
tcatcagtgcacttaccata

SEQ ID NO: 24697 - DNA, 20 bp, Unknown
  RNA secondary structure sequence
aagttgatgaaccagctcag

SEQ ID NO: 24698 - DNA, 20 bp, Unknown
  RNA secondary structure sequence
agaaacctgagttaagaaga

SEQ ID NO: 24699 - DNA, 20 bp, Unknown
  RNA secondary structure sequence
atattgatggaaggttagtt

SEQ ID NO: 24700 - DNA, 20 bp, Unknown
  RNA secondary structure sequence
tggaacaagcaatatatggt

SEQ ID NO: 24701 - DNA, 20 bp, Unknown
  RNA secondary structure sequence
taactttcctaaaggatgaa

SEQ ID NO: 24702 - DNA, 20 bp, Unknown
  RNA secondary structure sequence
atccagatgtgttttggtca

SEQ ID NO: 24703 - DNA, 20 bp, Unknown
  RNA secondary structure sequence
aactggatccgtaactggac

SEQ ID NO: 24704 - DNA, 20 bp, Unknown
  RNA secondary structure sequence
gacagcctaaggatgccctc

SEQ ID NO: 24705 - DNA, 20 bp, Unknown
  RNA secondary structure sequence
cggaaatgaaaagatcatac

SEQ ID NO: 24706 - DNA, 20 bp, Unknown
  RNA secondary structure sequence
cacccacgggtacgcacact

SEQ ID NO: 24707 - DNA, 20 bp, Unknown
  RNA secondary structure sequence
tcttgatgttcgggctagtt

SEQ ID NO: 24708 - DNA, 20 bp, Unknown
  RNA secondary structure sequence
ttctgagacagtgtttaata

SEQ ID NO: 24709 - DNA, 20 bp, Unknown
  RNA secondary structure sequence
gcgttgcccagttgagcctg

SEQ ID NO: 24710 - DNA, 20 bp, Unknown
  RNA secondary structure sequence
aagcaatacacaccagagat

SEQ ID NO: 24711 - DNA, 20 bp, Unknown
  RNA secondary structure sequence
tctctttgtaaaacaagaac

SEQ ID NO: 24712 - DNA, 20 bp, Unknown
  RNA secondary structure sequence
acgaaaacttaggctaacgg

SEQ ID NO: 24713 - DNA, 20 bp, Unknown
  RNA secondary structure sequence
tgtagacaggtttaaaccat

SEQ ID NO: 24714 - DNA, 20 bp, Unknown
  RNA secondary structure sequence
ggaaaggaaaagagaagttc

SEQ ID NO: 24715 - DNA, 20 bp, Unknown
  RNA secondary structure sequence
gaaccctccaactgacatgc

SEQ ID NO: 24716 - DNA, 20 bp, Unknown
  RNA secondary structure sequence
catccatagtgcaggaggta

SEQ ID NO: 24717 - DNA, 20 bp, Unknown
  RNA secondary structure sequence
tcacaatgttcttggcaaga

SEQ ID NO: 24718 - DNA, 20 bp, Unknown
  RNA secondary structure sequence
ggttttctcagacgcatacg

SEQ ID NO: 24719 - DNA, 20 bp, Unknown
  RNA secondary structure sequence
tttaggtaagaacattacag

SEQ ID NO: 24720 - DNA, 20 bp, Unknown
  RNA secondary structure sequence
cagtggagaagaagagtaca

SEQ ID NO: 24721 - DNA, 20 bp, Unknown
  RNA secondary structure sequence
aagtatgacctaccgttaac

SEQ ID NO: 24722 - DNA, 20 bp, Unknown
  RNA secondary structure sequence
cctagattactcagatggag

SEQ ID NO: 24723 - DNA, 20 bp, Unknown
  RNA secondary structure sequence
acctacagatcgaaagagtg

SEQ ID NO: 24724 - DNA, 20 bp, Unknown
  RNA secondary structure sequence
gattaacccttataatatac

SEQ ID NO: 24725 - DNA, 20 bp, Unknown
  RNA secondary structure sequence
tgtatgtttgttaatacatg

SEQ ID NO: 24726 - DNA, 20 bp, Unknown
  RNA secondary structure sequence
gacttcagtgcgttacacca

SEQ ID NO: 24727 - DNA, 20 bp, Unknown
  RNA secondary structure sequence
gccaaatgaaccaggagaaa

SEQ ID NO: 24728 - DNA, 20 bp, Unknown
  RNA secondary structure sequence
tggagtgctaatggcaacag

SEQ ID NO: 24729 - DNA, 20 bp, Unknown
  RNA secondary structure sequence
caaattggaacccagtgtgt

SEQ ID NO: 24730 - DNA, 20 bp, Unknown
  RNA secondary structure sequence
gttaggttacactagtgatg

SEQ ID NO: 24731 - DNA, 20 bp, Unknown
  RNA secondary structure sequence
gaaatgagccctaccgttaa

SEQ ID NO: 24732 - DNA, 20 bp, Unknown
  RNA secondary structure sequence
gtctactcaaaagactggtg

SEQ ID NO: 24733 - DNA, 20 bp, Unknown
  RNA secondary structure sequence
acaatgcaacgcttccaggt

SEQ ID NO: 24734 - DNA, 20 bp, Unknown
  RNA secondary structure sequence
agccgtttgcaacgcagcaa

SEQ ID NO: 24735 - DNA, 20 bp, Unknown
  RNA secondary structure sequence
tgttgagttagattactctg

SEQ ID NO: 24736 - DNA, 20 bp, Unknown
  RNA secondary structure sequence
tggtgccccaacaaacagga

SEQ ID NO: 24737 - DNA, 20 bp, Unknown
  RNA secondary structure sequence
ggcggcaaatgagtactacc

SEQ ID NO: 24738 - DNA, 20 bp, Unknown
  RNA secondary structure sequence
gctgttgcacggagctccag

SEQ ID NO: 24739 - DNA, 20 bp, Unknown
  RNA secondary structure sequence
tggaaaggatgtgtccctgt

SEQ ID NO: 24740 - DNA, 20 bp, Unknown
  RNA secondary structure sequence
attccattttgacatgaaca

SEQ ID NO: 24741 - DNA, 20 bp, Unknown
  RNA secondary structure sequence
cgtggatagtgaagaattga

SEQ ID NO: 24742 - DNA, 20 bp, Unknown
  RNA secondary structure sequence
aaaggaggaatctgagattg

SEQ ID NO: 24743 - DNA, 20 bp, Unknown
  RNA secondary structure sequence
gatactgatggccactggta

SEQ ID NO: 24744 - DNA, 20 bp, Unknown
  RNA secondary structure sequence
taagaacattgatcttgata

SEQ ID NO: 24745 - DNA, 20 bp, Unknown
  RNA secondary structure sequence
ttacgtagaaagtggcttga

SEQ ID NO: 24746 - DNA, 20 bp, Unknown
  RNA secondary structure sequence
gctcttatatacccacatca

SEQ ID NO: 24747 - DNA, 20 bp, Unknown
  RNA secondary structure sequence
cagtatatgtacataccacc

SEQ ID NO: 24748 - DNA, 20 bp, Unknown
  RNA secondary structure sequence
agccagccataccttctaaa

SEQ ID NO: 24749 - DNA, 20 bp, Unknown
  RNA secondary structure sequence
ctggtcatagtaatcaggag

SEQ ID NO: 24750 - DNA, 20 bp, Unknown
  RNA secondary structure sequence
cgcggcgctccaggcacagg

SEQ ID NO: 24751 - DNA, 20 bp, Unknown
  RNA secondary structure sequence
tcgggtatgcctaaaactgc

SEQ ID NO: 24752 - DNA, 20 bp, Unknown
  RNA secondary structure sequence
catgctgagccaagtggaac

SEQ ID NO: 24753 - DNA, 20 bp, Unknown
  RNA secondary structure sequence
aaaattattggaattcatgt

SEQ ID NO: 24754 - DNA, 20 bp, Unknown
  RNA secondary structure sequence
aacatagacacatccaaaat

SEQ ID NO: 24755 - DNA, 20 bp, Unknown
  RNA secondary structure sequence
attactggatctgctgtcgg

SEQ ID NO: 24756 - DNA, 20 bp, Unknown
  RNA secondary structure sequence
tgaaggggaaaacgctcgtt

SEQ ID NO: 24757 - DNA, 20 bp, Unknown
  RNA secondary structure sequence
atcagctgaagcgtgtgggt

SEQ ID NO: 24758 - DNA, 20 bp, Unknown
  RNA secondary structure sequence
tcagggtactctacttgttg

SEQ ID NO: 24759 - DNA, 20 bp, Unknown
  RNA secondary structure sequence
atgggaatcaacgttagtgg

SEQ ID NO: 24760 - DNA, 20 bp, Unknown
  RNA secondary structure sequence
aagcacacatcaagtagcga

SEQ ID NO: 24761 - DNA, 20 bp, Unknown
  RNA secondary structure sequence
tattagcatactgacatcaa

SEQ ID NO: 24762 - DNA, 20 bp, Unknown
  RNA secondary structure sequence
ccagtatatgtacatcccac

SEQ ID NO: 24763 - DNA, 20 bp, Unknown
  RNA secondary structure sequence
aaaccagccttatgtgctaa

SEQ ID NO: 24764 - DNA, 20 bp, Unknown
  RNA secondary structure sequence
agatgatgtcatggagcaag

SEQ ID NO: 24765 - DNA, 20 bp, Unknown
  RNA secondary structure sequence
tagaggcccaccaggcacag

SEQ ID NO: 24766 - DNA, 20 bp, Unknown
  RNA secondary structure sequence
ggacatctcccttttctgcc

SEQ ID NO: 24767 - DNA, 20 bp, Unknown
  RNA secondary structure sequence
tagcttagattctgttgttt

SEQ ID NO: 24768 - DNA, 20 bp, Unknown
  RNA secondary structure sequence
catatcagtgatagagggca

SEQ ID NO: 24769 - DNA, 20 bp, Unknown
  RNA secondary structure sequence
tgagttgaatatggtggcat

SEQ ID NO: 24770 - DNA, 20 bp, Unknown
  RNA secondary structure sequence
gtttaaaccagataaacagt

SEQ ID NO: 24771 - DNA, 20 bp, Unknown
  RNA secondary structure sequence
accagggggctttattagtg

SEQ ID NO: 24772 - DNA, 20 bp, Unknown
  RNA secondary structure sequence
tcaccatcgctcccatggca

SEQ ID NO: 24773 - DNA, 20 bp, Unknown
  RNA secondary structure sequence
ctgccaacacaccagcattg

SEQ ID NO: 24774 - DNA, 20 bp, Unknown
  RNA secondary structure sequence
acagcaactcacccaagttt

SEQ ID NO: 24775 - DNA, 20 bp, Unknown
  RNA secondary structure sequence
caccaggagcaccaataccc

SEQ ID NO: 24776 - DNA, 20 bp, Unknown
  RNA secondary structure sequence
cctcaccaaatggtaaagga

SEQ ID NO: 24777 - DNA, 20 bp, Unknown
  RNA secondary structure sequence
gggagagttatgagagagat

SEQ ID NO: 24778 - DNA, 20 bp, Unknown
  RNA secondary structure sequence
ttaggaatcatgaagatctc

SEQ ID NO: 24779 - DNA, 20 bp, Unknown
  RNA secondary structure sequence
tatgtcagatggtttccaca

SEQ ID NO: 24780 - DNA, 20 bp, Unknown
  RNA secondary structure sequence
aatactgtcaagagaagggt

SEQ ID NO: 24781 - DNA, 20 bp, Unknown
  RNA secondary structure sequence
ctttcaacaaacccaaagtt

SEQ ID NO: 24782 - DNA, 20 bp, Unknown
  RNA secondary structure sequence
gtattcacgttggtggtaat

SEQ ID NO: 24783 - DNA, 20 bp, Unknown
  RNA secondary structure sequence
ttagtgagatgtgccttgag

SEQ ID NO: 24784 - DNA, 20 bp, Unknown
  RNA secondary structure sequence
tttcgtacttgtgtcactca

SEQ ID NO: 24785 - DNA, 20 bp, Unknown
  RNA secondary structure sequence
caggcgcaagtggctcgacc

SEQ ID NO: 24786 - DNA, 20 bp, Unknown
  RNA secondary structure sequence
ccccagcaccctggttcgat

SEQ ID NO: 24787 - DNA, 20 bp, Unknown
  RNA secondary structure sequence
aactcaattgatctttcagc

SEQ ID NO: 24788 - DNA, 20 bp, Unknown
  RNA secondary structure sequence
gacaccgcaggcaacacggc

SEQ ID NO: 24789 - DNA, 20 bp, Unknown
  RNA secondary structure sequence
gcatttgatcatgtaaggat

SEQ ID NO: 24790 - DNA, 20 bp, Unknown
  RNA secondary structure sequence
ccacatcaaattcttaacct

SEQ ID NO: 24791 - DNA, 20 bp, Unknown
  RNA secondary structure sequence
tctgttcaacccgtaaagcc

SEQ ID NO: 24792 - DNA, 20 bp, Unknown
  RNA secondary structure sequence
aactctagctacaatttcac

SEQ ID NO: 24793 - DNA, 20 bp, Unknown
  RNA secondary structure sequence
ggtggggatgacttcactct

SEQ ID NO: 24794 - DNA, 20 bp, Unknown
  RNA secondary structure sequence
gcggtcctagcgtccgccct

SEQ ID NO: 24795 - DNA, 20 bp, Unknown
  RNA secondary structure sequence
actatcccctacactccatc

SEQ ID NO: 24796 - DNA, 20 bp, Unknown
  RNA secondary structure sequence
gttgcaccaaacgctgactt

SEQ ID NO: 24797 - DNA, 20 bp, Unknown
  RNA secondary structure sequence
cttcccgtctctactcccaa

SEQ ID NO: 24798 - DNA, 20 bp, Unknown
  RNA secondary structure sequence
ttgatggctggaatagatgt

SEQ ID NO: 24799 - DNA, 20 bp, Unknown
  RNA secondary structure sequence
ataaaaacaattaaaagaat

SEQ ID NO: 24800 - DNA, 20 bp, Unknown
  RNA secondary structure sequence
caagcagtctccaaactttt

SEQ ID NO: 24801 - DNA, 20 bp, Unknown
  RNA secondary structure sequence
ctcccaaacatggcccacct

SEQ ID NO: 24802 - DNA, 20 bp, Unknown
  RNA secondary structure sequence
gataacaaagtggaaaactt

SEQ ID NO: 24803 - DNA, 20 bp, Unknown
  RNA secondary structure sequence
caaattttggacgtacaagg

SEQ ID NO: 24804 - DNA, 20 bp, Unknown
  RNA secondary structure sequence
aaagatgatgacttcccggc

SEQ ID NO: 24805 - DNA, 20 bp, Unknown
  RNA secondary structure sequence
gggtcggcactcatctgtca

SEQ ID NO: 24806 - DNA, 20 bp, Unknown
  RNA secondary structure sequence
tgtatatggggacgtcaact

SEQ ID NO: 24807 - DNA, 20 bp, Unknown
  RNA secondary structure sequence
atgttgaacacaattataaa

SEQ ID NO: 24808 - DNA, 20 bp, Unknown
  RNA secondary structure sequence
cgtttctcccccgaccattc

SEQ ID NO: 24809 - DNA, 20 bp, Unknown
  RNA secondary structure sequence
actggagctcgaccctcctt

SEQ ID NO: 24810 - DNA, 20 bp, Unknown
  RNA secondary structure sequence
agcgagctacagcgggaact

SEQ ID NO: 24811 - DNA, 20 bp, Unknown
  RNA secondary structure sequence
atagacactttttgatgaag

SEQ ID NO: 24812 - DNA, 20 bp, Unknown
  RNA secondary structure sequence
ctgacgattacgggaccggg

SEQ ID NO: 24813 - DNA, 20 bp, Unknown
  RNA secondary structure sequence
tggcatttgagcgggtgcct

SEQ ID NO: 24814 - DNA, 20 bp, Unknown
  RNA secondary structure sequence
gtgggtgtatccaaatcact

SEQ ID NO: 24815 - DNA, 20 bp, Unknown
  RNA secondary structure sequence
cctacatctcgcccagtgac

SEQ ID NO: 24816 - DNA, 20 bp, Unknown
  RNA secondary structure sequence
aggtactggagaaggacgcc

SEQ ID NO: 24817 - DNA, 20 bp, Unknown
  RNA secondary structure sequence
ttactgggcgcactccccgc

SEQ ID NO: 24818 - DNA, 20 bp, Unknown
  RNA secondary structure sequence
caattttggagtttcttgaa

SEQ ID NO: 24819 - DNA, 20 bp, Unknown
  RNA secondary structure sequence
ccaaccaagcttcagtaaag

SEQ ID NO: 24820 - DNA, 20 bp, Unknown
  RNA secondary structure sequence
ccgctgcggtcgatgaggcg

SEQ ID NO: 24821 - DNA, 20 bp, Unknown
  RNA secondary structure sequence
ttcccaacagaccttctggg

SEQ ID NO: 24822 - DNA, 20 bp, Unknown
  RNA secondary structure sequence
gactagaccccatggatccc

SEQ ID NO: 24823 - DNA, 20 bp, Unknown
  RNA secondary structure sequence
aagatgagatcagaccctca

SEQ ID NO: 24824 - DNA, 20 bp, Unknown
  RNA secondary structure sequence
tctcggtgcacgcttacggc

SEQ ID NO: 24825 - DNA, 20 bp, Unknown
  RNA secondary structure sequence
cgcttgaggaggacttgtac

SEQ ID NO: 24826 - DNA, 20 bp, Unknown
  RNA secondary structure sequence
gcccttcaggtaccccgagg

SEQ ID NO: 24827 - DNA, 20 bp, Unknown
  RNA secondary structure sequence
gactgggtctataactcgcc

SEQ ID NO: 24828 - DNA, 20 bp, Unknown
  RNA secondary structure sequence
tcggctagcgccggcaaaga

SEQ ID NO: 24829 - DNA, 20 bp, Unknown
  RNA secondary structure sequence
gtgaagataaacagcctgag

SEQ ID NO: 24830 - DNA, 20 bp, Unknown
  RNA secondary structure sequence
gccactggggttaaagctat

SEQ ID NO: 24831 - DNA, 20 bp, Unknown
  RNA secondary structure sequence
ttcgtcgtgaagaaaatctc

SEQ ID NO: 24832 - DNA, 20 bp, Unknown
  RNA secondary structure sequence
attaacgacatcttcgccat

SEQ ID NO: 24833 - DNA, 20 bp, Unknown
  RNA secondary structure sequence
cctcgtcatcttttcgcaga

SEQ ID NO: 24834 - DNA, 20 bp, Unknown
  RNA secondary structure sequence
cactttcgtgatacagcaag

SEQ ID NO: 24835 - DNA, 20 bp, Unknown
  RNA secondary structure sequence
gctggctactgtggaggagc

SEQ ID NO: 24836 - DNA, 20 bp, Unknown
  RNA secondary structure sequence
gacgtaaagatgaccgaaga

SEQ ID NO: 24837 - DNA, 20 bp, Unknown
  RNA secondary structure sequence
tgggccctccagggaaaacg

SEQ ID NO: 24838 - DNA, 20 bp, Unknown
  RNA secondary structure sequence
tgggatgtggattactcggc

SEQ ID NO: 24839 - DNA, 20 bp, Unknown
  RNA secondary structure sequence
cgcccttctagggcctacga

SEQ ID NO: 24840 - DNA, 20 bp, Unknown
  RNA secondary structure sequence
atccttcacaggttcagaca

SEQ ID NO: 24841 - DNA, 20 bp, Unknown
  RNA secondary structure sequence
ctgtcacctgaaaataagac

SEQ ID NO: 24842 - DNA, 20 bp, Unknown
  RNA secondary structure sequence
gtcatgaccctggctgattt

SEQ ID NO: 24843 - DNA, 20 bp, Unknown
  RNA secondary structure sequence
acaacgcacattttggaact

SEQ ID NO: 24844 - DNA, 20 bp, Unknown
  RNA secondary structure sequence
agagagaaataccaactcac

SEQ ID NO: 24845 - DNA, 20 bp, Unknown
  RNA secondary structure sequence
attggctcactaaaagctga

SEQ ID NO: 24846 - DNA, 20 bp, Unknown
  RNA secondary structure sequence
tgggatactgggttgaactc

SEQ ID NO: 24847 - DNA, 20 bp, Unknown
  RNA secondary structure sequence
gggaaaaccatggaaaacaa

SEQ ID NO: 24848 - DNA, 20 bp, Unknown
  RNA secondary structure sequence
atcgccagtgagacccacat

SEQ ID NO: 24849 - DNA, 20 bp, Unknown
  RNA secondary structure sequence
tccgcatttgaggaattgac

SEQ ID NO: 24850 - DNA, 20 bp, Unknown
  RNA secondary structure sequence
caactcaaggcacgtgacat

SEQ ID NO: 24851 - DNA, 20 bp, Unknown
  RNA secondary structure sequence
aagagcttccttgctaatgt

SEQ ID NO: 24852 - DNA, 20 bp, Unknown
  RNA secondary structure sequence
gtacatgacagcattaaaga

SEQ ID NO: 24853 - DNA, 20 bp, Unknown
  RNA secondary structure sequence
gcggagaaaccacaagctga

SEQ ID NO: 24854 - DNA, 20 bp, Unknown
  RNA secondary structure sequence
ggaccagtgaagaagcctgt

SEQ ID NO: 24855 - DNA, 20 bp, Unknown
  RNA secondary structure sequence
acggcttacctcgtgcctcg

SEQ ID NO: 24856 - DNA, 20 bp, Unknown
  RNA secondary structure sequence
gaggggttggtagtggacac

SEQ ID NO: 24857 - DNA, 20 bp, Unknown
  RNA secondary structure sequence
tccaaacacaagggcgatgc

SEQ ID NO: 24858 - DNA, 20 bp, Unknown
  RNA secondary structure sequence
cagtacaaaaacgtttggga

SEQ ID NO: 24859 - DNA, 20 bp, Unknown
  RNA secondary structure sequence
ttggactttgaagctctcaa

SEQ ID NO: 24860 - DNA, 20 bp, Unknown
  RNA secondary structure sequence
cccttttagggcccacgacc

SEQ ID NO: 24861 - DNA, 20 bp, Unknown
  RNA secondary structure sequence
agcacatgagcggtgggaac

SEQ ID NO: 24862 - DNA, 20 bp, Unknown
  RNA secondary structure sequence
caccatgactctggccgatt

SEQ ID NO: 24863 - DNA, 20 bp, Unknown
  RNA secondary structure sequence
ggacgtagattggcaggacc

SEQ ID NO: 24864 - DNA, 20 bp, Unknown
  RNA secondary structure sequence
ccacaacacaactacatcca

SEQ ID NO: 24865 - DNA, 20 bp, Unknown
  RNA secondary structure sequence
gcgtgacgtttcacaactca

SEQ ID NO: 24866 - DNA, 20 bp, Unknown
  RNA secondary structure sequence
gggacaggacaacgtcgagg

SEQ ID NO: 24867 - DNA, 20 bp, Unknown
  RNA secondary structure sequence
accgcgcacagcgtttcccg

SEQ ID NO: 24868 - DNA, 20 bp, Unknown
  RNA secondary structure sequence
tggcgctgatcttgaatttc

SEQ ID NO: 24869 - DNA, 20 bp, Unknown
  RNA secondary structure sequence
tacgatcaccgcctcaaaga

SEQ ID NO: 24870 - DNA, 20 bp, Unknown
  RNA secondary structure sequence
ggacaacccagttgttcacg

SEQ ID NO: 24871 - DNA, 20 bp, Unknown
  RNA secondary structure sequence
aatcacaagatgcaggccca

SEQ ID NO: 24872 - DNA, 20 bp, Unknown
  RNA secondary structure sequence
cagcaccttcgtcgtgaaga

SEQ ID NO: 24873 - DNA, 20 bp, Unknown
  RNA secondary structure sequence
ggtctccaccacagggttca

SEQ ID NO: 24874 - DNA, 20 bp, Unknown
  RNA secondary structure sequence
tccctgggccctccagggga

SEQ ID NO: 24875 - DNA, 20 bp, Unknown
  RNA secondary structure sequence
aggtggaatgccctcgggtt

SEQ ID NO: 24876 - DNA, 20 bp, Unknown
  RNA secondary structure sequence
tgttgattcttggattgaat

SEQ ID NO: 24877 - DNA, 20 bp, Unknown
  RNA secondary structure sequence
cggaggaactgattgaaatg

SEQ ID NO: 24878 - DNA, 20 bp, Unknown
  RNA secondary structure sequence
atcttccaatcacaggctcc

SEQ ID NO: 24879 - DNA, 20 bp, Unknown
  RNA secondary structure sequence
gatccgtatattttaaagaa

SEQ ID NO: 24880 - DNA, 20 bp, Unknown
  RNA secondary structure sequence
tggttacattttgttaatta

SEQ ID NO: 24881 - DNA, 20 bp, Unknown
  RNA secondary structure sequence
ctaattggaaatgctacggt

SEQ ID NO: 24882 - DNA, 20 bp, Unknown
  RNA secondary structure sequence
aacatttaccgtatattcag

SEQ ID NO: 24883 - DNA, 20 bp, Unknown
  RNA secondary structure sequence
caattttttcaactaaaaag

SEQ ID NO: 24884 - DNA, 20 bp, Unknown
  RNA secondary structure sequence
accaccaaacatgacaccag

SEQ ID NO: 24885 - DNA, 20 bp, Unknown
  RNA secondary structure sequence
atcaatacacatatactcgt

SEQ ID NO: 24886 - DNA, 20 bp, Unknown
  RNA secondary structure sequence
cacaagcatttcgtaacgtg

SEQ ID NO: 24887 - DNA, 20 bp, Unknown
  RNA secondary structure sequence
ggacggatgtatcaacacaa

SEQ ID NO: 24888 - DNA, 20 bp, Unknown
  RNA secondary structure sequence
agcatttaatcttttaagat

SEQ ID NO: 24889 - DNA, 20 bp, Unknown
  RNA secondary structure sequence
atgcctacttgacctcccac

SEQ ID NO: 24890 - DNA, 20 bp, Unknown
  RNA secondary structure sequence
ggactgcggtgcatgtgact

SEQ ID NO: 24891 - DNA, 20 bp, Unknown
  RNA secondary structure sequence
agttgacaagacacatggct

SEQ ID NO: 24892 - DNA, 20 bp, Unknown
  RNA secondary structure sequence
acgaacaacaccggctcttc

SEQ ID NO: 24893 - DNA, 20 bp, Unknown
  RNA secondary structure sequence
cttcccttgcagggaaaatg

SEQ ID NO: 24894 - DNA, 20 bp, Unknown
  RNA secondary structure sequence
atggtcctgtctcctcttct

SEQ ID NO: 24895 - DNA, 20 bp, Unknown
  RNA secondary structure sequence
ttgagggcgccggcaaactt

SEQ ID NO: 24896 - DNA, 20 bp, Unknown
  RNA secondary structure sequence
ctgtccctctccccaatcca

SEQ ID NO: 24897 - DNA, 20 bp, Unknown
  RNA secondary structure sequence
tgattgaacctgtccttctt

SEQ ID NO: 24898 - DNA, 20 bp, Unknown
  RNA secondary structure sequence
ccggaccatcatccgctccc

SEQ ID NO: 24899 - DNA, 20 bp, Unknown
  RNA secondary structure sequence
aacctcgtaccaccttctcc

SEQ ID NO: 24900 - DNA, 20 bp, Unknown
  RNA secondary structure sequence
tgactaacgatgtccccacc

SEQ ID NO: 24901 - DNA, 20 bp, Unknown
  RNA secondary structure sequence
cccttctgtctggttgtgcc

SEQ ID NO: 24902 - DNA, 20 bp, Unknown
  RNA secondary structure sequence
atatctcaatggcagcaaac

SEQ ID NO: 24903 - DNA, 20 bp, Unknown
  RNA secondary structure sequence
ctttctccaaaaccttcact

SEQ ID NO: 24904 - DNA, 20 bp, Unknown
  RNA secondary structure sequence
tcacgcgctgtcgcgagctc

SEQ ID NO: 24905 - DNA, 20 bp, Unknown
  RNA secondary structure sequence
ctggcaagtccctccttgct

SEQ ID NO: 24906 - DNA, 20 bp, Unknown
  RNA secondary structure sequence
gccaacatcgcgatctccgt

SEQ ID NO: 24907 - DNA, 20 bp, Unknown
  RNA secondary structure sequence
ccttccagggtctctgtggt

SEQ ID NO: 24908 - DNA, 20 bp, Unknown
  RNA secondary structure sequence
ccatccacgctatcatcgct

SEQ ID NO: 24909 - DNA, 20 bp, Unknown
  RNA secondary structure sequence
ttgatgccaccctcccttcc

SEQ ID NO: 24910 - DNA, 20 bp, Unknown
  RNA secondary structure sequence
ttgttgtgactccagcaaac

SEQ ID NO: 24911 - DNA, 20 bp, Unknown
  RNA secondary structure sequence
gtgaacaagtgccacgtaca

SEQ ID NO: 24912 - DNA, 20 bp, Unknown
  RNA secondary structure sequence
gacaagccaacagtcgacat

SEQ ID NO: 24913 - DNA, 20 bp, Unknown
  RNA secondary structure sequence
cagatttttggagcagcctt

SEQ ID NO: 24914 - DNA, 20 bp, Unknown
  RNA secondary structure sequence
tccgtttcaagaatggaaaa

SEQ ID NO: 24915 - DNA, 20 bp, Unknown
  RNA secondary structure sequence
tgcggaactagaggaccatc

SEQ ID NO: 24916 - DNA, 20 bp, Unknown
  RNA secondary structure sequence
ccccctagtgaagttctcac

SEQ ID NO: 24917 - DNA, 20 bp, Unknown
  RNA secondary structure sequence
tgggaaaaggacgcggaagt

SEQ ID NO: 24918 - DNA, 20 bp, Unknown
  RNA secondary structure sequence
agggccagaaacattcagac

SEQ ID NO: 24919 - DNA, 20 bp, Unknown
  RNA secondary structure sequence
gaagtggaagtcccagagag

SEQ ID NO: 24920 - DNA, 20 bp, Unknown
  RNA secondary structure sequence
tttcagaaaacaaaaaatca

SEQ ID NO: 24921 - DNA, 20 bp, Unknown
  RNA secondary structure sequence
gctgctcagaggagaggacg

SEQ ID NO: 24922 - DNA, 20 bp, Unknown
  RNA secondary structure sequence
ctgggaacactgccaggaca

SEQ ID NO: 24923 - DNA, 20 bp, Unknown
  RNA secondary structure sequence
caaagatctccccaagataa

SEQ ID NO: 24924 - DNA, 20 bp, Unknown
  RNA secondary structure sequence
ggagtcccgctgctaatgat

SEQ ID NO: 24925 - DNA, 20 bp, Unknown
  RNA secondary structure sequence
gaaggctctccaaacaaata

SEQ ID NO: 24926 - DNA, 20 bp, Unknown
  RNA secondary structure sequence
cgtctgaatcagatgtcggc

SEQ ID NO: 24927 - DNA, 20 bp, Unknown
  RNA secondary structure sequence
ccctatgggaaggttgttga

SEQ ID NO: 24928 - DNA, 20 bp, Unknown
  RNA secondary structure sequence
gacgtcttccacatggcggc

SEQ ID NO: 24929 - DNA, 20 bp, Unknown
  RNA secondary structure sequence
agcactatgatggaaaccat

SEQ ID NO: 24930 - DNA, 20 bp, Unknown
  RNA secondary structure sequence
agggtgccagatccccaaga

SEQ ID NO: 24931 - DNA, 20 bp, Unknown
  RNA secondary structure sequence
atttcaagacaagaccagag

SEQ ID NO: 24932 - DNA, 20 bp, Unknown
  RNA secondary structure sequence
tgctcccaccacttcaacaa

SEQ ID NO: 24933 - DNA, 20 bp, Unknown
  RNA secondary structure sequence
ttccacagaagagaccttcg

SEQ ID NO: 24934 - DNA, 20 bp, Unknown
  RNA secondary structure sequence
cgccatggcacggaagaagc

SEQ ID NO: 24935 - DNA, 20 bp, Unknown
  RNA secondary structure sequence
gggtttggaccagttaggct

SEQ ID NO: 24936 - DNA, 20 bp, Unknown
  RNA secondary structure sequence
atggatgttggcgaactctg

SEQ ID NO: 24937 - DNA, 20 bp, Unknown
  RNA secondary structure sequence
cttctcaagacagctgcctc

SEQ ID NO: 24938 - DNA, 20 bp, Unknown
  RNA secondary structure sequence
aggacgctgtttggtggcat

SEQ ID NO: 24939 - DNA, 20 bp, Unknown
  RNA secondary structure sequence
catttgatcatcccacacac

SEQ ID NO: 24940 - DNA, 20 bp, Unknown
  RNA secondary structure sequence
gggacagcgttcgctgaagt

SEQ ID NO: 24941 - DNA, 20 bp, Unknown
  RNA secondary structure sequence
gggatgttgggcctggtgat

SEQ ID NO: 24942 - DNA, 20 bp, Unknown
  RNA secondary structure sequence
accagcccaaggcttgatgt

SEQ ID NO: 24943 - DNA, 20 bp, Unknown
  RNA secondary structure sequence
gggatattcaacacagccac

SEQ ID NO: 24944 - DNA, 20 bp, Unknown
  RNA secondary structure sequence
gagacccaaccacaggtggt

SEQ ID NO: 24945 - DNA, 20 bp, Unknown
  RNA secondary structure sequence
gagatgggtgaggctctgaa

SEQ ID NO: 24946 - DNA, 20 bp, Unknown
  RNA secondary structure sequence
aaagggtttgaatgggtcac

SEQ ID NO: 24947 - DNA, 20 bp, Unknown
  RNA secondary structure sequence
tttgtgatcacaacagacat

SEQ ID NO: 24948 - DNA, 20 bp, Unknown
  RNA secondary structure sequence
aatccgagtagaacaggtga

SEQ ID NO: 24949 - DNA, 20 bp, Unknown
  RNA secondary structure sequence
atctacagactgcgggagcc

SEQ ID NO: 24950 - DNA, 20 bp, Unknown
  RNA secondary structure sequence
atagggaaaatgactgcggg

SEQ ID NO: 24951 - DNA, 20 bp, Unknown
  RNA secondary structure sequence
ctgtacgcagtcattaccat

SEQ ID NO: 24952 - DNA, 20 bp, Unknown
  RNA secondary structure sequence
ccaaagggaacatccgcctc

SEQ ID NO: 24953 - DNA, 20 bp, Unknown
  RNA secondary structure sequence
gcagacttggatgacgaagc

SEQ ID NO: 24954 - DNA, 20 bp, Unknown
  RNA secondary structure sequence
caggtggtgacatacgcact

SEQ ID NO: 24955 - DNA, 20 bp, Unknown
  RNA secondary structure sequence
ctaaacaaaaaccgttgcac

SEQ ID NO: 24956 - DNA, 20 bp, Unknown
  RNA secondary structure sequence
cccgcgcccataaccaacat

SEQ ID NO: 24957 - DNA, 20 bp, Unknown
  RNA secondary structure sequence
ggagtaggaccagtcagaat

SEQ ID NO: 24958 - DNA, 20 bp, Unknown
  RNA secondary structure sequence
gttgtgaaagctctggatgt

SEQ ID NO: 24959 - DNA, 20 bp, Unknown
  RNA secondary structure sequence
tctatcacagtgcaccatca

SEQ ID NO: 24960 - DNA, 20 bp, Unknown
  RNA secondary structure sequence
gatgtgaagatgatgaacat

SEQ ID NO: 24961 - DNA, 20 bp, Unknown
  RNA secondary structure sequence
ggttggggtaatggttgtgg

SEQ ID NO: 24962 - DNA, 20 bp, Unknown
  RNA secondary structure sequence
tctgatggaccatgtcgtat

SEQ ID NO: 24963 - DNA, 20 bp, Unknown
  RNA secondary structure sequence
ctggagcataacatgtggaa

SEQ ID NO: 24964 - DNA, 20 bp, Unknown
  RNA secondary structure sequence
gttgcctccgccagaacaac

SEQ ID NO: 24965 - DNA, 20 bp, Unknown
  RNA secondary structure sequence
gcgttgcacgactggaacat

SEQ ID NO: 24966 - DNA, 20 bp, Unknown
  RNA secondary structure sequence
cttatcatcggagttatgtc

SEQ ID NO: 24967 - DNA, 20 bp, Unknown
  RNA secondary structure sequence
gaggatgcccaaataacagg

SEQ ID NO: 24968 - DNA, 20 bp, Unknown
  RNA secondary structure sequence
atgtggcatgtgacgaatgg

SEQ ID NO: 24969 - DNA, 20 bp, Unknown
  RNA secondary structure sequence
atttcccaaggccagcgaat

SEQ ID NO: 24970 - DNA, 20 bp, Unknown
  RNA secondary structure sequence
ttgtttgtgatggatgaagc

SEQ ID NO: 24971 - DNA, 20 bp, Unknown
  RNA secondary structure sequence
aaaatgcttccagagcattt

SEQ ID NO: 24972 - DNA, 20 bp, Unknown
  RNA secondary structure sequence
gatggaatcgtggcaacgga

SEQ ID NO: 24973 - DNA, 20 bp, Unknown
  RNA secondary structure sequence
acctggaactaccatggaag

SEQ ID NO: 24974 - DNA, 20 bp, Unknown
  RNA secondary structure sequence
aagtgggcatcagctcggga

SEQ ID NO: 24975 - DNA, 20 bp, Unknown
  RNA secondary structure sequence
gatgtgatttccagggaaga

SEQ ID NO: 24976 - DNA, 20 bp, Unknown
  RNA secondary structure sequence
gacgtccctttctgttcaca

SEQ ID NO: 24977 - DNA, 20 bp, Unknown
  RNA secondary structure sequence
ctactcatgtactttcacag

SEQ ID NO: 24978 - DNA, 20 bp, Unknown
  RNA secondary structure sequence
aacgaacacatggaagacaa

SEQ ID NO: 24979 - DNA, 20 bp, Unknown
  RNA secondary structure sequence
agtcaggccacaggttttgt

SEQ ID NO: 24980 - DNA, 20 bp, Unknown
  RNA secondary structure sequence
ggccaaaaggtctcgctccc

SEQ ID NO: 24981 - DNA, 20 bp, Unknown
  RNA secondary structure sequence
gccctgttcatgtccattga

SEQ ID NO: 24982 - DNA, 20 bp, Unknown
  RNA secondary structure sequence
atttacgaagggaaaacaaa

SEQ ID NO: 24983 - DNA, 20 bp, Unknown
  RNA secondary structure sequence
aatcgatgtgtgggaaagaa

SEQ ID NO: 24984 - DNA, 20 bp, Unknown
  RNA secondary structure sequence
gcggctatgacttgtcgctt

SEQ ID NO: 24985 - DNA, 20 bp, Unknown
  RNA secondary structure sequence
cagagtggctttggatacag

SEQ ID NO: 24986 - DNA, 20 bp, Unknown
  RNA secondary structure sequence
tcactcttgattggcggtgc

SEQ ID NO: 24987 - DNA, 20 bp, Unknown
  RNA secondary structure sequence
aactcgacgttgctcgtcct

SEQ ID NO: 24988 - DNA, 20 bp, Unknown
  RNA secondary structure sequence
ccgacgtacctggccggttc

SEQ ID NO: 24989 - DNA, 20 bp, Unknown
  RNA secondary structure sequence
aacgatagtacattgtttat

SEQ ID NO: 24990 - DNA, 20 bp, Unknown
  RNA secondary structure sequence
atagacgagatggatcagat

SEQ ID NO: 24991 - DNA, 20 bp, Unknown
  RNA secondary structure sequence
tggtttactgaagcatacgt

SEQ ID NO: 24992 - DNA, 20 bp, Unknown
  RNA secondary structure sequence
tttttcaagtatcacacagg

SEQ ID NO: 24993 - DNA, 20 bp, Unknown
  RNA secondary structure sequence
atcaaacaaacaaagagatt

SEQ ID NO: 24994 - DNA, 20 bp, Unknown
  RNA secondary structure sequence
gagaaaggcattgacagcat

SEQ ID NO: 24995 - DNA, 20 bp, Unknown
  RNA secondary structure sequence
cggcgtggaagaactggacg

SEQ ID NO: 24996 - DNA, 20 bp, Unknown
  RNA secondary structure sequence
gcccccaggttccacgacga

SEQ ID NO: 24997 - DNA, 20 bp, Unknown
  RNA secondary structure sequence
cgcgacacaatcgaaaacct

SEQ ID NO: 24998 - DNA, 20 bp, Unknown
  RNA secondary structure sequence
gcgtccgtgattggaggagt

SEQ ID NO: 24999 - DNA, 20 bp, Unknown
  RNA secondary structure sequence
tcgctggtgaagactgacac

SEQ ID NO: 25000 - DNA, 20 bp, Unknown
  RNA secondary structure sequence
ggcgtcgacgtgtatgccga

SEQ ID NO: 25001 - DNA, 20 bp, Unknown
  RNA secondary structure sequence
ccctatcacatcgaagtgct

SEQ ID NO: 25002 - DNA, 20 bp, Unknown
  RNA secondary structure sequence
cagtccttcaactaccacgg

SEQ ID NO: 25003 - DNA, 20 bp, Unknown
  RNA secondary structure sequence
gtcgacacgctaacagtcga

SEQ ID NO: 25004 - DNA, 20 bp, Unknown
  RNA secondary structure sequence
tcccaccatttccacgcctt

SEQ ID NO: 25005 - DNA, 20 bp, Unknown
  RNA secondary structure sequence
caccggcgagacctgcggct

SEQ ID NO: 25006 - DNA, 20 bp, Unknown
  RNA secondary structure sequence
accaaagaccttgtcaaagc

SEQ ID NO: 25007 - DNA, 20 bp, Unknown
  RNA secondary structure sequence
ggtttccagcccgcgcaagg

SEQ ID NO: 25008 - DNA, 20 bp, Unknown
  RNA secondary structure sequence
aaaacaaaacaaagtgcaag

SEQ ID NO: 25009 - DNA, 20 bp, Unknown
  RNA secondary structure sequence
ggactggctggtcgcaagaa

SEQ ID NO: 25010 - DNA, 20 bp, Unknown
  RNA secondary structure sequence
gtcaacactttggatgcggg

SEQ ID NO: 25011 - DNA, 20 bp, Unknown
  RNA secondary structure sequence
agggtagttattgccatctt

SEQ ID NO: 25012 - DNA, 20 bp, Unknown
  RNA secondary structure sequence
gtgacttttgttccgaccac

SEQ ID NO: 25013 - DNA, 20 bp, Unknown
  RNA secondary structure sequence
tggcagagtggaacaggagg

SEQ ID NO: 25014 - DNA, 20 bp, Unknown
  RNA secondary structure sequence
ggaggtcatgtgacgtgtaa

SEQ ID NO: 25015 - DNA, 20 bp, Unknown
  RNA secondary structure sequence
ataaccaagatattgattgg

SEQ ID NO: 25016 - DNA, 20 bp, Unknown
  RNA secondary structure sequence
aagatcatacctgaatggtg

SEQ ID NO: 25017 - DNA, 20 bp, Unknown
  RNA secondary structure sequence
gctggcatgggactgaagga

SEQ ID NO: 25018 - DNA, 20 bp, Unknown
  RNA secondary structure sequence
gtggaacaaactgacacagg

SEQ ID NO: 25019 - DNA, 20 bp, Unknown
  RNA secondary structure sequence
aaaaacggaaaagaaatagg

SEQ ID NO: 25020 - DNA, 20 bp, Unknown
  RNA secondary structure sequence
gaaacacgactaagagaaga

SEQ ID NO: 25021 - DNA, 20 bp, Unknown
  RNA secondary structure sequence
aaaatgcgggaagcgatcga

SEQ ID NO: 25022 - DNA, 20 bp, Unknown
  RNA secondary structure sequence
attgctgtagcgttttcagg

SEQ ID NO: 25023 - DNA, 20 bp, Unknown
  RNA secondary structure sequence
aaagtgccagacattactga

SEQ ID NO: 25024 - DNA, 20 bp, Unknown
  RNA secondary structure sequence
cccactggaacgcgaagcgt

SEQ ID NO: 25025 - DNA, 20 bp, Unknown
  RNA secondary structure sequence
aaactggttgatgatgagag

SEQ ID NO: 25026 - DNA, 20 bp, Unknown
  RNA secondary structure sequence
acttatgccctgaacaccgt

SEQ ID NO: 25027 - DNA, 20 bp, Unknown
  RNA secondary structure sequence
gcaatcaactcgaccgttcc

SEQ ID NO: 25028 - DNA, 20 bp, Unknown
  RNA secondary structure sequence
tgactctcacgcttactcca

SEQ ID NO: 25029 - DNA, 20 bp, Unknown
  RNA secondary structure sequence
tcatgccagccccaataaca

SEQ ID NO: 25030 - DNA, 20 bp, Unknown
  RNA secondary structure sequence
tgggtcgttactttggaaat

SEQ ID NO: 25031 - DNA, 20 bp, Unknown
  RNA secondary structure sequence
agtccacctttgaatttgtt

SEQ ID NO: 25032 - DNA, 20 bp, Unknown
  RNA secondary structure sequence
cctataccgtttttgctatg

SEQ ID NO: 25033 - DNA, 20 bp, Unknown
  RNA secondary structure sequence
atgtgcccagacctttaccc

SEQ ID NO: 25034 - DNA, 20 bp, Unknown
  RNA secondary structure sequence
ttggagtaacccccggttca

SEQ ID NO: 25035 - DNA, 20 bp, Unknown
  RNA secondary structure sequence
gcccggagtggaaaaacctt

SEQ ID NO: 25036 - DNA, 20 bp, Unknown
  RNA secondary structure sequence
ctaaacacgtgaataacgtg

SEQ ID NO: 25037 - DNA, 20 bp, Unknown
  RNA secondary structure sequence
caggtttgccctacaaaaag

SEQ ID NO: 25038 - DNA, 20 bp, Unknown
  RNA secondary structure sequence
tacgtggtgggctgccttca

SEQ ID NO: 25039 - DNA, 20 bp, Unknown
  RNA secondary structure sequence
tttcttggtataaacctgga

SEQ ID NO: 25040 - DNA, 20 bp, Unknown
  RNA secondary structure sequence
gatgctggatggtcacgttg

SEQ ID NO: 25041 - DNA, 20 bp, Unknown
  RNA secondary structure sequence
gtagcgatgctgtgtgtgtg

SEQ ID NO: 25042 - DNA, 20 bp, Unknown
  RNA secondary structure sequence
ttgatgcttctgcccaaggt

SEQ ID NO: 25043 - DNA, 20 bp, Unknown
  RNA secondary structure sequence
atcctaaagacacaaatgtt

SEQ ID NO: 25044 - DNA, 20 bp, Unknown
  RNA secondary structure sequence
ttgctaaagtgcccagtttt

SEQ ID NO: 25045 - DNA, 20 bp, Unknown
  RNA secondary structure sequence
attttgtagtcccttttata

SEQ ID NO: 25046 - DNA, 20 bp, Unknown
  RNA secondary structure sequence
cttccttcctgtttgctcaa

SEQ ID NO: 25047 - DNA, 20 bp, Unknown
  RNA secondary structure sequence
gtgactcctttcagagaccg

SEQ ID NO: 25048 - DNA, 20 bp, Unknown
  RNA secondary structure sequence
taggcaaatctgctgcagct

SEQ ID NO: 25049 - DNA, 20 bp, Unknown
  RNA secondary structure sequence
gtttctgtcaaatggtttct

SEQ ID NO: 25050 - DNA, 20 bp, Unknown
  RNA secondary structure sequence
cctttgtaatgctttacaaa

SEQ ID NO: 25051 - DNA, 20 bp, Unknown
  RNA secondary structure sequence
aggtgatcttctcaaaacat

SEQ ID NO: 25052 - DNA, 20 bp, Unknown
  RNA secondary structure sequence
aaaaggtcaaagcaggaaag

SEQ ID NO: 25053 - DNA, 20 bp, Unknown
  RNA secondary structure sequence
aactcagtggctttccttat

SEQ ID NO: 25054 - DNA, 20 bp, Unknown
  RNA secondary structure sequence
acaagagactccagattgct

SEQ ID NO: 25055 - DNA, 20 bp, Unknown
  RNA secondary structure sequence
acctcgaggcaatgttgtct

SEQ ID NO: 25056 - DNA, 20 bp, Unknown
  RNA secondary structure sequence
taaagttgtcaatatgggtg

SEQ ID NO: 25057 - DNA, 20 bp, Unknown
  RNA secondary structure sequence
tggaatggcaagttctgctt

SEQ ID NO: 25058 - DNA, 20 bp, Unknown
  RNA secondary structure sequence
ggaaattgcccactcacact

SEQ ID NO: 25059 - DNA, 20 bp, Unknown
  RNA secondary structure sequence
cagacctttccaccactctt

SEQ ID NO: 25060 - DNA, 20 bp, Unknown
  RNA secondary structure sequence
tcaaccttactttgagattt

SEQ ID NO: 25061 - DNA, 20 bp, Unknown
  RNA secondary structure sequence
taagggcaagttgcttcttt

SEQ ID NO: 25062 - DNA, 20 bp, Unknown
  RNA secondary structure sequence
ctccgtggtaaacacggatg

SEQ ID NO: 25063 - DNA, 20 bp, Unknown
  RNA secondary structure sequence
tgacaatgcggagaaaggta

SEQ ID NO: 25064 - DNA, 20 bp, Unknown
  RNA secondary structure sequence
tagtacaaccactgttacat

SEQ ID NO: 25065 - DNA, 20 bp, Unknown
  RNA secondary structure sequence
tgacaagaaatcactcaagg

SEQ ID NO: 25066 - DNA, 20 bp, Unknown
  RNA secondary structure sequence
tgtcagcaagctgaaaagaa

SEQ ID NO: 25067 - DNA, 20 bp, Unknown
  RNA secondary structure sequence
catatttgaaatcttggaag

SEQ ID NO: 25068 - DNA, 20 bp, Unknown
  RNA secondary structure sequence
tactgccatggaaacagctt

SEQ ID NO: 25069 - DNA, 20 bp, Unknown
  RNA secondary structure sequence
gcggcctccacgctctttgt

SEQ ID NO: 25070 - DNA, 20 bp, Unknown
  RNA secondary structure sequence
accagggtttaggtctttca

SEQ ID NO: 25071 - DNA, 20 bp, Unknown
  RNA secondary structure sequence
tgacacaaaattctggacag

SEQ ID NO: 25072 - DNA, 20 bp, Unknown
  RNA secondary structure sequence
gtgtggcccctgcaaaccac

SEQ ID NO: 25073 - DNA, 20 bp, Unknown
  RNA secondary structure sequence
acggcatttctttccttgac

SEQ ID NO: 25074 - DNA, 20 bp, Unknown
  RNA secondary structure sequence
tggtggtgcagtcgcccaaa

SEQ ID NO: 25075 - DNA, 20 bp, Unknown
  RNA secondary structure sequence
ccttgataaaacagtttctc

SEQ ID NO: 25076 - DNA, 20 bp, Unknown
  RNA secondary structure sequence
caattgactcagttgaacaa

SEQ ID NO: 25077 - DNA, 20 bp, Unknown
  RNA secondary structure sequence
ctctacacccaggaaccagg

SEQ ID NO: 25078 - DNA, 20 bp, Unknown
  RNA secondary structure sequence
ccagaattggtgattgtccc

SEQ ID NO: 25079 - DNA, 20 bp, Unknown
  RNA secondary structure sequence
agtccatctttgaacttctt

SEQ ID NO: 25080 - DNA, 20 bp, Unknown
  RNA secondary structure sequence
acgcgatttaccaaggaaag

SEQ ID NO: 25081 - DNA, 20 bp, Unknown
  RNA secondary structure sequence
gtgtaattggtataacatag

SEQ ID NO: 25082 - DNA, 20 bp, Unknown
  RNA secondary structure sequence
gaagggtaagaaattctctt

SEQ ID NO: 25083 - DNA, 20 bp, Unknown
  RNA secondary structure sequence
tactaggattgtgggaccag

SEQ ID NO: 25084 - DNA, 20 bp, Unknown
  RNA secondary structure sequence
cgcaccaatcgtgttaatgg

SEQ ID NO: 25085 - DNA, 20 bp, Unknown
  RNA secondary structure sequence
tagggcgtggtatgaggaag

SEQ ID NO: 25086 - DNA, 20 bp, Unknown
  RNA secondary structure sequence
cggaatgactctggctgact

SEQ ID NO: 25087 - DNA, 20 bp, Unknown
  RNA secondary structure sequence
ggtggggaacctgggatccg

SEQ ID NO: 25088 - DNA, 20 bp, Unknown
  RNA secondary structure sequence
caggttccctacatcactaa

SEQ ID NO: 25089 - DNA, 20 bp, Unknown
  RNA secondary structure sequence
tctgaagaacttaaaaggct

SEQ ID NO: 25090 - DNA, 20 bp, Unknown
  RNA secondary structure sequence
tcccagtattgccttcaacc

SEQ ID NO: 25091 - DNA, 20 bp, Unknown
  RNA secondary structure sequence
agctggacttaagataccaa

SEQ ID NO: 25092 - DNA, 20 bp, Unknown
  RNA secondary structure sequence
gcggggtagagtaggacggg

SEQ ID NO: 25093 - DNA, 20 bp, Unknown
  RNA secondary structure sequence
ggaagacagcttgttaataa

SEQ ID NO: 25094 - DNA, 20 bp, Unknown
  RNA secondary structure sequence
aaaacaggtatcaggtttat

SEQ ID NO: 25095 - DNA, 20 bp, Unknown
  RNA secondary structure sequence
aatgatgtcccaaaacccag

SEQ ID NO: 25096 - DNA, 20 bp, Unknown
  RNA secondary structure sequence
tgcagagttgaaaccggtaa

SEQ ID NO: 25097 - DNA, 20 bp, Unknown
  RNA secondary structure sequence
ggaggaaaaggcaatacccc

SEQ ID NO: 25098 - DNA, 20 bp, Unknown
  RNA secondary structure sequence
gagacccttatttgaggaac

SEQ ID NO: 25099 - DNA, 20 bp, Unknown
  RNA secondary structure sequence
cttgaaattaaaagatcttt

SEQ ID NO: 25100 - DNA, 20 bp, Unknown
  RNA secondary structure sequence
atgggtcaagcaaaaacctg

SEQ ID NO: 25101 - DNA, 20 bp, Unknown
  RNA secondary structure sequence
aatactagaaggagaccaaa

SEQ ID NO: 25102 - DNA, 20 bp, Unknown
  RNA secondary structure sequence
gggcactgccgcatatgaga

SEQ ID NO: 25103 - DNA, 20 bp, Unknown
  RNA secondary structure sequence
agtttctagcaagactggca

SEQ ID NO: 25104 - DNA, 20 bp, Unknown
  RNA secondary structure sequence
tcaattataaacttccggct

SEQ ID NO: 25105 - DNA, 20 bp, Unknown
  RNA secondary structure sequence
aaccacggccggcttcgcac

SEQ ID NO: 25106 - DNA, 20 bp, Unknown
  RNA secondary structure sequence
aatgcctgaccatggtaaat

SEQ ID NO: 25107 - DNA, 20 bp, Unknown
  RNA secondary structure sequence
gtctcgtcacaccggtagcc

SEQ ID NO: 25108 - DNA, 20 bp, Unknown
  RNA secondary structure sequence
aagatcactccgttgagctc

SEQ ID NO: 25109 - DNA, 20 bp, Unknown
  RNA secondary structure sequence
acaccactctatcgtacaac

SEQ ID NO: 25110 - DNA, 20 bp, Unknown
  RNA secondary structure sequence
caactgtcgcgatgcttact

SEQ ID NO: 25111 - DNA, 20 bp, Unknown
  RNA secondary structure sequence
agatcctcacgttttgcttg

SEQ ID NO: 25112 - DNA, 20 bp, Unknown
  RNA secondary structure sequence
aagggggaaacttccgtgac

SEQ ID NO: 25113 - DNA, 20 bp, Unknown
  RNA secondary structure sequence
agcgtggagtaggtgtggca

SEQ ID NO: 25114 - DNA, 20 bp, Unknown
  RNA secondary structure sequence
ggaccataatcctgacaccc

SEQ ID NO: 25115 - DNA, 20 bp, Unknown
  RNA secondary structure sequence
gggtggcgctcattgtcatg

SEQ ID NO: 25116 - DNA, 20 bp, Unknown
  RNA secondary structure sequence
ctagtagcgacgaaacctct

SEQ ID NO: 25117 - DNA, 20 bp, Unknown
  RNA secondary structure sequence
ccttagttggggaagacctg

SEQ ID NO: 25118 - DNA, 20 bp, Unknown
  RNA secondary structure sequence
caatgctgtcggccattgga

SEQ ID NO: 25119 - DNA, 20 bp, Unknown
  RNA secondary structure sequence
tggaggagacagtgacgtcc

SEQ ID NO: 25120 - DNA, 20 bp, Unknown
  RNA secondary structure sequence
acccaaatctcaccaaagag

SEQ ID NO: 25121 - DNA, 20 bp, Unknown
  RNA secondary structure sequence
gcttggcacacagtaggaat

SEQ ID NO: 25122 - DNA, 20 bp, Unknown
  RNA secondary structure sequence
cagcagctagcgtgtctgcc

SEQ ID NO: 25123 - DNA, 20 bp, Unknown
  RNA secondary structure sequence
gggtcagtcgtgaaaacttt

SEQ ID NO: 25124 - DNA, 20 bp, Unknown
  RNA secondary structure sequence
aactgactgcaaaccccttc

SEQ ID NO: 25125 - DNA, 20 bp, Unknown
  RNA secondary structure sequence
ttgcctcttccttagactac

SEQ ID NO: 25126 - DNA, 20 bp, Unknown
  RNA secondary structure sequence
tcgggcgaacatcctggtca

SEQ ID NO: 25127 - DNA, 20 bp, Unknown
  RNA secondary structure sequence
gcaagaatgccatcatctgt

SEQ ID NO: 25128 - DNA, 20 bp, Unknown
  RNA secondary structure sequence
tcgttggctggcctttcttc

SEQ ID NO: 25129 - DNA, 20 bp, Unknown
  RNA secondary structure sequence
tgcctggcggctttgcgcta

SEQ ID NO: 25130 - DNA, 20 bp, Unknown
  RNA secondary structure sequence
aacgacgtcaccacagacgt

SEQ ID NO: 25131 - DNA, 20 bp, Unknown
  RNA secondary structure sequence
gccggtggtgccccctctgc

SEQ ID NO: 25132 - DNA, 20 bp, Unknown
  RNA secondary structure sequence
tcttggtctgagacgatcgc

SEQ ID NO: 25133 - DNA, 20 bp, Unknown
  RNA secondary structure sequence
ttcaactgtggcttcgatgt

SEQ ID NO: 25134 - DNA, 20 bp, Unknown
  RNA secondary structure sequence
tcgggagccgatggtgcaga

SEQ ID NO: 25135 - DNA, 20 bp, Unknown
  RNA secondary structure sequence
ttctatgcccccccgggtgc

SEQ ID NO: 25136 - DNA, 20 bp, Unknown
  RNA secondary structure sequence
caaaacggcggagatgcagg

SEQ ID NO: 25137 - DNA, 20 bp, Unknown
  RNA secondary structure sequence
tccatcgttcgtgtcgctcg

SEQ ID NO: 25138 - DNA, 20 bp, Unknown
  RNA secondary structure sequence
atgttctctcatggcgacga

SEQ ID NO: 25139 - DNA, 20 bp, Unknown
  RNA secondary structure sequence
cgcgcagtccccccccttac

SEQ ID NO: 25140 - DNA, 20 bp, Unknown
  RNA secondary structure sequence
ctttccgccgcgctcgagag

SEQ ID NO: 25141 - DNA, 20 bp, Unknown
  RNA secondary structure sequence
ttctcagcggcggctgctct

SEQ ID NO: 25142 - DNA, 20 bp, Unknown
  RNA secondary structure sequence
agctcccttcgcgaccgggc

SEQ ID NO: 25143 - DNA, 20 bp, Unknown
  RNA secondary structure sequence
cgccctgtctctttcctctc

SEQ ID NO: 25144 - DNA, 20 bp, Unknown
  RNA secondary structure sequence
ctcccaaaacaacctgtgta

SEQ ID NO: 25145 - DNA, 20 bp, Unknown
  RNA secondary structure sequence
atcctcggtatccacgtcgc

SEQ ID NO: 25146 - DNA, 20 bp, Unknown
  RNA secondary structure sequence
atccctcccgcctttggtgc

SEQ ID NO: 25147 - DNA, 20 bp, Unknown
  RNA secondary structure sequence
tcccagcttcctgataacct

SEQ ID NO: 25148 - DNA, 20 bp, Unknown
  RNA secondary structure sequence
gccatcgattccgtctggga

SEQ ID NO: 25149 - DNA, 20 bp, Unknown
  RNA secondary structure sequence
ggtaaccctctccagcatgg

SEQ ID NO: 25150 - DNA, 20 bp, Unknown
  RNA secondary structure sequence
tttgacatcactttccttaa

SEQ ID NO: 25151 - DNA, 20 bp, Unknown
  RNA secondary structure sequence
aactactcggcttggtgtga

SEQ ID NO: 25152 - DNA, 20 bp, Unknown
  RNA secondary structure sequence
ggcccacccacagcaagaat

SEQ ID NO: 25153 - DNA, 20 bp, Unknown
  RNA secondary structure sequence
ttccccttcctcccataact

SEQ ID NO: 25154 - DNA, 20 bp, Unknown
  RNA secondary structure sequence
ccggtggggtaaggttggtg

SEQ ID NO: 25155 - DNA, 20 bp, Unknown
  RNA secondary structure sequence
ggattttcgagttcgttggc

SEQ ID NO: 25156 - DNA, 20 bp, Unknown
  RNA secondary structure sequence
tggtgggagcccgcggccgc

SEQ ID NO: 25157 - DNA, 20 bp, Unknown
  RNA secondary structure sequence
ctcaaacttccttacattgg

SEQ ID NO: 25158 - DNA, 20 bp, Unknown
  RNA secondary structure sequence
ggtcctgctcagtgctacgg

SEQ ID NO: 25159 - DNA, 20 bp, Unknown
  RNA secondary structure sequence
tcgggagctgatggcgcaga

SEQ ID NO: 25160 - DNA, 20 bp, Unknown
  RNA secondary structure sequence
ttttatgcccctcccggtgc

SEQ ID NO: 25161 - DNA, 20 bp, Unknown
  RNA secondary structure sequence
tccatcgttcgtgtcgcccg

SEQ ID NO: 25162 - DNA, 20 bp, Unknown
  RNA secondary structure sequence
caacacctctttgccaagct

SEQ ID NO: 25163 - DNA, 20 bp, Unknown
  RNA secondary structure sequence
cttggggtcctcgtcaaaga

SEQ ID NO: 25164 - DNA, 20 bp, Unknown
  RNA secondary structure sequence
gctgccaactctgtcaccca

SEQ ID NO: 25165 - DNA, 20 bp, Unknown
  RNA secondary structure sequence
tctactcttgctcaggccct

SEQ ID NO: 25166 - DNA, 20 bp, Unknown
  RNA secondary structure sequence
ggctctcttcgcgatcgggc

SEQ ID NO: 25167 - DNA, 20 bp, Unknown
  RNA secondary structure sequence
cgcccggtctctttcctctc

SEQ ID NO: 25168 - DNA, 20 bp, Unknown
  RNA secondary structure sequence
cagctccctgacagcctccc

SEQ ID NO: 25169 - DNA, 20 bp, Unknown
  RNA secondary structure sequence
aaccctctccagtatggcag

SEQ ID NO: 25170 - DNA, 20 bp, Unknown
  RNA secondary structure sequence
agcaaaatgggagctcaggt

SEQ ID NO: 25171 - DNA, 20 bp, Unknown
  RNA secondary structure sequence
acgggctacactgttcacgt

SEQ ID NO: 25172 - DNA, 20 bp, Unknown
  RNA secondary structure sequence
gatgactttcaatccccctc

SEQ ID NO: 25173 - DNA, 20 bp, Unknown
  RNA secondary structure sequence
attactgcttggtaccaaac

SEQ ID NO: 25174 - DNA, 20 bp, Unknown
  RNA secondary structure sequence
tatgtcggtaactatagagt

SEQ ID NO: 25175 - DNA, 20 bp, Unknown
  RNA secondary structure sequence
caagactccattctagagaa

SEQ ID NO: 25176 - DNA, 20 bp, Unknown
  RNA secondary structure sequence
ctagtgtgtggtaaagccat

SEQ ID NO: 25177 - DNA, 20 bp, Unknown
  RNA secondary structure sequence
cgcatgctaatgtacaactt

SEQ ID NO: 25178 - DNA, 20 bp, Unknown
  RNA secondary structure sequence
atcaagaagagagatatttt

SEQ ID NO: 25179 - DNA, 20 bp, Unknown
  RNA secondary structure sequence
gattcagtagctatgaggca

SEQ ID NO: 25180 - DNA, 20 bp, Unknown
  RNA secondary structure sequence
gtgcgatccttatgcctatt

SEQ ID NO: 25181 - DNA, 20 bp, Unknown
  RNA secondary structure sequence
cagcaaaatgggagctcaag

SEQ ID NO: 25182 - DNA, 20 bp, Unknown
  RNA secondary structure sequence
ggaggcgacagcggaggatc

SEQ ID NO: 25183 - DNA, 20 bp, Unknown
  RNA secondary structure sequence
ggcaggttacacgattcacg

SEQ ID NO: 25184 - DNA, 20 bp, Unknown
  RNA secondary structure sequence
tgacttccagtccccttgtg

SEQ ID NO: 25185 - DNA, 20 bp, Unknown
  RNA secondary structure sequence
gaacaagacccaagatcaag

SEQ ID NO: 25186 - DNA, 20 bp, Unknown
  RNA secondary structure sequence
gtactcccctccgggtgcgg

SEQ ID NO: 25187 - DNA, 20 bp, Unknown
  RNA secondary structure sequence
tgtccacgtggctgacacca

SEQ ID NO: 25188 - DNA, 20 bp, Unknown
  RNA secondary structure sequence
gagatcggcatgtgtgtaca

SEQ ID NO: 25189 - DNA, 20 bp, Unknown
  RNA secondary structure sequence
acacgtaagggtatggatcc

SEQ ID NO: 25190 - DNA, 20 bp, Unknown
  RNA secondary structure sequence
gtatgtgggcaattacagag

SEQ ID NO: 25191 - DNA, 20 bp, Unknown
  RNA secondary structure sequence
aaacaagcactatccagtcg

SEQ ID NO: 25192 - DNA, 20 bp, Unknown
  RNA secondary structure sequence
gggtggtgaaggtgttgttg

SEQ ID NO: 25193 - DNA, 20 bp, Unknown
  RNA secondary structure sequence
tcaagactccatcctggaaa

SEQ ID NO: 25194 - DNA, 20 bp, Unknown
  RNA secondary structure sequence
acaactgcccctgttggaaa

SEQ ID NO: 25195 - DNA, 20 bp, Unknown
  RNA secondary structure sequence
ggcaccagaaaccccccccc

SEQ ID NO: 25196 - DNA, 20 bp, Unknown
  RNA secondary structure sequence
ctccaaggaggctggtttcc

SEQ ID NO: 25197 - DNA, 20 bp, Unknown
  RNA secondary structure sequence
gaacacgaacgtggatgagt

SEQ ID NO: 25198 - DNA, 20 bp, Unknown
  RNA secondary structure sequence
tatcaaaaagagagacattt

SEQ ID NO: 25199 - DNA, 20 bp, Unknown
  RNA secondary structure sequence
tgattcagtggccatgaggc

SEQ ID NO: 25200 - DNA, 20 bp, Unknown
  RNA secondary structure sequence
tgtgcgatctttgtgcttat

SEQ ID NO: 25201 - DNA, 20 bp, Unknown
  RNA secondary structure sequence
agatgctctcaccgaagctg

SEQ ID NO: 25202 - DNA, 20 bp, Unknown
  RNA secondary structure sequence
gttcttggacaacggtacga

SEQ ID NO: 25203 - DNA, 20 bp, Unknown
  RNA secondary structure sequence
aaattttcattctactcccg

SEQ ID NO: 25204 - DNA, 20 bp, Unknown
  RNA secondary structure sequence
tttcacaattaatcctggta

SEQ ID NO: 25205 - DNA, 20 bp, Unknown
  RNA secondary structure sequence
ttacgatggttatccaagat

SEQ ID NO: 25206 - DNA, 20 bp, Unknown
  RNA secondary structure sequence
acccagaccatttaggatgt

SEQ ID NO: 25207 - DNA, 20 bp, Unknown
  RNA secondary structure sequence
atttattgaggccaatgagt

SEQ ID NO: 25208 - DNA, 20 bp, Unknown
  RNA secondary structure sequence
aaagtcagtggactcagagg

SEQ ID NO: 25209 - DNA, 20 bp, Unknown
  RNA secondary structure sequence
catactcatggctacaggta

SEQ ID NO: 25210 - DNA, 20 bp, Unknown
  RNA secondary structure sequence
actagaacccagcgtctttc

SEQ ID NO: 25211 - DNA, 20 bp, Unknown
  RNA secondary structure sequence
tggatacaccaacaatgaga

SEQ ID NO: 25212 - DNA, 20 bp, Unknown
  RNA secondary structure sequence
ttagacggaaatggcttgac

SEQ ID NO: 25213 - DNA, 20 bp, Unknown
  RNA secondary structure sequence
ttaaacctccgattcggcaa

SEQ ID NO: 25214 - DNA, 20 bp, Unknown
  RNA secondary structure sequence
ggcattgtgagacaacgggt

SEQ ID NO: 25215 - DNA, 20 bp, Unknown
  RNA secondary structure sequence
gaaagcaatgcagtcaagta

SEQ ID NO: 25216 - DNA, 20 bp, Unknown
  RNA secondary structure sequence
gcaacggcacacggcagtac

SEQ ID NO: 25217 - DNA, 20 bp, Unknown
  RNA secondary structure sequence
aaaatgcgttattaagaaaa

SEQ ID NO: 25218 - DNA, 20 bp, Unknown
  RNA secondary structure sequence
agacaattctgcattggaca

SEQ ID NO: 25219 - DNA, 20 bp, Unknown
  RNA secondary structure sequence
gtgagggaggcgcccggcga

SEQ ID NO: 25220 - DNA, 20 bp, Unknown
  RNA secondary structure sequence
aatcccaatctggcttcctc

SEQ ID NO: 25221 - DNA, 20 bp, Unknown
  RNA secondary structure sequence
ctcattccatcccaaattaa

SEQ ID NO: 25222 - DNA, 20 bp, Unknown
  RNA secondary structure sequence
actcctggttcacaggctga

SEQ ID NO: 25223 - DNA, 20 bp, Unknown
  RNA secondary structure sequence
attacacccgagcccaacac

SEQ ID NO: 25224 - DNA, 20 bp, Unknown
  RNA secondary structure sequence
aatcagctcaaaccgtctat

SEQ ID NO: 25225 - DNA, 20 bp, Unknown
  RNA secondary structure sequence
ttctaatactgttcttctgt

SEQ ID NO: 25226 - DNA, 20 bp, Unknown
  RNA secondary structure sequence
gggggttgtacacaacaata

SEQ ID NO: 25227 - DNA, 20 bp, Unknown
  RNA secondary structure sequence
cgcctttcacaaagaaggag

SEQ ID NO: 25228 - DNA, 20 bp, Unknown
  RNA secondary structure sequence
accacagaaagccacgccga

SEQ ID NO: 25229 - DNA, 20 bp, Unknown
  RNA secondary structure sequence
cgaagggatgtcactcccaa

SEQ ID NO: 25230 - DNA, 20 bp, Unknown
  RNA secondary structure sequence
ttgaggcagctggccaacga

SEQ ID NO: 25231 - DNA, 20 bp, Unknown
  RNA secondary structure sequence
gagaaggacttggtcaagac

SEQ ID NO: 25232 - DNA, 20 bp, Unknown
  RNA secondary structure sequence
tccatgaatcaaccttgaag

SEQ ID NO: 25233 - DNA, 20 bp, Unknown
  RNA secondary structure sequence
tttgacatgaggataagaac

SEQ ID NO: 25234 - DNA, 20 bp, Unknown
  RNA secondary structure sequence
gactaccgaaacatatatac

SEQ ID NO: 25235 - DNA, 20 bp, Unknown
  RNA secondary structure sequence
gagggcgactaaatagaggg

SEQ ID NO: 25236 - DNA, 20 bp, Unknown
  RNA secondary structure sequence
aggaggctattcaaggccat

SEQ ID NO: 25237 - DNA, 20 bp, Unknown
  RNA secondary structure sequence
acaaagcaggagattattta

SEQ ID NO: 25238 - DNA, 20 bp, Unknown
  RNA secondary structure sequence
ataaatttgctacaaaaagg

SEQ ID NO: 25239 - DNA, 20 bp, Unknown
  RNA secondary structure sequence
catatccaacacgcaatgtt

SEQ ID NO: 25240 - DNA, 20 bp, Unknown
  RNA secondary structure sequence
cacatggagtctctctcgaa

SEQ ID NO: 25241 - DNA, 20 bp, Unknown
  RNA secondary structure sequence
gtgacaatcaatgtataact

SEQ ID NO: 25242 - DNA, 20 bp, Unknown
  RNA secondary structure sequence
tttattttggcaaaaaacaa

SEQ ID NO: 25243 - DNA, 20 bp, Unknown
  RNA secondary structure sequence
atgagcattgccctaaatgt

SEQ ID NO: 25244 - DNA, 20 bp, Unknown
  RNA secondary structure sequence
attttgctgttgcacttttt

SEQ ID NO: 25245 - DNA, 20 bp, Unknown
  RNA secondary structure sequence
acaattcatcaacggatcca

SEQ ID NO: 25246 - DNA, 20 bp, Unknown
  RNA secondary structure sequence
tagctactcaaatacataat

SEQ ID NO: 25247 - DNA, 20 bp, Unknown
  RNA secondary structure sequence
cagagattgtaaggcttact

SEQ ID NO: 25248 - DNA, 20 bp, Unknown
  RNA secondary structure sequence
ttaccgatattactaatcca

SEQ ID NO: 25249 - DNA, 20 bp, Unknown
  RNA secondary structure sequence
agttctttctaataatacaa

SEQ ID NO: 25250 - DNA, 20 bp, Unknown
  RNA secondary structure sequence
tcaaactaatagatagattg

SEQ ID NO: 25251 - DNA, 20 bp, Unknown
  RNA secondary structure sequence
gagcctgcagaacacgcagg

SEQ ID NO: 25252 - DNA, 20 bp, Unknown
  RNA secondary structure sequence
tcatttgctagtctgtttct

SEQ ID NO: 25253 - DNA, 20 bp, Unknown
  RNA secondary structure sequence
gcgcgaacagccaaagtcaa

SEQ ID NO: 25254 - DNA, 20 bp, Unknown
  RNA secondary structure sequence
gagcccatcattttcagcac

SEQ ID NO: 25255 - DNA, 20 bp, Unknown
  RNA secondary structure sequence
ctttccagcaccggatgtaa

SEQ ID NO: 25256 - DNA, 20 bp, Unknown
  RNA secondary structure sequence
aataggaaatcaagccttct

SEQ ID NO: 25257 - DNA, 20 bp, Unknown
  RNA secondary structure sequence
tcatcccaaactgagaccta

SEQ ID NO: 25258 - DNA, 20 bp, Unknown
  RNA secondary structure sequence
ctgccgcagcatatagaccc

SEQ ID NO: 25259 - DNA, 20 bp, Unknown
  RNA secondary structure sequence
ccacaaagaaggcgctttct

SEQ ID NO: 25260 - DNA, 20 bp, Unknown
  RNA secondary structure sequence
accagcttcgccaacaacca

SEQ ID NO: 25261 - DNA, 20 bp, Unknown
  RNA secondary structure sequence
cagctagcaaatgagacgac

SEQ ID NO: 25262 - DNA, 20 bp, Unknown
  RNA secondary structure sequence
gctaggacaggatcaatcag

SEQ ID NO: 25263 - DNA, 20 bp, Unknown
  RNA secondary structure sequence
gcaaccgtaataaaagcatt

SEQ ID NO: 25264 - DNA, 20 bp, Unknown
  RNA secondary structure sequence
aacaagttctcaactaagag

SEQ ID NO: 25265 - DNA, 20 bp, Unknown
  RNA secondary structure sequence
aatgtccctgggtcacaaga

SEQ ID NO: 25266 - DNA, 20 bp, Unknown
  RNA secondary structure sequence
tattcagggaacatcgtaca

SEQ ID NO: 25267 - DNA, 20 bp, Unknown
  RNA secondary structure sequence
ttaacaactcaaatccataa

SEQ ID NO: 25268 - DNA, 20 bp, Unknown
  RNA secondary structure sequence
gtggccatttcttccttcct

SEQ ID NO: 25269 - DNA, 20 bp, Unknown
  RNA secondary structure sequence
ttccaagaagacagaaataa

SEQ ID NO: 25270 - DNA, 20 bp, Unknown
  RNA secondary structure sequence
gcaaaattaatggagagatt

SEQ ID NO: 25271 - DNA, 20 bp, Unknown
  RNA secondary structure sequence
caatgcgtaatttataccga

SEQ ID NO: 25272 - DNA, 20 bp, Unknown
  RNA secondary structure sequence
tctctcccgtttggctccac

SEQ ID NO: 25273 - DNA, 20 bp, Unknown
  RNA secondary structure sequence
gctgcctgggccttccacgc

SEQ ID NO: 25274 - DNA, 20 bp, Unknown
  RNA secondary structure sequence
cccgaccctatcttcgctga

SEQ ID NO: 25275 - DNA, 20 bp, Unknown
  RNA secondary structure sequence
gggccttccaactcctcccg

SEQ ID NO: 25276 - DNA, 20 bp, Unknown
  RNA secondary structure sequence
ctcaacttcccttactccat

SEQ ID NO: 25277 - DNA, 20 bp, Unknown
  RNA secondary structure sequence
acccctcaatccgcaaccca

SEQ ID NO: 25278 - DNA, 20 bp, Unknown
  RNA secondary structure sequence
ccctctttcctggacgtctc

SEQ ID NO: 25279 - DNA, 20 bp, Unknown
  RNA secondary structure sequence
cccctaggccaaacccttac

SEQ ID NO: 25280 - DNA, 20 bp, Unknown
  RNA secondary structure sequence
gacctcaccacctccgcctc

SEQ ID NO: 25281 - DNA, 20 bp, Unknown
  RNA secondary structure sequence
accattgccgtgttcatccg

SEQ ID NO: 25282 - DNA, 20 bp, Unknown
  RNA secondary structure sequence
gaggatcgtgctcacgtcac

SEQ ID NO: 25283 - DNA, 20 bp, Unknown
  RNA secondary structure sequence
aaccagcggctaacgtatgt

SEQ ID NO: 25284 - DNA, 20 bp, Unknown
  RNA secondary structure sequence
agcgagtacccctactccgc

SEQ ID NO: 25285 - DNA, 20 bp, Unknown
  RNA secondary structure sequence
gtcgtgatcgcctccgactt

SEQ ID NO: 25286 - DNA, 20 bp, Unknown
  RNA secondary structure sequence
agtcacgacaccatcatggc

SEQ ID NO: 25287 - DNA, 20 bp, Unknown
  RNA secondary structure sequence
ctgatcccgggcgtcaagcc

SEQ ID NO: 25288 - DNA, 20 bp, Unknown
  RNA secondary structure sequence
gacatccgtcgctttatccg

SEQ ID NO: 25289 - DNA, 20 bp, Unknown
  RNA secondary structure sequence
tggcccaccctccccgttgc

SEQ ID NO: 25290 - DNA, 20 bp, Unknown
  RNA secondary structure sequence
gcgatcatcgctggacgcat

SEQ ID NO: 25291 - DNA, 20 bp, Unknown
  RNA secondary structure sequence
actctcccctcctgcgcttt

SEQ ID NO: 25292 - DNA, 20 bp, Unknown
  RNA secondary structure sequence
gttggaacctcaatcctcaa

SEQ ID NO: 25293 - DNA, 20 bp, Unknown
  RNA secondary structure sequence
aacaccaccctaatcgtgac

SEQ ID NO: 25294 - DNA, 20 bp, Unknown
  RNA secondary structure sequence
tcttaagtctgtgccttcca

SEQ ID NO: 25295 - DNA, 20 bp, Unknown
  RNA secondary structure sequence
atggtaagtgatcaattcac

SEQ ID NO: 25296 - DNA, 20 bp, Unknown
  RNA secondary structure sequence
ctcgaagttctcggggttct

SEQ ID NO: 25297 - DNA, 20 bp, Unknown
  RNA secondary structure sequence
atctggaaaccggaattgcg

SEQ ID NO: 25298 - DNA, 20 bp, Unknown
  RNA secondary structure sequence
acctgaaacaggcactaaat

SEQ ID NO: 25299 - DNA, 20 bp, Unknown
  RNA secondary structure sequence
ggggtaccctggtggtagct

SEQ ID NO: 25300 - DNA, 20 bp, Unknown
  RNA secondary structure sequence
gagtccttgattttccacca

SEQ ID NO: 25301 - DNA, 20 bp, Unknown
  RNA secondary structure sequence
tgactggagttttccttatc

SEQ ID NO: 25302 - DNA, 20 bp, Unknown
  RNA secondary structure sequence
aaggtcctagtgggcaggct

SEQ ID NO: 25303 - DNA, 20 bp, Unknown
  RNA secondary structure sequence
aaaattctttgcagcgcact

SEQ ID NO: 25304 - DNA, 20 bp, Unknown
  RNA secondary structure sequence
taactgctaattttaatctt

SEQ ID NO: 25305 - DNA, 20 bp, Unknown
  RNA secondary structure sequence
tagatggtgttgtgttagat

SEQ ID NO: 25306 - DNA, 20 bp, Unknown
  RNA secondary structure sequence
atgagctgaggaaagttgag

SEQ ID NO: 25307 - DNA, 20 bp, Unknown
  RNA secondary structure sequence
tgtatggaaacaagatttat

SEQ ID NO: 25308 - DNA, 20 bp, Unknown
  RNA secondary structure sequence
tccgtccaagccgcggacgt

SEQ ID NO: 25309 - DNA, 20 bp, Unknown
  RNA secondary structure sequence
gcgacagttccggtcaactc

SEQ ID NO: 25310 - DNA, 20 bp, Unknown
  RNA secondary structure sequence
agatgtggctgggaagtgtt

SEQ ID NO: 25311 - DNA, 20 bp, Unknown
  RNA secondary structure sequence
ctgctcttgccatatgcttc

SEQ ID NO: 25312 - DNA, 20 bp, Unknown
  RNA secondary structure sequence
aatttgctggtccgtcctct

SEQ ID NO: 25313 - DNA, 20 bp, Unknown
  RNA secondary structure sequence
gtgattcctttttgcagctc

SEQ ID NO: 25314 - DNA, 20 bp, Unknown
  RNA secondary structure sequence
ttcctggatatgttattaga

SEQ ID NO: 25315 - DNA, 20 bp, Unknown
  RNA secondary structure sequence
aagctggaccgcatctctga

SEQ ID NO: 25316 - DNA, 20 bp, Unknown
  RNA secondary structure sequence
aaggtcgatgacatctatgc

SEQ ID NO: 25317 - DNA, 20 bp, Unknown
  RNA secondary structure sequence
atgagacatttcaaatctgg

SEQ ID NO: 25318 - DNA, 20 bp, Unknown
  RNA secondary structure sequence
gatgtgaagatgacccgcat

SEQ ID NO: 25319 - DNA, 20 bp, Unknown
  RNA secondary structure sequence
acgttccgtggaattgaaac

SEQ ID NO: 25320 - DNA, 20 bp, Unknown
  RNA secondary structure sequence
gggactcccctgctggatgg

SEQ ID NO: 25321 - DNA, 20 bp, Unknown
  RNA secondary structure sequence
ggtgatgatgtagtttatgc

SEQ ID NO: 25322 - DNA, 20 bp, Unknown
  RNA secondary structure sequence
ggagttcgcaaatctgctgc

SEQ ID NO: 25323 - DNA, 20 bp, Unknown
  RNA secondary structure sequence
tttgtcattgctacttctaa

SEQ ID NO: 25324 - DNA, 20 bp, Unknown
  RNA secondary structure sequence
cctattgctgcttgtgctta

SEQ ID NO: 25325 - DNA, 20 bp, Unknown
  RNA secondary structure sequence
atgttagaatcccatcagga

SEQ ID NO: 25326 - DNA, 20 bp, Unknown
  RNA secondary structure sequence
tcatcaaatgatcataatgc

SEQ ID NO: 25327 - DNA, 20 bp, Unknown
  RNA secondary structure sequence
ggcattgttgatactgagct

SEQ ID NO: 25328 - DNA, 20 bp, Unknown
  RNA secondary structure sequence
gtagacaatgagataggttt

SEQ ID NO: 25329 - DNA, 20 bp, Unknown
  RNA secondary structure sequence
cttcttgctcacgaggaaaa

SEQ ID NO: 25330 - DNA, 20 bp, Unknown
  RNA secondary structure sequence
gatgaaaccaagagtggttc

SEQ ID NO: 25331 - DNA, 20 bp, Unknown
  RNA secondary structure sequence
gattccgagcttctaagctt

SEQ ID NO: 25332 - DNA, 20 bp, Unknown
  RNA secondary structure sequence
ttggcagccaggttttaact

SEQ ID NO: 25333 - DNA, 20 bp, Unknown
  RNA secondary structure sequence
catcaattagacaaatttct

SEQ ID NO: 25334 - DNA, 20 bp, Unknown
  RNA secondary structure sequence
aaacttctaagattcgttcc

SEQ ID NO: 25335 - DNA, 20 bp, Unknown
  RNA secondary structure sequence
atattcctgctaagggtttc

SEQ ID NO: 25336 - DNA, 20 bp, Unknown
  RNA secondary structure sequence
gtggaaatactccctcgccg

SEQ ID NO: 25337 - DNA, 20 bp, Unknown
  RNA secondary structure sequence
agttcgcaaagacacaatac

SEQ ID NO: 25338 - DNA, 20 bp, Unknown
  RNA secondary structure sequence
cttatgatcctgccactgaa

SEQ ID NO: 25339 - DNA, 20 bp, Unknown
  RNA secondary structure sequence
cgataacagaggatcctact

SEQ ID NO: 25340 - DNA, 20 bp, Unknown
  RNA secondary structure sequence
atgtggagcttgatcctgct

SEQ ID NO: 25341 - DNA, 20 bp, Unknown
  RNA secondary structure sequence
taacccgtcgcgagacgcgt

SEQ ID NO: 25342 - DNA, 20 bp, Unknown
  RNA secondary structure sequence
cctaggtttacttttattag

SEQ ID NO: 25343 - DNA, 20 bp, Unknown
  RNA secondary structure sequence
tccgctgtcttggggtatgg

SEQ ID NO: 25344 - DNA, 20 bp, Unknown
  RNA secondary structure sequence
tgacactatatccgcaccaa

SEQ ID NO: 25345 - DNA, 20 bp, Unknown
  RNA secondary structure sequence
taccaggtaggatgacaaat

SEQ ID NO: 25346 - DNA, 20 bp, Unknown
  RNA secondary structure sequence
ggttgcaatcaacgtgtacg

SEQ ID NO: 25347 - DNA, 20 bp, Unknown
  RNA secondary structure sequence
gtattgctgccatcctggaa

SEQ ID NO: 25348 - DNA, 20 bp, Unknown
  RNA secondary structure sequence
tcacagccatcacacgatct

SEQ ID NO: 25349 - DNA, 20 bp, Unknown
  RNA secondary structure sequence
ttggactgcttattcatggg

SEQ ID NO: 25350 - DNA, 20 bp, Unknown
  RNA secondary structure sequence
aaaacccggatggtgaggac

SEQ ID NO: 25351 - DNA, 20 bp, Unknown
  RNA secondary structure sequence
aatcattacctgcaaaccca

SEQ ID NO: 25352 - DNA, 20 bp, Unknown
  RNA secondary structure sequence
acgctgcccaactccagccc

SEQ ID NO: 25353 - DNA, 20 bp, Unknown
  RNA secondary structure sequence
taggttttgacacggaagat

SEQ ID NO: 25354 - DNA, 20 bp, Unknown
  RNA secondary structure sequence
acaagtttattgccctggtt

SEQ ID NO: 25355 - DNA, 20 bp, Unknown
  RNA secondary structure sequence
cggaaggcgaaacgtcgggg

SEQ ID NO: 25356 - DNA, 20 bp, Unknown
  RNA secondary structure sequence
aacgtgcatcaccatggaga

SEQ ID NO: 25357 - DNA, 20 bp, Unknown
  RNA secondary structure sequence
ataattttcacaattatgtt

SEQ ID NO: 25358 - DNA, 20 bp, Unknown
  RNA secondary structure sequence
aagatgatgaacatggaggc

SEQ ID NO: 25359 - DNA, 20 bp, Unknown
  RNA secondary structure sequence
tttcatgatctcaacttacc

SEQ ID NO: 25360 - DNA, 20 bp, Unknown
  RNA secondary structure sequence
gggccctgtagagttcccat

SEQ ID NO: 25361 - DNA, 20 bp, Unknown
  RNA secondary structure sequence
tttaaaagcttatttggagg

SEQ ID NO: 25362 - DNA, 20 bp, Unknown
  RNA secondary structure sequence
gacttggctaggaaagaatt

SEQ ID NO: 25363 - DNA, 20 bp, Unknown
  RNA secondary structure sequence
cacaacatgtgggtaagcat

SEQ ID NO: 25364 - DNA, 20 bp, Unknown
  RNA secondary structure sequence
accgcagtaatgggcacagc

SEQ ID NO: 25365 - DNA, 20 bp, Unknown
  RNA secondary structure sequence
gtggcagctgcatttgctga

SEQ ID NO: 25366 - DNA, 20 bp, Unknown
  RNA secondary structure sequence
ctgggaatcctctcactatt

SEQ ID NO: 25367 - DNA, 20 bp, Unknown
  RNA secondary structure sequence
gcgagggtgactggagcatc

SEQ ID NO: 25368 - DNA, 20 bp, Unknown
  RNA secondary structure sequence
cacgtgacgaatggggccgt

SEQ ID NO: 25369 - DNA, 20 bp, Unknown
  RNA secondary structure sequence
attatggatgaggctcactt

SEQ ID NO: 25370 - DNA, 20 bp, Unknown
  RNA secondary structure sequence
aagagtggagaatgggattt

SEQ ID NO: 25371 - DNA, 20 bp, Unknown
  RNA secondary structure sequence
cagcgtcgtggacgggttgg

SEQ ID NO: 25372 - DNA, 20 bp, Unknown
  RNA secondary structure sequence
ccagcgacggcatgggcggc

SEQ ID NO: 25373 - DNA, 20 bp, Unknown
  RNA secondary structure sequence
tggaactatcatggaagcta

SEQ ID NO: 25374 - DNA, 20 bp, Unknown
  RNA secondary structure sequence
gtacccttttgctcacacca

SEQ ID NO: 25375 - DNA, 20 bp, Unknown
  RNA secondary structure sequence
ttgatgtacttccacaggag

SEQ ID NO: 25376 - DNA, 20 bp, Unknown
  RNA secondary structure sequence
aatccctgccaccggatgtt

SEQ ID NO: 25377 - DNA, 20 bp, Unknown
  RNA secondary structure sequence
aggggaaggactagaggtta

SEQ ID NO: 25378 - DNA, 20 bp, Unknown
  RNA secondary structure sequence
ctcaatgtctttatttacac

SEQ ID NO: 25379 - DNA, 20 bp, Unknown
  RNA secondary structure sequence
aactactatggtgcccaata

SEQ ID NO: 25380 - DNA, 20 bp, Unknown
  RNA secondary structure sequence
ggcaactccactcttacaac

SEQ ID NO: 25381 - DNA, 20 bp, Unknown
  RNA secondary structure sequence
cgcgtgattcgcttgcctgg

SEQ ID NO: 25382 - DNA, 20 bp, Unknown
  RNA secondary structure sequence
tctctatacattgttccaat

SEQ ID NO: 25383 - DNA, 20 bp, Unknown
  RNA secondary structure sequence
actatcaagaacgatggttt

SEQ ID NO: 25384 - DNA, 20 bp, Unknown
  RNA secondary structure sequence
ggagatgccccagcaacacg

SEQ ID NO: 25385 - DNA, 20 bp, Unknown
  RNA secondary structure sequence
caaaccaatatagttgttcc

SEQ ID NO: 25386 - DNA, 20 bp, Unknown
  RNA secondary structure sequence
gtacttcgccccgctacagg

SEQ ID NO: 25387 - DNA, 20 bp, Unknown
  RNA secondary structure sequence
atcgaggcatttatgtctcg

SEQ ID NO: 25388 - DNA, 20 bp, Unknown
  RNA secondary structure sequence
gatgtggtcgctattgtctc

SEQ ID NO: 25389 - DNA, 20 bp, Unknown
  RNA secondary structure sequence
cccccggcatccctacggct

SEQ ID NO: 25390 - DNA, 20 bp, Unknown
  RNA secondary structure sequence
caccttttcaacaacagact

SEQ ID NO: 25391 - DNA, 20 bp, Unknown
  RNA secondary structure sequence
gctatggccacagcaggcag

SEQ ID NO: 25392 - DNA, 20 bp, Unknown
  RNA secondary structure sequence
tacggggtgcagcgaaacca

SEQ ID NO: 25393 - DNA, 20 bp, Unknown
  RNA secondary structure sequence
cagaagttgggtggcaacag

SEQ ID NO: 25394 - DNA, 20 bp, Unknown
  RNA secondary structure sequence
aacactgcacttgacaggtg

SEQ ID NO: 25395 - DNA, 20 bp, Unknown
  RNA secondary structure sequence
aagctcgaggcaatcttcca

SEQ ID NO: 25396 - DNA, 20 bp, Unknown
  RNA secondary structure sequence
tccatcttgtcatccctcac

SEQ ID NO: 25397 - DNA, 20 bp, Unknown
  RNA secondary structure sequence
ggtaacacagacattcccat

SEQ ID NO: 25398 - DNA, 20 bp, Unknown
  RNA secondary structure sequence
tatgtcattaagaacaccag

SEQ ID NO: 25399 - DNA, 20 bp, Unknown
  RNA secondary structure sequence
tgcagttccatgaatgacac

SEQ ID NO: 25400 - DNA, 20 bp, Unknown
  RNA secondary structure sequence
gggacatccatcttcaattc

SEQ ID NO: 25401 - DNA, 20 bp, Unknown
  RNA secondary structure sequence
tacaatttgacaatgacacc

SEQ ID NO: 25402 - DNA, 20 bp, Unknown
  RNA secondary structure sequence
cctggtaacaggtgccccag

SEQ ID NO: 25403 - DNA, 20 bp, Unknown
  RNA secondary structure sequence
taccccctaccccgctcacc

SEQ ID NO: 25404 - DNA, 20 bp, Unknown
  RNA secondary structure sequence
cccgcacagatgcccctcgc

SEQ ID NO: 25405 - DNA, 20 bp, Unknown
  RNA secondary structure sequence
ggtcgctccgggggtgcgtc

SEQ ID NO: 25406 - DNA, 20 bp, Unknown
  RNA secondary structure sequence
aattggggcactcaatctgg

SEQ ID NO: 25407 - DNA, 20 bp, Unknown
  RNA secondary structure sequence
atcctttacatggtcccgga

SEQ ID NO: 25408 - DNA, 20 bp, Unknown
  RNA secondary structure sequence
tccccttctgccattgctgg

SEQ ID NO: 25409 - DNA, 20 bp, Unknown
  RNA secondary structure sequence
gatgtctccggcctcactgc

SEQ ID NO: 25410 - DNA, 20 bp, Unknown
  RNA secondary structure sequence
cttggtgacgtcccaccaga

SEQ ID NO: 25411 - DNA, 20 bp, Unknown
  RNA secondary structure sequence
cgggaagtcccactctcctc

SEQ ID NO: 25412 - DNA, 20 bp, Unknown
  RNA secondary structure sequence
ctctttggttccccctcccc

SEQ ID NO: 25413 - DNA, 20 bp, Unknown
  RNA secondary structure sequence
tctcaacaccgcaagcgcca

SEQ ID NO: 25414 - DNA, 20 bp, Unknown
  RNA secondary structure sequence
acctccaacttccatgagcc

SEQ ID NO: 25415 - DNA, 20 bp, Unknown
  RNA secondary structure sequence
acccttttccaagccaacgt

SEQ ID NO: 25416 - DNA, 20 bp, Unknown
  RNA secondary structure sequence
actccccgggaaatccccga

SEQ ID NO: 25417 - DNA, 20 bp, Unknown
  RNA secondary structure sequence
ttcctggcggtggtcggatt

SEQ ID NO: 25418 - DNA, 20 bp, Unknown
  RNA secondary structure sequence
atctctcccgcaatccctgg

SEQ ID NO: 25419 - DNA, 20 bp, Unknown
  RNA secondary structure sequence
tgggccaccctccctaccct

SEQ ID NO: 25420 - DNA, 20 bp, Unknown
  RNA secondary structure sequence
cttgacatgaacttccccgg

SEQ ID NO: 25421 - DNA, 20 bp, Unknown
  RNA secondary structure sequence
cataccattctccctgaaat

SEQ ID NO: 25422 - DNA, 20 bp, Unknown
  RNA secondary structure sequence
atggaagggcttgatatggg

SEQ ID NO: 25423 - DNA, 20 bp, Unknown
  RNA secondary structure sequence
tggaccgagttcttctacaa

SEQ ID NO: 25424 - DNA, 20 bp, Unknown
  RNA secondary structure sequence
cacatctatggcaaccagat

SEQ ID NO: 25425 - DNA, 20 bp, Unknown
  RNA secondary structure sequence
tacgcgacggaacccccaat

SEQ ID NO: 25426 - DNA, 20 bp, Unknown
  RNA secondary structure sequence
attcaccctgtgatggaccc

SEQ ID NO: 25427 - DNA, 20 bp, Unknown
  RNA secondary structure sequence
ccaaatttcctcccctactc

SEQ ID NO: 25428 - DNA, 20 bp, Unknown
  RNA secondary structure sequence
ccatggttgtactgtgctat

SEQ ID NO: 25429 - DNA, 20 bp, Unknown
  RNA secondary structure sequence
acttacctttttcccctctt

SEQ ID NO: 25430 - DNA, 20 bp, Unknown
  RNA secondary structure sequence
cgacaggttatggtagagta

SEQ ID NO: 25431 - DNA, 20 bp, Unknown
  RNA secondary structure sequence
gccattggattatgtcaccg

SEQ ID NO: 25432 - DNA, 20 bp, Unknown
  RNA secondary structure sequence
aaatgctgccatagcccatt

SEQ ID NO: 25433 - DNA, 20 bp, Unknown
  RNA secondary structure sequence
cggcggttcggcgccagcca

SEQ ID NO: 25434 - DNA, 20 bp, Unknown
  RNA secondary structure sequence
acatgccctgcagcccctag

SEQ ID NO: 25435 - DNA, 20 bp, Unknown
  RNA secondary structure sequence
catttctttgcgacttccct

SEQ ID NO: 25436 - DNA, 20 bp, Unknown
  RNA secondary structure sequence
acatcgcattttgatgcttg

SEQ ID NO: 25437 - DNA, 20 bp, Unknown
  RNA secondary structure sequence
agcagcaaattgtgggcccc

SEQ ID NO: 25438 - DNA, 20 bp, Unknown
  RNA secondary structure sequence
ttatgttgctgatcttgtgt

SEQ ID NO: 25439 - DNA, 20 bp, Unknown
  RNA secondary structure sequence
gggtcacagctttggtgatt

SEQ ID NO: 25440 - DNA, 20 bp, Unknown
  RNA secondary structure sequence
gcttgtccatggcacacctg

SEQ ID NO: 25441 - DNA, 20 bp, Unknown
  RNA secondary structure sequence
tagattttttgtggatgtta

SEQ ID NO: 25442 - DNA, 20 bp, Unknown
  RNA secondary structure sequence
tgaagaattgagaaaggaag

SEQ ID NO: 25443 - DNA, 20 bp, Unknown
  RNA secondary structure sequence
tgtcaataagctgttcaagc

SEQ ID NO: 25444 - DNA, 20 bp, Unknown
  RNA secondary structure sequence
gaagtcaaggctgattgagt

SEQ ID NO: 25445 - DNA, 20 bp, Unknown
  RNA secondary structure sequence
ctttccaatgaaggaaattt

SEQ ID NO: 25446 - DNA, 20 bp, Unknown
  RNA secondary structure sequence
gtacagtgtactgcgccagc

SEQ ID NO: 25447 - DNA, 20 bp, Unknown
  RNA secondary structure sequence
actgtgggcgacaggttatg

SEQ ID NO: 25448 - DNA, 20 bp, Unknown
  RNA secondary structure sequence
taacctgtatagtcagttga

SEQ ID NO: 25449 - DNA, 20 bp, Unknown
  RNA secondary structure sequence
tgcgtcggctcatggtgctg

SEQ ID NO: 25450 - DNA, 20 bp, Unknown
  RNA secondary structure sequence
tcttacagacttaggagttt

SEQ ID NO: 25451 - DNA, 20 bp, Unknown
  RNA secondary structure sequence
ggaagcaaaagatcttgaag

SEQ ID NO: 25452 - DNA, 20 bp, Unknown
  RNA secondary structure sequence
ggagctttcatatatgaatg

SEQ ID NO: 25453 - DNA, 20 bp, Unknown
  RNA secondary structure sequence
ggggtttcctattttaccgg

SEQ ID NO: 25454 - DNA, 20 bp, Unknown
  RNA secondary structure sequence
agctcccgccacacgcaaag

SEQ ID NO: 25455 - DNA, 20 bp, Unknown
  RNA secondary structure sequence
agttacatctgtaaatggtt

SEQ ID NO: 25456 - DNA, 20 bp, Unknown
  RNA secondary structure sequence
gaggacaaatggtgcttatc

SEQ ID NO: 25457 - DNA, 20 bp, Unknown
  RNA secondary structure sequence
tgttgcaatccgctgtgggg

SEQ ID NO: 25458 - DNA, 20 bp, Unknown
  RNA secondary structure sequence
taagtcattagtgacagaag

SEQ ID NO: 25459 - DNA, 20 bp, Unknown
  RNA secondary structure sequence
tcaaatggtatcctcaacag

SEQ ID NO: 25460 - DNA, 20 bp, Unknown
  RNA secondary structure sequence
accctcaaaggattacctta

SEQ ID NO: 25461 - DNA, 20 bp, Unknown
  RNA secondary structure sequence
ttctgttaagactaagaagg

SEQ ID NO: 25462 - DNA, 20 bp, Unknown
  RNA secondary structure sequence
gaatgataccatcctgatga

SEQ ID NO: 25463 - DNA, 20 bp, Unknown
  RNA secondary structure sequence
atccattcgctggtgcaagt

SEQ ID NO: 25464 - DNA, 20 bp, Unknown
  RNA secondary structure sequence
ggtcgcgtatggttgttggc

SEQ ID NO: 25465 - DNA, 20 bp, Unknown
  RNA secondary structure sequence
cgagtatagttcaggggcta

SEQ ID NO: 25466 - DNA, 20 bp, Unknown
  RNA secondary structure sequence
gtacccggagtaccagaaga

SEQ ID NO: 25467 - DNA, 20 bp, Unknown
  RNA secondary structure sequence
acagggtaatttattatccc

SEQ ID NO: 25468 - DNA, 20 bp, Unknown
  RNA secondary structure sequence
tcccaatcagtgtgcgcttg

SEQ ID NO: 25469 - DNA, 20 bp, Unknown
  RNA secondary structure sequence
gtcactaccacaacagctct

SEQ ID NO: 25470 - DNA, 20 bp, Unknown
  RNA secondary structure sequence
gggcatctcgtccgcttatg

SEQ ID NO: 25471 - DNA, 20 bp, Unknown
  RNA secondary structure sequence
ctgccggccagtcaattttg

SEQ ID NO: 25472 - DNA, 20 bp, Unknown
  RNA secondary structure sequence
ctccgagtacaaaccagtgt

SEQ ID NO: 25473 - DNA, 20 bp, Unknown
  RNA secondary structure sequence
gtctgagataccgtattttc

SEQ ID NO: 25474 - DNA, 20 bp, Unknown
  RNA secondary structure sequence
gaccacgatcaccacccttg

SEQ ID NO: 25475 - DNA, 20 bp, Unknown
  RNA secondary structure sequence
gcttatggagacctttgata

SEQ ID NO: 25476 - DNA, 20 bp, Unknown
  RNA secondary structure sequence
atgtggaaaggccgtgaaac

SEQ ID NO: 25477 - DNA, 20 bp, Unknown
  RNA secondary structure sequence
acaaaagatgaaggtaaaac

SEQ ID NO: 25478 - DNA, 20 bp, Unknown
  RNA secondary structure sequence
aaccctcgcctccttcatat

SEQ ID NO: 25479 - DNA, 20 bp, Unknown
  RNA secondary structure sequence
caaccgtcccaccaaattca

SEQ ID NO: 25480 - DNA, 20 bp, Unknown
  RNA secondary structure sequence
aaggcctatcaacctcaaca

SEQ ID NO: 25481 - DNA, 20 bp, Unknown
  RNA secondary structure sequence
agagctgtccctggctgtgg

SEQ ID NO: 25482 - DNA, 20 bp, Unknown
  RNA secondary structure sequence
caacaacctcattatcaaga

SEQ ID NO: 25483 - DNA, 20 bp, Unknown
  RNA secondary structure sequence
ctttgtcattgcccacctac

SEQ ID NO: 25484 - DNA, 20 bp, Unknown
  RNA secondary structure sequence
atggtgcactacatgatacg

SEQ ID NO: 25485 - DNA, 20 bp, Unknown
  RNA secondary structure sequence
gccgaagatgtattgtgacc

SEQ ID NO: 25486 - DNA, 20 bp, Unknown
  RNA secondary structure sequence
atgtgatgcacatctaggat

SEQ ID NO: 25487 - DNA, 20 bp, Unknown
  RNA secondary structure sequence
ccaaaacttggatccagcag

SEQ ID NO: 25488 - DNA, 20 bp, Unknown
  RNA secondary structure sequence
gtgtctacccaaaatccatt

SEQ ID NO: 25489 - DNA, 20 bp, Unknown
  RNA secondary structure sequence
acaatgggcaacatccctta

SEQ ID NO: 25490 - DNA, 20 bp, Unknown
  RNA secondary structure sequence
accggaagatgacaatcatg

SEQ ID NO: 25491 - DNA, 20 bp, Unknown
  RNA secondary structure sequence
aatgaagcaccaggaaacta

SEQ ID NO: 25492 - DNA, 20 bp, Unknown
  RNA secondary structure sequence
ctcgctcccacctgatccaa

SEQ ID NO: 25493 - DNA, 20 bp, Unknown
  RNA secondary structure sequence
tattagtgattttgttctag

SEQ ID NO: 25494 - DNA, 20 bp, Unknown
  RNA secondary structure sequence
tcatgaggtggatgtgcttt

SEQ ID NO: 25495 - DNA, 20 bp, Unknown
  RNA secondary structure sequence
gggaccaaccgctccaaaac

SEQ ID NO: 25496 - DNA, 20 bp, Unknown
  RNA secondary structure sequence
aggaccaggagcaccaaatc

SEQ ID NO: 25497 - DNA, 20 bp, Unknown
  RNA secondary structure sequence
cactgagcccctgaccctag

SEQ ID NO: 25498 - DNA, 20 bp, Unknown
  RNA secondary structure sequence
tggatgcaatccagacaggg

SEQ ID NO: 25499 - DNA, 20 bp, Unknown
  RNA secondary structure sequence
tgaccacatgtgcttttccg

SEQ ID NO: 25500 - DNA, 20 bp, Unknown
  RNA secondary structure sequence
agatgatgaatttgatttct

SEQ ID NO: 25501 - DNA, 20 bp, Unknown
  RNA secondary structure sequence
ctgaggacatcctcgaggat

SEQ ID NO: 25502 - DNA, 20 bp, Unknown
  RNA secondary structure sequence
ctgttcctcttcctaatcca

SEQ ID NO: 25503 - DNA, 20 bp, Unknown
  RNA secondary structure sequence
ctgctaattggggaacacaa

SEQ ID NO: 25504 - DNA, 20 bp, Unknown
  RNA secondary structure sequence
gtttagcattggtcatggtc

SEQ ID NO: 25505 - DNA, 20 bp, Unknown
  RNA secondary structure sequence
ccctcctgtctggttgcgca

SEQ ID NO: 25506 - DNA, 20 bp, Unknown
  RNA secondary structure sequence
ccttttccaagaccttcact

SEQ ID NO: 25507 - DNA, 20 bp, Unknown
  RNA secondary structure sequence
cctctgaatacttccactct

SEQ ID NO: 25508 - DNA, 20 bp, Unknown
  RNA secondary structure sequence
ttgagcgggctgtctcacag

SEQ ID NO: 25509 - DNA, 20 bp, Unknown
  RNA secondary structure sequence
gtcgcagcgcaagctgtggc

SEQ ID NO: 25510 - DNA, 20 bp, Unknown
  RNA secondary structure sequence
gccaacatcgtgacctccgt

SEQ ID NO: 25511 - DNA, 20 bp, Unknown
  RNA secondary structure sequence
gccgttcactctttgtccaa

SEQ ID NO: 25512 - DNA, 20 bp, Unknown
  RNA secondary structure sequence
ttgttgtaactccagcaaat

SEQ ID NO: 25513 - DNA, 20 bp, Unknown
  RNA secondary structure sequence
acaccagatacactcttgct

SEQ ID NO: 25514 - DNA, 20 bp, Unknown
  RNA secondary structure sequence
ttgactgctgtgggattgac

SEQ ID NO: 25515 - DNA, 20 bp, Unknown
  RNA secondary structure sequence
aaatctgatgaaaacccttc

SEQ ID NO: 25516 - DNA, 20 bp, Unknown
  RNA secondary structure sequence
gactaattccactaccccgg

SEQ ID NO: 25517 - DNA, 20 bp, Unknown
  RNA secondary structure sequence
ccgtaaaggatgcgtgacaa

SEQ ID NO: 25518 - DNA, 20 bp, Unknown
  RNA secondary structure sequence
ttacacggccgatatgtcag

SEQ ID NO: 25519 - DNA, 20 bp, Unknown
  RNA secondary structure sequence
aggagccatgtccactgccc

SEQ ID NO: 25520 - DNA, 20 bp, Unknown
  RNA secondary structure sequence
caccgccaccccgtatggaa

SEQ ID NO: 25521 - DNA, 20 bp, Unknown
  RNA secondary structure sequence
gaaaacaaaagtgtttttgg

SEQ ID NO: 25522 - DNA, 20 bp, Unknown
  RNA secondary structure sequence
taggaggtgtttgtggcctg

SEQ ID NO: 25523 - DNA, 20 bp, Unknown
  RNA secondary structure sequence
gacctgtcctggaacgacgg

SEQ ID NO: 25524 - DNA, 20 bp, Unknown
  RNA secondary structure sequence
tctggctccgttgcctttag

SEQ ID NO: 25525 - DNA, 20 bp, Unknown
  RNA secondary structure sequence
ggccaacgacatattccttg

SEQ ID NO: 25526 - DNA, 20 bp, Unknown
  RNA secondary structure sequence
catggccggcttccatcccc

SEQ ID NO: 25527 - DNA, 20 bp, Unknown
  RNA secondary structure sequence
gactactgaagtgcaactta

SEQ ID NO: 25528 - DNA, 20 bp, Unknown
  RNA secondary structure sequence
tgagatactgcgtgaagctg

SEQ ID NO: 25529 - DNA, 20 bp, Unknown
  RNA secondary structure sequence
aacattcacgtatcgtcagt

SEQ ID NO: 25530 - DNA, 20 bp, Unknown
  RNA secondary structure sequence
gacagacgctttccctgagt

SEQ ID NO: 25531 - DNA, 20 bp, Unknown
  RNA secondary structure sequence
ggacaacatcacagtgcctg

SEQ ID NO: 25532 - DNA, 20 bp, Unknown
  RNA secondary structure sequence
cacggaatttgcagagggca

SEQ ID NO: 25533 - DNA, 20 bp, Unknown
  RNA secondary structure sequence
ggctgaaactgctatgctta

SEQ ID NO: 25534 - DNA, 20 bp, Unknown
  RNA secondary structure sequence
taaagctgcccgggaagcac

SEQ ID NO: 25535 - DNA, 20 bp, Unknown
  RNA secondary structure sequence
tcgaagcacgctgcatatga

SEQ ID NO: 25536 - DNA, 20 bp, Unknown
  RNA secondary structure sequence
accaggacatgaggaaccag

SEQ ID NO: 25537 - DNA, 20 bp, Unknown
  RNA secondary structure sequence
agttacaagtgtttgcatga

SEQ ID NO: 25538 - DNA, 20 bp, Unknown
  RNA secondary structure sequence
aggcgtcattcatggagatg

SEQ ID NO: 25539 - DNA, 20 bp, Unknown
  RNA secondary structure sequence
agctacctgggctgataaca

SEQ ID NO: 25540 - DNA, 20 bp, Unknown
  RNA secondary structure sequence
acggatcatgcatcgttatg

SEQ ID NO: 25541 - DNA, 20 bp, Unknown
  RNA secondary structure sequence
gcagcagacgatctgttgct

SEQ ID NO: 25542 - DNA, 20 bp, Unknown
  RNA secondary structure sequence
gtaaaccaacagtggatttc

SEQ ID NO: 25543 - DNA, 20 bp, Unknown
  RNA secondary structure sequence
tggtcaagagagactggttc

SEQ ID NO: 25544 - DNA, 20 bp, Unknown
  RNA secondary structure sequence
cgtcagtcgagtggaactct

SEQ ID NO: 25545 - DNA, 20 bp, Unknown
  RNA secondary structure sequence
catatgctggaacagatgcg

SEQ ID NO: 25546 - DNA, 20 bp, Unknown
  RNA secondary structure sequence
ggggcaagacaatgtttgtt

SEQ ID NO: 25547 - DNA, 20 bp, Unknown
  RNA secondary structure sequence
cagaatactgcgacacggaa

SEQ ID NO: 25548 - DNA, 20 bp, Unknown
  RNA secondary structure sequence
ttctgcaaatttgtgcggct

SEQ ID NO: 25549 - DNA, 20 bp, Unknown
  RNA secondary structure sequence
taagagtcagcatggttaca

SEQ ID NO: 25550 - DNA, 20 bp, Unknown
  RNA secondary structure sequence
tgtttcacacaatgtggcac

SEQ ID NO: 25551 - DNA, 20 bp, Unknown
  RNA secondary structure sequence
aagatgaggaaagggaaatt

SEQ ID NO: 25552 - DNA, 20 bp, Unknown
  RNA secondary structure sequence
taagcccagctagtgcagca

SEQ ID NO: 25553 - DNA, 20 bp, Unknown
  RNA secondary structure sequence
agttctacgagccggaggct

SEQ ID NO: 25554 - DNA, 20 bp, Unknown
  RNA secondary structure sequence
gtgggccatctggacatctc

SEQ ID NO: 25555 - DNA, 20 bp, Unknown
  RNA secondary structure sequence
ctataatagaagtgctcggc

SEQ ID NO: 25556 - DNA, 20 bp, Unknown
  RNA secondary structure sequence
tcatgaccatgggaatacta

SEQ ID NO: 25557 - DNA, 20 bp, Unknown
  RNA secondary structure sequence
ttttcaacttggactggggc

SEQ ID NO: 25558 - DNA, 20 bp, Unknown
  RNA secondary structure sequence
acacccgagggatggaatgg

SEQ ID NO: 25559 - DNA, 20 bp, Unknown
  RNA secondary structure sequence
ggctggtagataaaggatat

SEQ ID NO: 25560 - DNA, 20 bp, Unknown
  RNA secondary structure sequence
acattgtcactctgcgtagc

SEQ ID NO: 25561 - DNA, 20 bp, Unknown
  RNA secondary structure sequence
tttgttgcaaggttcttgct

SEQ ID NO: 25562 - DNA, 20 bp, Unknown
  RNA secondary structure sequence
gcaagggaggaaagacgcta

SEQ ID NO: 25563 - DNA, 20 bp, Unknown
  RNA secondary structure sequence
caacaggctggaacagttgg

SEQ ID NO: 25564 - DNA, 20 bp, Unknown
  RNA secondary structure sequence
gtaaggcgtatgcgcaaatg

SEQ ID NO: 25565 - DNA, 20 bp, Unknown
  RNA secondary structure sequence
acccccccaaaaatgaaggg

SEQ ID NO: 25566 - DNA, 20 bp, Unknown
  RNA secondary structure sequence
ttctcttattttcactagtt

SEQ ID NO: 25567 - DNA, 20 bp, Unknown
  RNA secondary structure sequence
ccgtggaggatcgcccggga

SEQ ID NO: 25568 - DNA, 20 bp, Unknown
  RNA secondary structure sequence
cacgatattttcagttcttt

SEQ ID NO: 25569 - DNA, 20 bp, Unknown
  RNA secondary structure sequence
agtctccgatttttgggcgt

SEQ ID NO: 25570 - DNA, 20 bp, Unknown
  RNA secondary structure sequence
cttccaacgttataaaatgc

SEQ ID NO: 25571 - DNA, 20 bp, Unknown
  RNA secondary structure sequence
gtcgtggatggtatgtcatg

SEQ ID NO: 25572 - DNA, 20 bp, Unknown
  RNA secondary structure sequence
ctcatagttattcgcatgag

SEQ ID NO: 25573 - DNA, 20 bp, Unknown
  RNA secondary structure sequence
ccgcttttgtggatgccctt

SEQ ID NO: 25574 - DNA, 20 bp, Unknown
  RNA secondary structure sequence
ctttgtccttgagtgctcgt

SEQ ID NO: 25575 - DNA, 20 bp, Unknown
  RNA secondary structure sequence
aatatcagaatacgtgtgct

SEQ ID NO: 25576 - DNA, 20 bp, Unknown
  RNA secondary structure sequence
ggtatgctgggcaaccgatt

SEQ ID NO: 25577 - DNA, 20 bp, Unknown
  RNA secondary structure sequence
aatcagattggtcatctcgt

SEQ ID NO: 25578 - DNA, 20 bp, Unknown
  RNA secondary structure sequence
cagtgttcgactattgcgct

SEQ ID NO: 25579 - DNA, 20 bp, Unknown
  RNA secondary structure sequence
ctatgcttaaggaattggac

SEQ ID NO: 25580 - DNA, 20 bp, Unknown
  RNA secondary structure sequence
gccttgcatttggtggtaat

SEQ ID NO: 25581 - DNA, 20 bp, Unknown
  RNA secondary structure sequence
attttgactatgtttttagt

SEQ ID NO: 25582 - DNA, 20 bp, Unknown
  RNA secondary structure sequence
atggttctataccacgtcag

SEQ ID NO: 25583 - DNA, 20 bp, Unknown
  RNA secondary structure sequence
ctattgtcaatacagcttgt

SEQ ID NO: 25584 - DNA, 20 bp, Unknown
  RNA secondary structure sequence
ttgatggtgattatcccaag

SEQ ID NO: 25585 - DNA, 20 bp, Unknown
  RNA secondary structure sequence
tatcccagcgcgtggtggac

SEQ ID NO: 25586 - DNA, 20 bp, Unknown
  RNA secondary structure sequence
cttagtatcatggaaatgtg

SEQ ID NO: 25587 - DNA, 20 bp, Unknown
  RNA secondary structure sequence
atgggatctgatcagggcca

SEQ ID NO: 25588 - DNA, 20 bp, Unknown
  RNA secondary structure sequence
tgaccaaggattaatggctt

SEQ ID NO: 25589 - DNA, 20 bp, Unknown
  RNA secondary structure sequence
ctcctcccgcggtgtagata

SEQ ID NO: 25590 - DNA, 20 bp, Unknown
  RNA secondary structure sequence
tggttccggcgatggttaca

SEQ ID NO: 25591 - DNA, 20 bp, Unknown
  RNA secondary structure sequence
ccccggttttgctgccccat

SEQ ID NO: 25592 - DNA, 20 bp, Unknown
  RNA secondary structure sequence
cccaatcaagaccaatactc

SEQ ID NO: 25593 - DNA, 20 bp, Unknown
  RNA secondary structure sequence
atacaacctgcagaactcag

SEQ ID NO: 25594 - DNA, 20 bp, Unknown
  RNA secondary structure sequence
tgtccccgccccccgtcccg

SEQ ID NO: 25595 - DNA, 20 bp, Unknown
  RNA secondary structure sequence
tggtcaatctgttcacattg

SEQ ID NO: 25596 - DNA, 20 bp, Unknown
  RNA secondary structure sequence
taggcttactgtagatatgg

SEQ ID NO: 25597 - DNA, 20 bp, Unknown
  RNA secondary structure sequence
cgaggaagcgattcgtgaaa

SEQ ID NO: 25598 - DNA, 20 bp, Unknown
  RNA secondary structure sequence
tcgccttgtcggtgtacatg

SEQ ID NO: 25599 - DNA, 20 bp, Unknown
  RNA secondary structure sequence
ccattccaatcctggtatgt

SEQ ID NO: 25600 - DNA, 20 bp, Unknown
  RNA secondary structure sequence
gtctgccctcatctcccgtc

SEQ ID NO: 25601 - DNA, 20 bp, Unknown
  RNA secondary structure sequence
tttccctaactcctcttctc

SEQ ID NO: 25602 - DNA, 20 bp, Unknown
  RNA secondary structure sequence
tgctcaccacgctggtcccc

SEQ ID NO: 25603 - DNA, 20 bp, Unknown
  RNA secondary structure sequence
aggtgctctggccgagctaa

SEQ ID NO: 25604 - DNA, 20 bp, Unknown
  RNA secondary structure sequence
gctcattgggaagagttacc

SEQ ID NO: 25605 - DNA, 20 bp, Unknown
  RNA secondary structure sequence
gaaagtagttgtgtccgaga

SEQ ID NO: 25606 - DNA, 20 bp, Unknown
  RNA secondary structure sequence
ttgggtgattctcattctga

SEQ ID NO: 25607 - DNA, 20 bp, Unknown
  RNA secondary structure sequence
aagatttatgcatggcttcc

SEQ ID NO: 25608 - DNA, 20 bp, Unknown
  RNA secondary structure sequence
aggttggatatacaagtgcg

SEQ ID NO: 25609 - DNA, 20 bp, Unknown
  RNA secondary structure sequence
gaagagtatgcaggagcttt

SEQ ID NO: 25610 - DNA, 20 bp, Unknown
  RNA secondary structure sequence
atgcaattagtaggtgctcg

SEQ ID NO: 25611 - DNA, 20 bp, Unknown
  RNA secondary structure sequence
ggtgagttcatagtagataa

SEQ ID NO: 25612 - DNA, 20 bp, Unknown
  RNA secondary structure sequence
aatcaagggttggctttggc

SEQ ID NO: 25613 - DNA, 20 bp, Unknown
  RNA secondary structure sequence
aaggtgtgtgagtggtttaa

SEQ ID NO: 25614 - DNA, 20 bp, Unknown
  RNA secondary structure sequence
gaaaacacgcgtcaggagac

SEQ ID NO: 25615 - DNA, 20 bp, Unknown
  RNA secondary structure sequence
atagtgaactagtatcagat

SEQ ID NO: 25616 - DNA, 20 bp, Unknown
  RNA secondary structure sequence
cctatgtacttcagcgttac

SEQ ID NO: 25617 - DNA, 20 bp, Unknown
  RNA secondary structure sequence
cttcttatgtggcgcaagat

SEQ ID NO: 25618 - DNA, 20 bp, Unknown
  RNA secondary structure sequence
ttaccttacctggtatcaat

SEQ ID NO: 25619 - DNA, 20 bp, Unknown
  RNA secondary structure sequence
ctaatgcttatcagtttgat

SEQ ID NO: 25620 - DNA, 20 bp, Unknown
  RNA secondary structure sequence
atgaatattttgttcttgct

SEQ ID NO: 25621 - DNA, 20 bp, Unknown
  RNA secondary structure sequence
aatgtgatcacttcggtgag

SEQ ID NO: 25622 - DNA, 20 bp, Unknown
  RNA secondary structure sequence
agttttggatagtgaaggat

SEQ ID NO: 25623 - DNA, 20 bp, Unknown
  RNA secondary structure sequence
tggtgccacagtttgtttac

SEQ ID NO: 25624 - DNA, 20 bp, Unknown
  RNA secondary structure sequence
agactcctgaggttacagct

SEQ ID NO: 25625 - DNA, 20 bp, Unknown
  RNA secondary structure sequence
cacctttcccctcttcagat

SEQ ID NO: 25626 - DNA, 20 bp, Unknown
  RNA secondary structure sequence
ccaacatggggccaaagatt

SEQ ID NO: 25627 - DNA, 20 bp, Unknown
  RNA secondary structure sequence
gctttagggaaagaatgcaa

SEQ ID NO: 25628 - DNA, 20 bp, Unknown
  RNA secondary structure sequence
tgttctctagtgcgtgcttg

SEQ ID NO: 25629 - DNA, 20 bp, Unknown
  RNA secondary structure sequence
tgtggaatgatgcaacacac

SEQ ID NO: 25630 - DNA, 20 bp, Unknown
  RNA secondary structure sequence
gcagtgttgttgttgttgac

SEQ ID NO: 25631 - DNA, 20 bp, Unknown
  RNA secondary structure sequence
gaggagcccgcttttatgca

SEQ ID NO: 25632 - DNA, 20 bp, Unknown
  RNA secondary structure sequence
cggatgaaggcttggacatg

SEQ ID NO: 25633 - DNA, 20 bp, Unknown
  RNA secondary structure sequence
ctaccttttcctttcaatgc

SEQ ID NO: 25634 - DNA, 20 bp, Unknown
  RNA secondary structure sequence
aacatcgtggcgagcaggac

SEQ ID NO: 25635 - DNA, 20 bp, Unknown
  RNA secondary structure sequence
aaagaagaaaagaggaggaa

SEQ ID NO: 25636 - DNA, 20 bp, Unknown
  RNA secondary structure sequence
cacagtccatcatcatggcg

SEQ ID NO: 25637 - DNA, 20 bp, Unknown
  RNA secondary structure sequence
caaaatgatgaacatggagg

SEQ ID NO: 25638 - DNA, 20 bp, Unknown
  RNA secondary structure sequence
gttccatgatttaaatctgc

SEQ ID NO: 25639 - DNA, 20 bp, Unknown
  RNA secondary structure sequence
aagcagcaagctggaaatga

SEQ ID NO: 25640 - DNA, 20 bp, Unknown
  RNA secondary structure sequence
tcaaattaaatatcagtggc

SEQ ID NO: 25641 - DNA, 20 bp, Unknown
  RNA secondary structure sequence
acacaacatgtgggattcga

SEQ ID NO: 25642 - DNA, 20 bp, Unknown
  RNA secondary structure sequence
ctttacgagtccaggcatgt

SEQ ID NO: 25643 - DNA, 20 bp, Unknown
  RNA secondary structure sequence
atcagctcgaaccaccactg

SEQ ID NO: 25644 - DNA, 20 bp, Unknown
  RNA secondary structure sequence
aggcgatggcatggaaccat

SEQ ID NO: 25645 - DNA, 20 bp, Unknown
  RNA secondary structure sequence
gcaagattgggacatgacaa

SEQ ID NO: 25646 - DNA, 20 bp, Unknown
  RNA secondary structure sequence
catagggattatgtcgctga

SEQ ID NO: 25647 - DNA, 20 bp, Unknown
  RNA secondary structure sequence
actgacagccgttggattga

SEQ ID NO: 25648 - DNA, 20 bp, Unknown
  RNA secondary structure sequence
gctcacagtcaaggctccga

SEQ ID NO: 25649 - DNA, 20 bp, Unknown
  RNA secondary structure sequence
cgttatggatgaagcacatt

SEQ ID NO: 25650 - DNA, 20 bp, Unknown
  RNA secondary structure sequence
acaaaggaggggaagagtgg

SEQ ID NO: 25651 - DNA, 20 bp, Unknown
  RNA secondary structure sequence
agagaaggtcttttccattg

SEQ ID NO: 25652 - DNA, 20 bp, Unknown
  RNA secondary structure sequence
gcctcttcttttactcggat

SEQ ID NO: 25653 - DNA, 20 bp, Unknown
  RNA secondary structure sequence
aatagtcgccacagacatac

SEQ ID NO: 25654 - DNA, 20 bp, Unknown
  RNA secondary structure sequence
gccacacggaaaggttatag

SEQ ID NO: 25655 - DNA, 20 bp, Unknown
  RNA secondary structure sequence
gcccaaggtgcttaaagagc

SEQ ID NO: 25656 - DNA, 20 bp, Unknown
  RNA secondary structure sequence
ttggaactatcatggaagtt

SEQ ID NO: 25657 - DNA, 20 bp, Unknown
  RNA secondary structure sequence
catgtggttaggttcaagat

SEQ ID NO: 25658 - DNA, 20 bp, Unknown
  RNA secondary structure sequence
cgtcatctcacgggaagacc

SEQ ID NO: 25659 - DNA, 20 bp, Unknown
  RNA secondary structure sequence
ggcgatagtcaggccaggca

SEQ ID NO: 25660 - DNA, 20 bp, Unknown
  RNA secondary structure sequence
gtaggttttacgccactagc

SEQ ID NO: 25661 - DNA, 20 bp, Unknown
  RNA secondary structure sequence
atggtgtgccccttgtggaa

SEQ ID NO: 25662 - DNA, 20 bp, Unknown
  RNA secondary structure sequence
ttgagatgctacgtggacga

SEQ ID NO: 25663 - DNA, 20 bp, Unknown
  RNA secondary structure sequence
acttccacgtaagggagatt

SEQ ID NO: 25664 - DNA, 20 bp, Unknown
  RNA secondary structure sequence
gaagttttcttttgcgggta

SEQ ID NO: 25665 - DNA, 20 bp, Unknown
  RNA secondary structure sequence
gaaccccaaagactgtgata

SEQ ID NO: 25666 - DNA, 20 bp, Unknown
  RNA secondary structure sequence
tgctatagcaaaaacaactg

SEQ ID NO: 25667 - DNA, 20 bp, Unknown
  RNA secondary structure sequence
tctcgtttgcccaattgggt

SEQ ID NO: 25668 - DNA, 20 bp, Unknown
  RNA secondary structure sequence
cagacatggggtgataatag

SEQ ID NO: 25669 - DNA, 20 bp, Unknown
  RNA secondary structure sequence
ccccacgacaataccactta

SEQ ID NO: 25670 - DNA, 20 bp, Unknown
  RNA secondary structure sequence
agaagttgcagggggaacaa

SEQ ID NO: 25671 - DNA, 20 bp, Unknown
  RNA secondary structure sequence
tacgtcactgctgaaaatca

SEQ ID NO: 25672 - DNA, 20 bp, Unknown
  RNA secondary structure sequence
gaatagaggagaatttaaac

SEQ ID NO: 25673 - DNA, 20 bp, Unknown
  RNA secondary structure sequence
atcattcaatctgagaattg

SEQ ID NO: 25674 - DNA, 20 bp, Unknown
  RNA secondary structure sequence
acaagctgccactgatctag

SEQ ID NO: 25675 - DNA, 20 bp, Unknown
  RNA secondary structure sequence
acaaaatcctgtatcggttg

SEQ ID NO: 25676 - DNA, 20 bp, Unknown
  RNA secondary structure sequence
aataatggccctgtttgaag

SEQ ID NO: 25677 - DNA, 20 bp, Unknown
  RNA secondary structure sequence
caaaggtacattccttacta

SEQ ID NO: 25678 - DNA, 20 bp, Unknown
  RNA secondary structure sequence
gttcgaagagctcatgcttc

SEQ ID NO: 25679 - DNA, 20 bp, Unknown
  RNA secondary structure sequence
cgtgtacaacaagattatag

SEQ ID NO: 25680 - DNA, 20 bp, Unknown
  RNA secondary structure sequence
attcaacaccctgaagaaaa

SEQ ID NO: 25681 - DNA, 20 bp, Unknown
  RNA secondary structure sequence
acagaagccggtggtaatac

SEQ ID NO: 25682 - DNA, 20 bp, Unknown
  RNA secondary structure sequence
ggcatatgaaaaagccgttg

SEQ ID NO: 25683 - DNA, 20 bp, Unknown
  RNA secondary structure sequence
cagtcggcagggtcgacccc

SEQ ID NO: 25684 - DNA, 20 bp, Unknown
  RNA secondary structure sequence
ccgcccttttaacgcttcgg

SEQ ID NO: 25685 - DNA, 20 bp, Unknown
  RNA secondary structure sequence
gctgcataaatcccccccct

SEQ ID NO: 25686 - DNA, 20 bp, Unknown
  RNA secondary structure sequence
gggagctgtatggcgcgggg

SEQ ID NO: 25687 - DNA, 20 bp, Unknown
  RNA secondary structure sequence
agcttcctggcgctctctgg

SEQ ID NO: 25688 - DNA, 20 bp, Unknown
  RNA secondary structure sequence
gccctaaaatttctgaccat

SEQ ID NO: 25689 - DNA, 20 bp, Unknown
  RNA secondary structure sequence
tggcttggttccctgtggaa

SEQ ID NO: 25690 - DNA, 20 bp, Unknown
  RNA secondary structure sequence
gctttgactatgtcggccca

SEQ ID NO: 25691 - DNA, 20 bp, Unknown
  RNA secondary structure sequence
ggtctgccttgggcttggag

SEQ ID NO: 25692 - DNA, 20 bp, Unknown
  RNA secondary structure sequence
tccttgaagcttgcctctgt

SEQ ID NO: 25693 - DNA, 20 bp, Unknown
  RNA secondary structure sequence
tcctgaaggaattggagtgc

SEQ ID NO: 25694 - DNA, 20 bp, Unknown
  RNA secondary structure sequence
tgttcacaacgtggcactcc

SEQ ID NO: 25695 - DNA, 20 bp, Unknown
  RNA secondary structure sequence
atgggggcctagcccatgga

SEQ ID NO: 25696 - DNA, 20 bp, Unknown
  RNA secondary structure sequence
gctatgttgagccctggaag

SEQ ID NO: 25697 - DNA, 20 bp, Unknown
  RNA secondary structure sequence
tccttgttctaaatcctagc

SEQ ID NO: 25698 - DNA, 20 bp, Unknown
  RNA secondary structure sequence
gcctcctgcgggcctacgca

SEQ ID NO: 25699 - DNA, 20 bp, Unknown
  RNA secondary structure sequence
ctgctggaccgattctgttg

SEQ ID NO: 25700 - DNA, 20 bp, Unknown
  RNA secondary structure sequence
ggacggcgcttacaggaaat

SEQ ID NO: 25701 - DNA, 20 bp, Unknown
  RNA secondary structure sequence
gtactggtacccccgaagca

SEQ ID NO: 25702 - DNA, 20 bp, Unknown
  RNA secondary structure sequence
aggacgtcactgctcgtgca

SEQ ID NO: 25703 - DNA, 20 bp, Unknown
  RNA secondary structure sequence
ttgcttatgtgaaggacagg

SEQ ID NO: 25704 - DNA, 20 bp, Unknown
  RNA secondary structure sequence
tgcccgagattatcccccct

SEQ ID NO: 25705 - DNA, 20 bp, Unknown
  RNA secondary structure sequence
ccggcgtcacccccacgcag

SEQ ID NO: 25706 - DNA, 20 bp, Unknown
  RNA secondary structure sequence
tcttcgcgtgcaaccatgct

SEQ ID NO: 25707 - DNA, 20 bp, Unknown
  RNA secondary structure sequence
ctgcctgtcgcaagataggc

SEQ ID NO: 25708 - DNA, 20 bp, Unknown
  RNA secondary structure sequence
tgttgattccgacactgctt

SEQ ID NO: 25709 - DNA, 20 bp, Unknown
  RNA secondary structure sequence
cactgtcagaagcacaaaaa

SEQ ID NO: 25710 - DNA, 20 bp, Unknown
  RNA secondary structure sequence
acttaattgtggggatgtcg

SEQ ID NO: 25711 - DNA, 20 bp, Unknown
  RNA secondary structure sequence
ccgccaatctaactctacgt

SEQ ID NO: 25712 - DNA, 20 bp, Unknown
  RNA secondary structure sequence
ggagcgtgtggcccgcagcc

SEQ ID NO: 25713 - DNA, 20 bp, Unknown
  RNA secondary structure sequence
ccgaggggacgtgttccaga

SEQ ID NO: 25714 - DNA, 20 bp, Unknown
  RNA secondary structure sequence
gatgtacgccatgaagtgcc

SEQ ID NO: 25715 - DNA, 20 bp, Unknown
  RNA secondary structure sequence
catgaacggtggggacctgc

SEQ ID NO: 25716 - DNA, 20 bp, Unknown
  RNA secondary structure sequence
ccccttccggcagcacaaga

SEQ ID NO: 25717 - DNA, 20 bp, Unknown
  RNA secondary structure sequence
gaaagagagcccctttttcc

SEQ ID NO: 25718 - DNA, 20 bp, Unknown
  RNA secondary structure sequence
cctcaagatccgcggtggga

SEQ ID NO: 25719 - DNA, 20 bp, Unknown
  RNA secondary structure sequence
ctgcactctgtgcccatggg

SEQ ID NO: 25720 - DNA, 20 bp, Unknown
  RNA secondary structure sequence
ccagcacccgggctcaggga

SEQ ID NO: 25721 - DNA, 20 bp, Unknown
  RNA secondary structure sequence
cagctatgcgggttgacaat

SEQ ID NO: 25722 - DNA, 20 bp, Unknown
  RNA secondary structure sequence
atgtctggtggcttatggct

SEQ ID NO: 25723 - DNA, 20 bp, Unknown
  RNA secondary structure sequence
accttacagtttggccttct

SEQ ID NO: 25724 - DNA, 20 bp, Unknown
  RNA secondary structure sequence
atgtggttcctgcgtccgcg

SEQ ID NO: 25725 - DNA, 20 bp, Unknown
  RNA secondary structure sequence
ttcgccggcttggttgctta

SEQ ID NO: 25726 - DNA, 20 bp, Unknown
  RNA secondary structure sequence
gtcagactttcgcgggtctt

SEQ ID NO: 25727 - DNA, 20 bp, Unknown
  RNA secondary structure sequence
tcgggcgaggttactcgctc

SEQ ID NO: 25728 - DNA, 20 bp, Unknown
  RNA secondary structure sequence
tgacaccgtaacagactgtg

SEQ ID NO: 25729 - DNA, 20 bp, Unknown
  RNA secondary structure sequence
gaggacagtgcctgttggcg

SEQ ID NO: 25730 - DNA, 20 bp, Unknown
  RNA secondary structure sequence
cgttcggagggcggtgcgag

SEQ ID NO: 25731 - DNA, 20 bp, Unknown
  RNA secondary structure sequence
atctggcagtgttgccggta

SEQ ID NO: 25732 - DNA, 20 bp, Unknown
  RNA secondary structure sequence
agaggtatctactcctatat

SEQ ID NO: 25733 - DNA, 20 bp, Unknown
  RNA secondary structure sequence
taccaaagtttatgttactg

SEQ ID NO: 25734 - DNA, 20 bp, Unknown
  RNA secondary structure sequence
agttaggcgccgagcagccg

SEQ ID NO: 25735 - DNA, 20 bp, Unknown
  RNA secondary structure sequence
aagattcatagttttcccac

SEQ ID NO: 25736 - DNA, 20 bp, Unknown
  RNA secondary structure sequence
gtgtaggtcgtcgggcgtgt

SEQ ID NO: 25737 - DNA, 20 bp, Unknown
  RNA secondary structure sequence
cctactgaagtagacgtaat

SEQ ID NO: 25738 - DNA, 20 bp, Unknown
  RNA secondary structure sequence
tccacaggtgttggtcctac

SEQ ID NO: 25739 - DNA, 20 bp, Unknown
  RNA secondary structure sequence
gctggagcagcgtattgtca

SEQ ID NO: 25740 - DNA, 20 bp, Unknown
  RNA secondary structure sequence
tgggaacgtcacacttttgt

SEQ ID NO: 25741 - DNA, 20 bp, Unknown
  RNA secondary structure sequence
gggttctgtgtcttggtttg

SEQ ID NO: 25742 - DNA, 20 bp, Unknown
  RNA secondary structure sequence
caggcggcctgcctcgtgtg

SEQ ID NO: 25743 - DNA, 20 bp, Unknown
  RNA secondary structure sequence
ggatgcgggcaacttcattc

SEQ ID NO: 25744 - DNA, 20 bp, Unknown
  RNA secondary structure sequence
gatggggatttccgccactc

SEQ ID NO: 25745 - DNA, 20 bp, Unknown
  RNA secondary structure sequence
tttcgacgcgctcgattggg

SEQ ID NO: 25746 - DNA, 20 bp, Unknown
  RNA secondary structure sequence
gcacaaggtcctgattctca

SEQ ID NO: 25747 - DNA, 20 bp, Unknown
  RNA secondary structure sequence
atccataattgagacaaagc

SEQ ID NO: 25748 - DNA, 20 bp, Unknown
  RNA secondary structure sequence
gggtaaggacagttccatca

SEQ ID NO: 25749 - DNA, 20 bp, Unknown
  RNA secondary structure sequence
tgcttcggctgaattgtcga

SEQ ID NO: 25750 - DNA, 20 bp, Unknown
  RNA secondary structure sequence
cccggtagaccatcggccgg

SEQ ID NO: 25751 - DNA, 20 bp, Unknown
  RNA secondary structure sequence
gtggctcgctggctgctaca

SEQ ID NO: 25752 - DNA, 20 bp, Unknown
  RNA secondary structure sequence
ggggtacgtctgggatctgt

SEQ ID NO: 25753 - DNA, 20 bp, Unknown
  RNA secondary structure sequence
tgaggtggtggtgaccccta

SEQ ID NO: 25754 - DNA, 20 bp, Unknown
  RNA secondary structure sequence
tgttaccattgatggggagc

SEQ ID NO: 25755 - DNA, 20 bp, Unknown
  RNA secondary structure sequence
gacctcctcgcaggaggaca

SEQ ID NO: 25756 - DNA, 20 bp, Unknown
  RNA secondary structure sequence
ggcacgccaagagacccttg

SEQ ID NO: 25757 - DNA, 20 bp, Unknown
  RNA secondary structure sequence
gctcattctgggagacccgg

SEQ ID NO: 25758 - DNA, 20 bp, Unknown
  RNA secondary structure sequence
agggagtggtactctgttat

SEQ ID NO: 25759 - DNA, 20 bp, Unknown
  RNA secondary structure sequence
caaacaatggacaaggtgtg

SEQ ID NO: 25760 - DNA, 20 bp, Unknown
  RNA secondary structure sequence
ggtatttttggtgaaaacat

SEQ ID NO: 25761 - DNA, 20 bp, Unknown
  RNA secondary structure sequence
ttttgtggtactgccaacac

SEQ ID NO: 25762 - DNA, 20 bp, Unknown
  RNA secondary structure sequence
aacacatcaccaggtagatc

SEQ ID NO: 25763 - DNA, 20 bp, Unknown
  RNA secondary structure sequence
atagcacagaaccctgttga

SEQ ID NO: 25764 - DNA, 20 bp, Unknown
  RNA secondary structure sequence
ttcacctatactaggtttga

SEQ ID NO: 25765 - DNA, 20 bp, Unknown
  RNA secondary structure sequence
atgtatgttcatgtaggtaa

SEQ ID NO: 25766 - DNA, 20 bp, Unknown
  RNA secondary structure sequence
aaaattattaaatggatgtt

SEQ ID NO: 25767 - DNA, 20 bp, Unknown
  RNA secondary structure sequence
aatccagccggggatgacat

SEQ ID NO: 25768 - DNA, 20 bp, Unknown
  RNA secondary structure sequence
tcttgcaacaaatacagcct

SEQ ID NO: 25769 - DNA, 20 bp, Unknown
  RNA secondary structure sequence
attaagtattgtgagggtaa

SEQ ID NO: 25770 - DNA, 20 bp, Unknown
  RNA secondary structure sequence
cctggttcaaaagaaccagc

SEQ ID NO: 25771 - DNA, 20 bp, Unknown
  RNA secondary structure sequence
aaacctattacacttgagga

SEQ ID NO: 25772 - DNA, 20 bp, Unknown
  RNA secondary structure sequence
gcagttggatgtgatccaga

SEQ ID NO: 25773 - DNA, 20 bp, Unknown
  RNA secondary structure sequence
ctatgcaagtctaaacacat

SEQ ID NO: 25774 - DNA, 20 bp, Unknown
  RNA secondary structure sequence
tatggtgatgatgtcatatt

SEQ ID NO: 25775 - DNA, 20 bp, Unknown
  RNA secondary structure sequence
aagaacaggtactatgagcc

SEQ ID NO: 25776 - DNA, 20 bp, Unknown
  RNA secondary structure sequence
ggccacaacctttttgatct

SEQ ID NO: 25777 - DNA, 20 bp, Unknown
  RNA secondary structure sequence
cctctgctgcttctccttgg

SEQ ID NO: 25778 - DNA, 20 bp, Unknown
  RNA secondary structure sequence
tttttttgtttttccccttt

SEQ ID NO: 25779 - DNA, 20 bp, Unknown
  RNA secondary structure sequence
cttttacaacagggggagaa

SEQ ID NO: 25780 - DNA, 20 bp, Unknown
  RNA secondary structure sequence
ccgagccgcccgatctgttt

SEQ ID NO: 25781 - DNA, 20 bp, Unknown
  RNA secondary structure sequence
cttccgaagagtgcgtgttt

SEQ ID NO: 25782 - DNA, 20 bp, Unknown
  RNA secondary structure sequence
ccttcttatgattgttgttt

SEQ ID NO: 25783 - DNA, 20 bp, Unknown
  RNA secondary structure sequence
caaggctacttaaaaaaatc

SEQ ID NO: 25784 - DNA, 20 bp, Unknown
  RNA secondary structure sequence
agtctcagctcttgcttttc

SEQ ID NO: 25785 - DNA, 20 bp, Unknown
  RNA secondary structure sequence
tggccttgttacgggagata

SEQ ID NO: 25786 - DNA, 20 bp, Unknown
  RNA secondary structure sequence
tgtttgctgatcgttttact

SEQ ID NO: 25787 - DNA, 20 bp, Unknown
  RNA secondary structure sequence
ctgcaagcaagattcgtgga

SEQ ID NO: 25788 - DNA, 20 bp, Unknown
  RNA secondary structure sequence
gtggaaaactcctgttgccg

SEQ ID NO: 25789 - DNA, 20 bp, Unknown
  RNA secondary structure sequence
ccaggcgcgtcctgccttca

SEQ ID NO: 25790 - DNA, 20 bp, Unknown
  RNA secondary structure sequence
tgctgttcggagtttaatca

SEQ ID NO: 25791 - DNA, 20 bp, Unknown
  RNA secondary structure sequence
cgactcctgattcattggga

SEQ ID NO: 25792 - DNA, 20 bp, Unknown
  RNA secondary structure sequence
taacctttcagcatcacaga

SEQ ID NO: 25793 - DNA, 20 bp, Unknown
  RNA secondary structure sequence
atttcctgcgtctcatgcca

SEQ ID NO: 25794 - DNA, 20 bp, Unknown
  RNA secondary structure sequence
taaaaatcttagttcatgtg

SEQ ID NO: 25795 - DNA, 20 bp, Unknown
  RNA secondary structure sequence
cccatagcagcgggcgggca

SEQ ID NO: 25796 - DNA, 20 bp, Unknown
  RNA secondary structure sequence
aggacgcgactctcccgacg

SEQ ID NO: 25797 - DNA, 20 bp, Unknown
  RNA secondary structure sequence
gcggggaggctattctgccc

SEQ ID NO: 25798 - DNA, 20 bp, Unknown
  RNA secondary structure sequence
ctttcccctcccttccctat

SEQ ID NO: 25799 - DNA, 20 bp, Unknown
  RNA secondary structure sequence
acttggggactgctggtggg

SEQ ID NO: 25800 - DNA, 20 bp, Unknown
  RNA secondary structure sequence
gtgtatatatgtatgtgtgt

SEQ ID NO: 25801 - DNA, 20 bp, Unknown
  RNA secondary structure sequence
gaggccaacctactaacagg

SEQ ID NO: 25802 - DNA, 20 bp, Unknown
  RNA secondary structure sequence
ttcttctcatggggtttctc

SEQ ID NO: 25803 - DNA, 20 bp, Unknown
  RNA secondary structure sequence
gagagagaggacaagtggat

SEQ ID NO: 25804 - DNA, 20 bp, Unknown
  RNA secondary structure sequence
catcgcctccttttctggga

SEQ ID NO: 25805 - DNA, 20 bp, Unknown
  RNA secondary structure sequence
gctggccaccttcggaacca

SEQ ID NO: 25806 - DNA, 20 bp, Unknown
  RNA secondary structure sequence
gttcactgtgcagggattgt

SEQ ID NO: 25807 - DNA, 20 bp, Unknown
  RNA secondary structure sequence
tcgcgggaaactgaagtggt

SEQ ID NO: 25808 - DNA, 20 bp, Unknown
  RNA secondary structure sequence
tagtttcattgtggtataaa

SEQ ID NO: 25809 - DNA, 20 bp, Unknown
  RNA secondary structure sequence
cggtcctcgcagagttgcgg

SEQ ID NO: 25810 - DNA, 20 bp, Unknown
  RNA secondary structure sequence
ctaattcccttctttgggct

SEQ ID NO: 25811 - DNA, 20 bp, Unknown
  RNA secondary structure sequence
agctggccggcggaggcgtg

SEQ ID NO: 25812 - DNA, 20 bp, Unknown
  RNA secondary structure sequence
aaactcgacccgggaacaaa

SEQ ID NO: 25813 - DNA, 20 bp, Unknown
  RNA secondary structure sequence
ctccgcagtgccctccactg

SEQ ID NO: 25814 - DNA, 20 bp, Unknown
  RNA secondary structure sequence
gaagcgaaagggaagaaaat

SEQ ID NO: 25815 - DNA, 20 bp, Unknown
  RNA secondary structure sequence
gggtggctcctttttctttt

SEQ ID NO: 25816 - DNA, 20 bp, Unknown
  RNA secondary structure sequence
gtttcgttatcttctgatcc

SEQ ID NO: 25817 - DNA, 20 bp, Unknown
  RNA secondary structure sequence
atccggggtaactacagtgg

SEQ ID NO: 25818 - DNA, 20 bp, Unknown
  RNA secondary structure sequence
cgcgcgcaaatcccggcgac

SEQ ID NO: 25819 - DNA, 20 bp, Unknown
  RNA secondary structure sequence
agacattgatttttctcccc

SEQ ID NO: 25820 - DNA, 20 bp, Unknown
  RNA secondary structure sequence
cccagccctgtcgccccccg

SEQ ID NO: 25821 - DNA, 20 bp, Unknown
  RNA secondary structure sequence
aggcgcacgcgcccagcacc

SEQ ID NO: 25822 - DNA, 20 bp, Unknown
  RNA secondary structure sequence
tgatatatttcaatccattg

SEQ ID NO: 25823 - DNA, 20 bp, Unknown
  RNA secondary structure sequence
gctcactttgccagtaagag

SEQ ID NO: 25824 - DNA, 20 bp, Unknown
  RNA secondary structure sequence
atttctctaaggaccctgat

SEQ ID NO: 25825 - DNA, 20 bp, Unknown
  RNA secondary structure sequence
tattttagggccgattcttt

SEQ ID NO: 25826 - DNA, 20 bp, Unknown
  RNA secondary structure sequence
gattggcagccagactgcct

SEQ ID NO: 25827 - DNA, 20 bp, Unknown
  RNA secondary structure sequence
tgagtcaggaaacattttca

SEQ ID NO: 25828 - DNA, 20 bp, Unknown
  RNA secondary structure sequence
aaagccaactttggaaaaag

SEQ ID NO: 25829 - DNA, 20 bp, Unknown
  RNA secondary structure sequence
aaaagctaagccggcgggca

SEQ ID NO: 25830 - DNA, 20 bp, Unknown
  RNA secondary structure sequence
acgaaccatcgactgccgtg

SEQ ID NO: 25831 - DNA, 20 bp, Unknown
  RNA secondary structure sequence
tgggcgcccccacaccggta

SEQ ID NO: 25832 - DNA, 20 bp, Unknown
  RNA secondary structure sequence
ccggccgtggatgctcactc

SEQ ID NO: 25833 - DNA, 20 bp, Unknown
  RNA secondary structure sequence
ggagtcggtggcagcggcgg

SEQ ID NO: 25834 - DNA, 20 bp, Unknown
  RNA secondary structure sequence
cgagccgctcaccccgccgt

SEQ ID NO: 25835 - DNA, 20 bp, Unknown
  RNA secondary structure sequence
tcggccttccgcgccagccg

SEQ ID NO: 25836 - DNA, 20 bp, Unknown
  RNA secondary structure sequence
aagccagccactggagtcgc

SEQ ID NO: 25837 - DNA, 20 bp, Unknown
  RNA secondary structure sequence
ggacctgctgtccgacttac

SEQ ID NO: 25838 - DNA, 20 bp, Unknown
  RNA secondary structure sequence
aggaggaagaggaggaggag

SEQ ID NO: 25839 - DNA, 20 bp, Unknown
  RNA secondary structure sequence
gttttattctgcctgcttaa

SEQ ID NO: 25840 - DNA, 20 bp, Unknown
  RNA secondary structure sequence
agtatttagaattagaatgt

SEQ ID NO: 25841 - DNA, 20 bp, Unknown
  RNA secondary structure sequence
tcatcaaacttctccgtcag

SEQ ID NO: 25842 - DNA, 20 bp, Unknown
  RNA secondary structure sequence
gagtgccaccggggaagctt

SEQ ID NO: 25843 - DNA, 20 bp, Unknown
  RNA secondary structure sequence
ggaaaccgtgtgataagaac

SEQ ID NO: 25844 - DNA, 20 bp, Unknown
  RNA secondary structure sequence
gatgctgaatctctttgtcg

SEQ ID NO: 25845 - DNA, 20 bp, Unknown
  RNA secondary structure sequence
gtctgggccgagtatgaccc

SEQ ID NO: 25846 - DNA, 20 bp, Unknown
  RNA secondary structure sequence
catgtatcagatgctgagac

SEQ ID NO: 25847 - DNA, 20 bp, Unknown
  RNA secondary structure sequence
ccgcacagccctggacatca

SEQ ID NO: 25848 - DNA, 20 bp, Unknown
  RNA secondary structure sequence
cgtctcactccgctcgcgga

SEQ ID NO: 25849 - DNA, 20 bp, Unknown
  RNA secondary structure sequence
agcgaggggtgtgtgccatc

SEQ ID NO: 25850 - DNA, 20 bp, Unknown
  RNA secondary structure sequence
gggtgaagcggcgactggag

SEQ ID NO: 25851 - DNA, 20 bp, Unknown
  RNA secondary structure sequence
gacgccgcttggagatcccg

SEQ ID NO: 25852 - DNA, 20 bp, Unknown
  RNA secondary structure sequence
cagctagcaggtgtgagcgg

SEQ ID NO: 25853 - DNA, 20 bp, Unknown
  RNA secondary structure sequence
acgaggactctgcaataccc

SEQ ID NO: 25854 - DNA, 20 bp, Unknown
  RNA secondary structure sequence
gttccgtggatatttgggat

SEQ ID NO: 25855 - DNA, 20 bp, Unknown
  RNA secondary structure sequence
tttatttttcgcacttgctg

SEQ ID NO: 25856 - DNA, 20 bp, Unknown
  RNA secondary structure sequence
tgagtttgcctctgctggaa

SEQ ID NO: 25857 - DNA, 20 bp, Unknown
  RNA secondary structure sequence
gcaatggctgggcatatttt

SEQ ID NO: 25858 - DNA, 20 bp, Unknown
  RNA secondary structure sequence
ttttctaggcacaacttctg

SEQ ID NO: 25859 - DNA, 20 bp, Unknown
  RNA secondary structure sequence
gtggcgtcatcaccggacag

SEQ ID NO: 25860 - DNA, 20 bp, Unknown
  RNA secondary structure sequence
tgtttgaggaacactaggct

SEQ ID NO: 25861 - DNA, 20 bp, Unknown
  RNA secondary structure sequence
aacgccgagtctctgagaag

SEQ ID NO: 25862 - DNA, 20 bp, Unknown
  RNA secondary structure sequence
aatatcccacgtcttctaag

SEQ ID NO: 25863 - DNA, 20 bp, Unknown
  RNA secondary structure sequence
tgtgggcccaacgtgaggag

SEQ ID NO: 25864 - DNA, 20 bp, Unknown
  RNA secondary structure sequence
gtgcccctggctgggcaaaa

SEQ ID NO: 25865 - DNA, 20 bp, Unknown
  RNA secondary structure sequence
cactgccctcgaacgcctca

SEQ ID NO: 25866 - DNA, 20 bp, Unknown
  RNA secondary structure sequence
gagcgcgaggccggagggct

SEQ ID NO: 25867 - DNA, 20 bp, Unknown
  RNA secondary structure sequence
tccaccgggtatgaagctaa

SEQ ID NO: 25868 - DNA, 20 bp, Unknown
  RNA secondary structure sequence
cctccaccagggctgaggga

SEQ ID NO: 25869 - DNA, 20 bp, Unknown
  RNA secondary structure sequence
gaggccatggtgacctgaga

SEQ ID NO: 25870 - DNA, 20 bp, Unknown
  RNA secondary structure sequence
ctccttctgcctcccctctc

SEQ ID NO: 25871 - DNA, 20 bp, Unknown
  RNA secondary structure sequence
tggcagaagcagacaggagc

SEQ ID NO: 25872 - DNA, 20 bp, Unknown
  RNA secondary structure sequence
tccagctggctgcttgtttt

SEQ ID NO: 25873 - DNA, 20 bp, Unknown
  RNA secondary structure sequence
gctgacggggcggcggcggg

SEQ ID NO: 25874 - DNA, 20 bp, Unknown
  RNA secondary structure sequence
ggcggcttctccatgggtcc

SEQ ID NO: 25875 - DNA, 20 bp, Unknown
  RNA secondary structure sequence
gccgggcgcgggatttctcc

SEQ ID NO: 25876 - DNA, 20 bp, Unknown
  RNA secondary structure sequence
attcctgcagagggaaaact

SEQ ID NO: 25877 - DNA, 20 bp, Unknown
  RNA secondary structure sequence
cccctttggatcttgtcggg

SEQ ID NO: 25878 - DNA, 20 bp, Unknown
  RNA secondary structure sequence
taaaataaattcctaaagtc

SEQ ID NO: 25879 - DNA, 20 bp, Unknown
  RNA secondary structure sequence
tcaggacgagggccacacca

SEQ ID NO: 25880 - DNA, 20 bp, Unknown
  RNA secondary structure sequence
aatgacatggaaaattcgcc

SEQ ID NO: 25881 - DNA, 20 bp, Unknown
  RNA secondary structure sequence
caaagcacaaaattaatttc

SEQ ID NO: 25882 - DNA, 20 bp, Unknown
  RNA secondary structure sequence
ggacggtctgcggcaaattg

SEQ ID NO: 25883 - DNA, 20 bp, Unknown
  RNA secondary structure sequence
ggagatacggatacctctgg

SEQ ID NO: 25884 - DNA, 20 bp, Unknown
  RNA secondary structure sequence
cgtttgcaaaatctcaaaag

SEQ ID NO: 25885 - DNA, 20 bp, Unknown
  RNA secondary structure sequence
ggagacgagattttctacca

SEQ ID NO: 25886 - DNA, 20 bp, Unknown
  RNA secondary structure sequence
gaaaagtagctaaaagcacg

SEQ ID NO: 25887 - DNA, 20 bp, Unknown
  RNA secondary structure sequence
tagctaaaagcacgcggaca

SEQ ID NO: 25888 - DNA, 20 bp, Unknown
  RNA secondary structure sequence
agtccgcgctgcgagcataa

SEQ ID NO: 25889 - DNA, 20 bp, Unknown
  RNA secondary structure sequence
tgaacatatttcaagggact

SEQ ID NO: 25890 - DNA, 20 bp, Unknown
  RNA secondary structure sequence
aacgacaacaacagcaacga

SEQ ID NO: 25891 - DNA, 20 bp, Unknown
  RNA secondary structure sequence
agtagcagcaccagctaccc

SEQ ID NO: 25892 - DNA, 20 bp, Unknown
  RNA secondary structure sequence
actttacacttaataatata

SEQ ID NO: 25893 - DNA, 20 bp, Unknown
  RNA secondary structure sequence
tgtcacacagtaaacggcgc

SEQ ID NO: 25894 - DNA, 20 bp, Unknown
  RNA secondary structure sequence
ctttgttttattatccacat

SEQ ID NO: 25895 - DNA, 20 bp, Unknown
  RNA secondary structure sequence
tcagcgctttaccgctcgcc

SEQ ID NO: 25896 - DNA, 20 bp, Unknown
  RNA secondary structure sequence
aacactcaaataaaatccgc

SEQ ID NO: 25897 - DNA, 20 bp, Unknown
  RNA secondary structure sequence
cccctcccccaactgtaact

SEQ ID NO: 25898 - DNA, 20 bp, Unknown
  RNA secondary structure sequence
agtatcaatagactgctcac

SEQ ID NO: 25899 - DNA, 20 bp, Unknown
  RNA secondary structure sequence
cacgggcgaccgtggcggtg

SEQ ID NO: 25900 - DNA, 20 bp, Unknown
  RNA secondary structure sequence
tggtagtcctccggcccctg

SEQ ID NO: 25901 - DNA, 20 bp, Unknown
  RNA secondary structure sequence
catattgccgtcttttggca

SEQ ID NO: 25902 - DNA, 20 bp, Unknown
  RNA secondary structure sequence
tcttgacgagcattcctagg

SEQ ID NO: 25903 - DNA, 20 bp, Unknown
  RNA secondary structure sequence
gcgacaggtgcctctgcggc

SEQ ID NO: 25904 - DNA, 20 bp, Unknown
  RNA secondary structure sequence
gagtatcaataggctgctcg

SEQ ID NO: 25905 - DNA, 20 bp, Unknown
  RNA secondary structure sequence
tcgctcagcacaaccccagt

SEQ ID NO: 25906 - DNA, 20 bp, Unknown
  RNA secondary structure sequence
tgctcacaaaccagtgggtg

SEQ ID NO: 25907 - DNA, 20 bp, Unknown
  RNA secondary structure sequence
ggctccacgctcgatccact

SEQ ID NO: 25908 - DNA, 20 bp, Unknown
  RNA secondary structure sequence
gaccggccgggtggaaggcc

SEQ ID NO: 25909 - DNA, 20 bp, Unknown
  RNA secondary structure sequence
gaaggggtacgtctatgggt

SEQ ID NO: 25910 - DNA, 20 bp, Unknown
  RNA secondary structure sequence
agtgttagggttcgtaggtg

SEQ ID NO: 25911 - DNA, 20 bp, Unknown
  RNA secondary structure sequence
tttggacacggtccacaggt

SEQ ID NO: 25912 - DNA, 20 bp, Unknown
  RNA secondary structure sequence
tgaagcgtcagtcgttaaac

SEQ ID NO: 25913 - DNA, 20 bp, Unknown
  RNA secondary structure sequence
ctcttgagactggccgaaag

SEQ ID NO: 25914 - DNA, 20 bp, Unknown
  RNA secondary structure sequence
gctgcatgcggcaaggggaa

SEQ ID NO: 25915 - DNA, 20 bp, Unknown
  RNA secondary structure sequence
gacgtaatggccccggcccg

SEQ ID NO: 25916 - DNA, 20 bp, Unknown
  RNA secondary structure sequence
aaaagcgcacggtccacagg

SEQ ID NO: 25917 - DNA, 20 bp, Unknown
  RNA secondary structure sequence
gtagccggcgagttgacaag

SEQ ID NO: 25918 - DNA, 20 bp, Unknown
  RNA secondary structure sequence
cagctccgcggcggcctaca

SEQ ID NO: 25919 - DNA, 20 bp, Unknown
  RNA secondary structure sequence
ggcgggtggcattttctttt

SEQ ID NO: 25920 - DNA, 20 bp, Unknown
  RNA secondary structure sequence
caccttgcagtgttaacttg

SEQ ID NO: 25921 - DNA, 20 bp, Unknown
  RNA secondary structure sequence
agggcaaacatcatttggcc

SEQ ID NO: 25922 - DNA, 20 bp, Unknown
  RNA secondary structure sequence
tcctttcttggataaacccg

SEQ ID NO: 25923 - DNA, 20 bp, Unknown
  RNA secondary structure sequence
gcaagactgctagccgagta

SEQ ID NO: 25924 - DNA, 20 bp, Unknown
  RNA secondary structure sequence
agggacctgaaagcgaaagg

SEQ ID NO: 25925 - DNA, 20 bp, Unknown
  RNA secondary structure sequence
tgtaacttagaagtttttca

SEQ ID NO: 25926 - DNA, 20 bp, Unknown
  RNA secondary structure sequence
tactgaaggtcaagcacttc

SEQ ID NO: 25927 - DNA, 20 bp, Unknown
  RNA secondary structure sequence
acagggcaaaaacaactgcg

SEQ ID NO: 25928 - DNA, 20 bp, Unknown
  RNA secondary structure sequence
ttagtagcatctttgaaatc

SEQ ID NO: 25929 - DNA, 20 bp, Unknown
  RNA secondary structure sequence
gtggctaaccttaaccctgc

SEQ ID NO: 25930 - DNA, 20 bp, Unknown
  RNA secondary structure sequence
gcggctaatcccaacctcgg

SEQ ID NO: 25931 - DNA, 20 bp, Unknown
  RNA secondary structure sequence
cgcatagactgttcccacgg

SEQ ID NO: 25932 - DNA, 20 bp, Unknown
  RNA secondary structure sequence
gtacttcgagaagcctagta

SEQ ID NO: 25933 - DNA, 20 bp, Unknown
  RNA secondary structure sequence
actggcgacagtggtccagg

SEQ ID NO: 25934 - DNA, 20 bp, Unknown
  RNA secondary structure sequence
gagagtcctccggcccctga

SEQ ID NO: 25935 - DNA, 20 bp, Unknown
  RNA secondary structure sequence
gctgcaacccagcagccagc

SEQ ID NO: 25936 - DNA, 20 bp, Unknown
  RNA secondary structure sequence
attcgaatctgtaataaaag

SEQ ID NO: 25937 - DNA, 20 bp, Unknown
  RNA secondary structure sequence
gagaggagattttgttcgtg

SEQ ID NO: 25938 - DNA, 20 bp, Unknown
  RNA secondary structure sequence
atccggactgaatccgtagt

SEQ ID NO: 25939 - DNA, 20 bp, Unknown
  RNA secondary structure sequence
ccctggtctgagctctgtgg

SEQ ID NO: 25940 - DNA, 20 bp, Unknown
  RNA secondary structure sequence
cggtgatactataagtcgtg

SEQ ID NO: 25941 - DNA, 20 bp, Unknown
  RNA secondary structure sequence
cgtcacttgtcgacagcgcc

SEQ ID NO: 25942 - DNA, 20 bp, Unknown
  RNA secondary structure sequence
tatatgcattcccgcatggc

SEQ ID NO: 25943 - DNA, 20 bp, Unknown
  RNA secondary structure sequence
ggtatgcgtcatcatttgcc

SEQ ID NO: 25944 - DNA, 20 bp, Unknown
  RNA secondary structure sequence
cgtgccgaaaatccctttgc

SEQ ID NO: 25945 - DNA, 20 bp, Unknown
  RNA secondary structure sequence
gcacatcttaacctgagcgg

SEQ ID NO: 25946 - DNA, 20 bp, Unknown
  RNA secondary structure sequence
gtggcgagctccctgggtgg

SEQ ID NO: 25947 - DNA, 20 bp, Unknown
  RNA secondary structure sequence
ttcaggctttagcgcgccct

SEQ ID NO: 25948 - DNA, 20 bp, Unknown
  RNA secondary structure sequence
tgctctggatggtgtcacca

SEQ ID NO: 25949 - DNA, 20 bp, Unknown
  RNA secondary structure sequence
gcgacacgcctgtggtagcg

SEQ ID NO: 25950 - DNA, 20 bp, Unknown
  RNA secondary structure sequence
gcaggaaccccacctgccag

SEQ ID NO: 25951 - DNA, 20 bp, Unknown
  RNA secondary structure sequence
caagctggttacagccctga

SEQ ID NO: 25952 - DNA, 20 bp, Unknown
  RNA secondary structure sequence
cagggtcaaaaattgtctaa

SEQ ID NO: 25953 - DNA, 20 bp, Unknown
  RNA secondary structure sequence
gagcgtttcttttccttttg

SEQ ID NO: 25954 - DNA, 20 bp, Unknown
  RNA secondary structure sequence
cgtttgccaatcggagggcg

SEQ ID NO: 25955 - DNA, 20 bp, Unknown
  RNA secondary structure sequence
cgttccactttagcaggggt

SEQ ID NO: 25956 - DNA, 20 bp, Unknown
  RNA secondary structure sequence
ctagccgtcgcgtcttaacg

SEQ ID NO: 25957 - DNA, 20 bp, Unknown
  RNA secondary structure sequence
gtttacagcacctctcacat

SEQ ID NO: 25958 - DNA, 20 bp, Unknown
  RNA secondary structure sequence
tagtagtatggcttagtacg

SEQ ID NO: 25959 - DNA, 20 bp, Unknown
  RNA secondary structure sequence
ccttgttctgaatgcacaca

SEQ ID NO: 25960 - DNA, 20 bp, Unknown
  RNA secondary structure sequence
cccgcacgtaaccttcagag

SEQ ID NO: 25961 - DNA, 20 bp, Unknown
  RNA secondary structure sequence
aggagaccgtggtgcactgc

SEQ ID NO: 25962 - DNA, 20 bp, Unknown
  RNA secondary structure sequence
ggcctctcacgccatccagg

SEQ ID NO: 25963 - DNA, 20 bp, Unknown
  RNA secondary structure sequence
tccaggggaccttgtcctac

SEQ ID NO: 25964 - DNA, 20 bp, Unknown
  RNA secondary structure sequence
ggtactgcgatagtgccacc

SEQ ID NO: 25965 - DNA, 20 bp, Unknown
  RNA secondary structure sequence
ctgactaatcagaggaacgt

SEQ ID NO: 25966 - DNA, 20 bp, Unknown
  RNA secondary structure sequence
agataagttagaatccaaat

SEQ ID NO: 25967 - DNA, 20 bp, Unknown
  RNA secondary structure sequence
gattatgtgatgctttctgc

SEQ ID NO: 25968 - DNA, 20 bp, Unknown
  RNA secondary structure sequence
aaaccttcttcctttttcct

SEQ ID NO: 25969 - DNA, 20 bp, Unknown
  RNA secondary structure sequence
ggaatatgacagggttattt

SEQ ID NO: 25970 - DNA, 20 bp, Unknown
  RNA secondary structure sequence
tatactgtggaagggtatgt

SEQ ID NO: 25971 - DNA, 20 bp, Unknown
  RNA secondary structure sequence
tgcggccaaaagccacgtgg

SEQ ID NO: 25972 - DNA, 20 bp, Unknown
  RNA secondary structure sequence
ctcaagcgcctctgtaggga

SEQ ID NO: 25973 - DNA, 20 bp, Unknown
  RNA secondary structure sequence
gggaagccaagaatgtccag

SEQ ID NO: 25974 - DNA, 20 bp, Unknown
  RNA secondary structure sequence
gattgggaacacttggagga

SEQ ID NO: 25975 - DNA, 20 bp, Unknown
  RNA secondary structure sequence
ttcgttgaacaattgtgcgt

SEQ ID NO: 25976 - DNA, 20 bp, Unknown
  RNA secondary structure sequence
aacaattgtgcgtattacac

SEQ ID NO: 25977 - DNA, 20 bp, Unknown
  RNA secondary structure sequence
aaaaattagcttaatgcatt

SEQ ID NO: 25978 - DNA, 20 bp, Unknown
  RNA secondary structure sequence
tggacttagacttgctctat

SEQ ID NO: 25979 - DNA, 20 bp, Unknown
  RNA secondary structure sequence
cagtaggacataccccaaat

SEQ ID NO: 25980 - DNA, 20 bp, Unknown
  RNA secondary structure sequence
ccacaaggctagtgataata

SEQ ID NO: 25981 - DNA, 20 bp, Unknown
  RNA secondary structure sequence
ctctagacctactggaaata

SEQ ID NO: 25982 - DNA, 20 bp, Unknown
  RNA secondary structure sequence
acattaagagagagagtatt

SEQ ID NO: 25983 - DNA, 20 bp, Unknown
  RNA secondary structure sequence
actctggtgtaaggcttaga

SEQ ID NO: 25984 - DNA, 20 bp, Unknown
  RNA secondary structure sequence
tttaaattttttaattccga

SEQ ID NO: 25985 - DNA, 20 bp, Unknown
  RNA secondary structure sequence
taaacttgaatgtaaggctt

SEQ ID NO: 25986 - DNA, 20 bp, Unknown
  RNA secondary structure sequence
tggtttaattgagcgcattt

SEQ ID NO: 25987 - DNA, 20 bp, Unknown
  RNA secondary structure sequence
aataagggagtgtcctattt

SEQ ID NO: 25988 - DNA, 20 bp, Unknown
  RNA secondary structure sequence
acttatgtattgatgagagc

SEQ ID NO: 25989 - DNA, 20 bp, Unknown
  RNA secondary structure sequence
tggaagacaatgatctgggg

SEQ ID NO: 25990 - DNA, 20 bp, Unknown
  RNA secondary structure sequence
tggtttgctatttagcgtac

SEQ ID NO: 25991 - DNA, 20 bp, Unknown
  RNA secondary structure sequence
cataggcagccccaaaaaca

SEQ ID NO: 25992 - DNA, 20 bp, Unknown
  RNA secondary structure sequence
tagtcaagttcgaccgtctt

SEQ ID NO: 25993 - DNA, 20 bp, Unknown
  RNA secondary structure sequence
cgaccgtcttctcagcgctc

SEQ ID NO: 25994 - DNA, 20 bp, Unknown
  RNA secondary structure sequence
ctcagcgctccgccagggcc

SEQ ID NO: 25995 - DNA, 20 bp, Unknown
  RNA secondary structure sequence
cgccagggccgtgggccgac

SEQ ID NO: 25996 - DNA, 20 bp, Unknown
  RNA secondary structure sequence
gtgggccgaccccggcgggg

SEQ ID NO: 25997 - DNA, 20 bp, Unknown
  RNA secondary structure sequence
cccggcggggccgatccgag

SEQ ID NO: 25998 - DNA, 20 bp, Unknown
  RNA secondary structure sequence
tcggtagtagcgacgggcgg

SEQ ID NO: 25999 - DNA, 20 bp, Unknown
  RNA secondary structure sequence
tgtgtacaaagggcagggac

SEQ ID NO: 26000 - DNA, 20 bp, Unknown
  RNA secondary structure sequence
gggcagggacttaatcaacg

SEQ ID NO: 26001 - DNA, 20 bp, Unknown
  RNA secondary structure sequence
caagcttatgacccgcactt

SEQ ID NO: 26002 - DNA, 20 bp, Unknown
  RNA secondary structure sequence
actgggaattcctcgttcat

SEQ ID NO: 26003 - DNA, 20 bp, Unknown
  RNA secondary structure sequence
ggggaataattgcaatcccc

SEQ ID NO: 26004 - DNA, 20 bp, Unknown
  RNA secondary structure sequence
gatccccatcacgaatgggg

SEQ ID NO: 26005 - DNA, 20 bp, Unknown
  RNA secondary structure sequence
agtcagtgtagcgcgcgtgc

SEQ ID NO: 26006 - DNA, 20 bp, Unknown
  RNA secondary structure sequence
agccccggacatctaagggc

SEQ ID NO: 26007 - DNA, 20 bp, Unknown
  RNA secondary structure sequence
atctaagggcatcacagacc

SEQ ID NO: 26008 - DNA, 20 bp, Unknown
  RNA secondary structure sequence
caatctcgggtggctgaacg

SEQ ID NO: 26009 - DNA, 20 bp, Unknown
  RNA secondary structure sequence
ccacttgtccctctaagaag

SEQ ID NO: 26010 - DNA, 20 bp, Unknown
  RNA secondary structure sequence
ctctaagaagttgggggacg

SEQ ID NO: 26011 - DNA, 20 bp, Unknown
  RNA secondary structure sequence
ttgggggacgccgaccgctc

SEQ ID NO: 26012 - DNA, 20 bp, Unknown
  RNA secondary structure sequence
ccaactaagaacggccatgc

SEQ ID NO: 26013 - DNA, 20 bp, Unknown
  RNA secondary structure sequence
accaccacccacggaatcga

SEQ ID NO: 26014 - DNA, 20 bp, Unknown
  RNA secondary structure sequence
tcaatctgtcaatcctgtcc

SEQ ID NO: 26015 - DNA, 20 bp, Unknown
  RNA secondary structure sequence
cgggtgaggtttcccgtgtt

SEQ ID NO: 26016 - DNA, 20 bp, Unknown
  RNA secondary structure sequence
ttcccgtgttgagtcaaatt

SEQ ID NO: 26017 - DNA, 20 bp, Unknown
  RNA secondary structure sequence
gagtcaaattaagccgcagg

SEQ ID NO: 26018 - DNA, 20 bp, Unknown
  RNA secondary structure sequence
aagccgcaggctccactcct

SEQ ID NO: 26019 - DNA, 20 bp, Unknown
  RNA secondary structure sequence
ttcagctttgcaaccatact

SEQ ID NO: 26020 - DNA, 20 bp, Unknown
  RNA secondary structure sequence
ttggtttcccggaagctgcc

SEQ ID NO: 26021 - DNA, 20 bp, Unknown
  RNA secondary structure sequence
ggaagctgcccggcgggtca

SEQ ID NO: 26022 - DNA, 20 bp, Unknown
  RNA secondary structure sequence
gccgccgcatcgccggtcgg

SEQ ID NO: 26023 - DNA, 20 bp, Unknown
  RNA secondary structure sequence
cgccggtcggcatcgtttat

SEQ ID NO: 26024 - DNA, 20 bp, Unknown
  RNA secondary structure sequence
catcgtttatggtcggaact

SEQ ID NO: 26025 - DNA, 20 bp, Unknown
  RNA secondary structure sequence
acgacggtatctgatcgtct

SEQ ID NO: 26026 - DNA, 20 bp, Unknown
  RNA secondary structure sequence
ctgatcgtcttcgaacctcc

SEQ ID NO: 26027 - DNA, 20 bp, Unknown
  RNA secondary structure sequence
gactttcgttcttgattaat

SEQ ID NO: 26028 - DNA, 20 bp, Unknown
  RNA secondary structure sequence
cttgattaatgaaaacattc

SEQ ID NO: 26029 - DNA, 20 bp, Unknown
  RNA secondary structure sequence
gaaaacattcttggcaaatg

SEQ ID NO: 26030 - DNA, 20 bp, Unknown
  RNA secondary structure sequence
ttggcaaatgctttcgctct

SEQ ID NO: 26031 - DNA, 20 bp, Unknown
  RNA secondary structure sequence
gcgccggtccaagaatttca

SEQ ID NO: 26032 - DNA, 20 bp, Unknown
  RNA secondary structure sequence
aagaatttcacctctagcgg

SEQ ID NO: 26033 - DNA, 20 bp, Unknown
  RNA secondary structure sequence
cgcaatacgaatgcccccgg

SEQ ID NO: 26034 - DNA, 20 bp, Unknown
  RNA secondary structure sequence
atgcccccggccgtccctct

SEQ ID NO: 26035 - DNA, 20 bp, Unknown
  RNA secondary structure sequence
ctcagttccgaaaaccaaca

SEQ ID NO: 26036 - DNA, 20 bp, Unknown
  RNA secondary structure sequence
aaatagaaccgcggtcctat

SEQ ID NO: 26037 - DNA, 20 bp, Unknown
  RNA secondary structure sequence
gcggtcctattccattattc

SEQ ID NO: 26038 - DNA, 20 bp, Unknown
  RNA secondary structure sequence
tccattattcctagctgcgg

SEQ ID NO: 26039 - DNA, 20 bp, Unknown
  RNA secondary structure sequence
ctctaattttttcaaagtaa

SEQ ID NO: 26040 - DNA, 20 bp, Unknown
  RNA secondary structure sequence
agagcatcgagggggcgccg

SEQ ID NO: 26041 - DNA, 20 bp, Unknown
  RNA secondary structure sequence
ggcggggacgggcggtggct

SEQ ID NO: 26042 - DNA, 20 bp, Unknown
  RNA secondary structure sequence
ggcggtggctcgcctcgcgg

SEQ ID NO: 26043 - DNA, 20 bp, Unknown
  RNA secondary structure sequence
cgcctcgcgggggaccgccc

SEQ ID NO: 26044 - DNA, 20 bp, Unknown
  RNA secondary structure sequence
gggaccgcccgcccgctccc

SEQ ID NO: 26045 - DNA, 20 bp, Unknown
  RNA secondary structure sequence
ggagctggaattaccgcggc

SEQ ID NO: 26046 - DNA, 20 bp, Unknown
  RNA secondary structure sequence
agacttgccctccaatggat

SEQ ID NO: 26047 - DNA, 20 bp, Unknown
  RNA secondary structure sequence
tccaatggatcctcgttaaa

SEQ ID NO: 26048 - DNA, 20 bp, Unknown
  RNA secondary structure sequence
tggactcattccaattacag

SEQ ID NO: 26049 - DNA, 20 bp, Unknown
  RNA secondary structure sequence
ccaattacagggcctcgaaa

SEQ ID NO: 26050 - DNA, 20 bp, Unknown
  RNA secondary structure sequence
ctccccgggtcgggagtggg

SEQ ID NO: 26051 - DNA, 20 bp, Unknown
  RNA secondary structure sequence
gcctgctgccttccttggat

SEQ ID NO: 26052 - DNA, 20 bp, Unknown
  RNA secondary structure sequence
ctgattccccgtcacccgtg

SEQ ID NO: 26053 - DNA, 20 bp, Unknown
  RNA secondary structure sequence
taggcacggcgactaccatc

SEQ ID NO: 26054 - DNA, 20 bp, Unknown
  RNA secondary structure sequence
gactaccatcgaaagttgat

SEQ ID NO: 26055 - DNA, 20 bp, Unknown
  RNA secondary structure sequence
agggcagacgttcgaatggg

SEQ ID NO: 26056 - DNA, 20 bp, Unknown
  RNA secondary structure sequence
ccaaagccgccggcgcccgc

SEQ ID NO: 26057 - DNA, 20 bp, Unknown
  RNA secondary structure sequence
cccccggccggggccggaga

SEQ ID NO: 26058 - DNA, 20 bp, Unknown
  RNA secondary structure sequence
tcccccccgcgaagggggtc

SEQ ID NO: 26059 - DNA, 20 bp, Unknown
  RNA secondary structure sequence
agctctagaattaccacagt

SEQ ID NO: 26060 - DNA, 20 bp, Unknown
  RNA secondary structure sequence
cgaggccaaccgaggctccg

SEQ ID NO: 26061 - DNA, 20 bp, Unknown
  RNA secondary structure sequence
cgaggctccgcggcgctgcc

SEQ ID NO: 26062 - DNA, 20 bp, Unknown
  RNA secondary structure sequence
cggcgctgccgtatcgttcc

SEQ ID NO: 26063 - DNA, 20 bp, Unknown
  RNA secondary structure sequence
gattctgacttagaggcgtt

SEQ ID NO: 26064 - DNA, 20 bp, Unknown
  RNA secondary structure sequence
tagaggcgttcagtcataat

SEQ ID NO: 26065 - DNA, 20 bp, Unknown
  RNA secondary structure sequence
cagtcataatcccacagatg

SEQ ID NO: 26066 - DNA, 20 bp, Unknown
  RNA secondary structure sequence
cccacagatggtagcttcgc

SEQ ID NO: 26067 - DNA, 20 bp, Unknown
  RNA secondary structure sequence
ctgagcaggattaccatggc

SEQ ID NO: 26068 - DNA, 20 bp, Unknown
  RNA secondary structure sequence
catcagtagggtaaaactaa

SEQ ID NO: 26069 - DNA, 20 bp, Unknown
  RNA secondary structure sequence
cgttccctattagtgggtga

SEQ ID NO: 26070 - DNA, 20 bp, Unknown
  RNA secondary structure sequence
caatgataggaagagccgac

SEQ ID NO: 26071 - DNA, 20 bp, Unknown
  RNA secondary structure sequence
atcgaaggatcaaaaagcga

SEQ ID NO: 26072 - DNA, 20 bp, Unknown
  RNA secondary structure sequence
cgtcgctatgaacgcttggc

SEQ ID NO: 26073 - DNA, 20 bp, Unknown
  RNA secondary structure sequence
tgtggtaacttttctgacac

SEQ ID NO: 26074 - DNA, 20 bp, Unknown
  RNA secondary structure sequence
aaacccaaaaggtcagaagg

SEQ ID NO: 26075 - DNA, 20 bp, Unknown
  RNA secondary structure sequence
cccgctttcacggtctgtat

SEQ ID NO: 26076 - DNA, 20 bp, Unknown
  RNA secondary structure sequence
tcgtactgaaaatcaagatc

SEQ ID NO: 26077 - DNA, 20 bp, Unknown
  RNA secondary structure sequence
aatcaagatcaagcgagctt

SEQ ID NO: 26078 - DNA, 20 bp, Unknown
  RNA secondary structure sequence
aagcgagcttttgcccttct

SEQ ID NO: 26079 - DNA, 20 bp, Unknown
  RNA secondary structure sequence
ttgcccttctgctccacggg

SEQ ID NO: 26080 - DNA, 20 bp, Unknown
  RNA secondary structure sequence
tacacctctcatgtctcttc

SEQ ID NO: 26081 - DNA, 20 bp, Unknown
  RNA secondary structure sequence
atgtctcttcaccgtgccag

SEQ ID NO: 26082 - DNA, 20 bp, Unknown
  RNA secondary structure sequence
accgtgccagactagagtca

SEQ ID NO: 26083 - DNA, 20 bp, Unknown
  RNA secondary structure sequence
actagagtcaagctcaacag

SEQ ID NO: 26084 - DNA, 20 bp, Unknown
  RNA secondary structure sequence
agctcaacagggtcttcttt

SEQ ID NO: 26085 - DNA, 20 bp, Unknown
  RNA secondary structure sequence
ggtcttctttccccgctgat

SEQ ID NO: 26086 - DNA, 20 bp, Unknown
  RNA secondary structure sequence
ccccgctgattccgccaagc

SEQ ID NO: 26087 - DNA, 20 bp, Unknown
  RNA secondary structure sequence
ccgttcccttggctgtggtt

SEQ ID NO: 26088 - DNA, 20 bp, Unknown
  RNA secondary structure sequence
tcgctggatagtaggtaggg

SEQ ID NO: 26089 - DNA, 20 bp, Unknown
  RNA secondary structure sequence
acagtgggaatctcgttcat

SEQ ID NO: 26090 - DNA, 20 bp, Unknown
  RNA secondary structure sequence
tctcgttcatccattcatgc

SEQ ID NO: 26091 - DNA, 20 bp, Unknown
  RNA secondary structure sequence
ccattcatgcgcgtcactaa

SEQ ID NO: 26092 - DNA, 20 bp, Unknown
  RNA secondary structure sequence
gcgtcactaattagatgacg

SEQ ID NO: 26093 - DNA, 20 bp, Unknown
  RNA secondary structure sequence
agagtcatagttactcccgc

SEQ ID NO: 26094 - DNA, 20 bp, Unknown
  RNA secondary structure sequence
cgcttcattgaatttcttca

SEQ ID NO: 26095 - DNA, 20 bp, Unknown
  RNA secondary structure sequence
aatttcttcactttgacatt

SEQ ID NO: 26096 - DNA, 20 bp, Unknown
  RNA secondary structure sequence
ctttgacattcagagcactg

SEQ ID NO: 26097 - DNA, 20 bp, Unknown
  RNA secondary structure sequence
cgccccagcccgaccgaccc

SEQ ID NO: 26098 - DNA, 20 bp, Unknown
  RNA secondary structure sequence
cgaccgacccagcccttaga

SEQ ID NO: 26099 - DNA, 20 bp, Unknown
  RNA secondary structure sequence
atcccgaagttacggatccg

SEQ ID NO: 26100 - DNA, 20 bp, Unknown
  RNA secondary structure sequence
tacggatccggcttgccgac

SEQ ID NO: 26101 - DNA, 20 bp, Unknown
  RNA secondary structure sequence
gcttgccgacttcccttacc

SEQ ID NO: 26102 - DNA, 20 bp, Unknown
  RNA secondary structure sequence
accttggagacctgctgcgg

SEQ ID NO: 26103 - DNA, 20 bp, Unknown
  RNA secondary structure sequence
atatgggtacggcccggcgc

SEQ ID NO: 26104 - DNA, 20 bp, Unknown
  RNA secondary structure sequence
gagatttacaccctctcccc

SEQ ID NO: 26105 - DNA, 20 bp, Unknown
  RNA secondary structure sequence
agggccagcgagagctcacc

SEQ ID NO: 26106 - DNA, 20 bp, Unknown
  RNA secondary structure sequence
agagctcaccggacgccgcc

SEQ ID NO: 26107 - DNA, 20 bp, Unknown
  RNA secondary structure sequence
ggacgccgccggaaccgcga

SEQ ID NO: 26108 - DNA, 20 bp, Unknown
  RNA secondary structure sequence
cgctttccaaggcacgggcc

SEQ ID NO: 26109 - DNA, 20 bp, Unknown
  RNA secondary structure sequence
cctctctcggggcgaaccca

SEQ ID NO: 26110 - DNA, 20 bp, Unknown
  RNA secondary structure sequence
ggcgaacccattccagggcg

SEQ ID NO: 26111 - DNA, 20 bp, Unknown
  RNA secondary structure sequence
cacaaagaaaagagaactct

SEQ ID NO: 26112 - DNA, 20 bp, Unknown
  RNA secondary structure sequence
cccgccggcttctccgggat

SEQ ID NO: 26113 - DNA, 20 bp, Unknown
  RNA secondary structure sequence
accgcactggacgcctcgcg

SEQ ID NO: 26114 - DNA, 20 bp, Unknown
  RNA secondary structure sequence
acgcctcgcggcgcccatct

SEQ ID NO: 26115 - DNA, 20 bp, Unknown
  RNA secondary structure sequence
gcgcccatctccgccactcc

SEQ ID NO: 26116 - DNA, 20 bp, Unknown
  RNA secondary structure sequence
ccgccactccggattcgggg

SEQ ID NO: 26117 - DNA, 20 bp, Unknown
  RNA secondary structure sequence
ggaacggcgctcgcccatct

SEQ ID NO: 26118 - DNA, 20 bp, Unknown
  RNA secondary structure sequence
tcgcccatctctcaggaccg

SEQ ID NO: 26119 - DNA, 20 bp, Unknown
  RNA secondary structure sequence
actgacccatgttcaactgc

SEQ ID NO: 26120 - DNA, 20 bp, Unknown
  RNA secondary structure sequence
gttcaactgctgttcacatg

SEQ ID NO: 26121 - DNA, 20 bp, Unknown
  RNA secondary structure sequence
ccacttcggccttcaaagtt

SEQ ID NO: 26122 - DNA, 20 bp, Unknown
  RNA secondary structure sequence
taccaccaagatctgcacct

SEQ ID NO: 26123 - DNA, 20 bp, Unknown
  RNA secondary structure sequence
gcggcggctccacccgggcc

SEQ ID NO: 26124 - DNA, 20 bp, Unknown
  RNA secondary structure sequence
ggccctcctactcgtcgcgg

SEQ ID NO: 26125 - DNA, 20 bp, Unknown
  RNA secondary structure sequence
gccgctcccgtccactctcg

SEQ ID NO: 26126 - DNA, 20 bp, Unknown
  RNA secondary structure sequence
acggccgggtatgggcccga

SEQ ID NO: 26127 - DNA, 20 bp, Unknown
  RNA secondary structure sequence
cgctccagcgccatccattt

SEQ ID NO: 26128 - DNA, 20 bp, Unknown
  RNA secondary structure sequence
ccatccattttcagggctag

SEQ ID NO: 26129 - DNA, 20 bp, Unknown
  RNA secondary structure sequence
tcagggctagttgattcggc

SEQ ID NO: 26130 - DNA, 20 bp, Unknown
  RNA secondary structure sequence
ttacacactccttagcggat

SEQ ID NO: 26131 - DNA, 20 bp, Unknown
  RNA secondary structure sequence
cttagcggattccgacttcc

SEQ ID NO: 26132 - DNA, 20 bp, Unknown
  RNA secondary structure sequence
atggccaccgtcctgctgtc

SEQ ID NO: 26133 - DNA, 20 bp, Unknown
  RNA secondary structure sequence
aacaccttttctggggtctg

SEQ ID NO: 26134 - DNA, 20 bp, Unknown
  RNA secondary structure sequence
ccttaacccggcgttcggtt

SEQ ID NO: 26135 - DNA, 20 bp, Unknown
  RNA secondary structure sequence
gcgttcggttcatcccgcag

SEQ ID NO: 26136 - DNA, 20 bp, Unknown
  RNA secondary structure sequence
catcccgcagcgccagttct

SEQ ID NO: 26137 - DNA, 20 bp, Unknown
  RNA secondary structure sequence
gcttaccaaaagtggcccac

SEQ ID NO: 26138 - DNA, 20 bp, Unknown
  RNA secondary structure sequence
taggcactcgcattccacgc

SEQ ID NO: 26139 - DNA, 20 bp, Unknown
  RNA secondary structure sequence
acccatttaaagtttgagaa

SEQ ID NO: 26140 - DNA, 20 bp, Unknown
  RNA secondary structure sequence
taggttgagatcgtttcggc

SEQ ID NO: 26141 - DNA, 20 bp, Unknown
  RNA secondary structure sequence
tcgtttcggccccaagacct

SEQ ID NO: 26142 - DNA, 20 bp, Unknown
  RNA secondary structure sequence
cccaagacctctaatcattc

SEQ ID NO: 26143 - DNA, 20 bp, Unknown
  RNA secondary structure sequence
ctaatcattcgctttaccgg

SEQ ID NO: 26144 - DNA, 20 bp, Unknown
  RNA secondary structure sequence
gctttaccggataaaactgc

SEQ ID NO: 26145 - DNA, 20 bp, Unknown
  RNA secondary structure sequence
ataaaactgcgtggcggggg

SEQ ID NO: 26146 - DNA, 20 bp, Unknown
  RNA secondary structure sequence
tgcgtcgggtctgcgagagc

SEQ ID NO: 26147 - DNA, 20 bp, Unknown
  RNA secondary structure sequence
ctgcgagagcgccagctatc

SEQ ID NO: 26148 - DNA, 20 bp, Unknown
  RNA secondary structure sequence
gccagctatcctgagggaaa

SEQ ID NO: 26149 - DNA, 20 bp, Unknown
  RNA secondary structure sequence
ctgagggaaacttcggaggg

SEQ ID NO: 26150 - DNA, 20 bp, Unknown
  RNA secondary structure sequence
tcgcccctatacccaggtcg

SEQ ID NO: 26151 - DNA, 20 bp, Unknown
  RNA secondary structure sequence
gacgaccgatttgcacgtca

SEQ ID NO: 26152 - DNA, 20 bp, Unknown
  RNA secondary structure sequence
ggaccgctacggacctccac

SEQ ID NO: 26153 - DNA, 20 bp, Unknown
  RNA secondary structure sequence
cagagtttcctctggcttcg

SEQ ID NO: 26154 - DNA, 20 bp, Unknown
  RNA secondary structure sequence
tctggcttcgccctgcccag

SEQ ID NO: 26155 - DNA, 20 bp, Unknown
  RNA secondary structure sequence
tgctccacctccccggcgcg

SEQ ID NO: 26156 - DNA, 20 bp, Unknown
  RNA secondary structure sequence
tcggccggcgagcgcgccgg

SEQ ID NO: 26157 - DNA, 20 bp, Unknown
  RNA secondary structure sequence
ccttcaccttcattgcgcca

SEQ ID NO: 26158 - DNA, 20 bp, Unknown
  RNA secondary structure sequence
cggcggctttcgtgcgagcc

SEQ ID NO: 26159 - DNA, 20 bp, Unknown
  RNA secondary structure sequence
gcacgtgttagactccttgg

SEQ ID NO: 26160 - DNA, 20 bp, Unknown
  RNA secondary structure sequence
ggtggcccggcccccccacg

SEQ ID NO: 26161 - DNA, 20 bp, Unknown
  RNA secondary structure sequence
tgggcgccgggaggggggag

SEQ ID NO: 26162 - DNA, 20 bp, Unknown
  RNA secondary structure sequence
gcgagtgctgctgccggggg

SEQ ID NO: 26163 - DNA, 20 bp, Unknown
  RNA secondary structure sequence
acgcggggccggggggcgga

SEQ ID NO: 26164 - DNA, 20 bp, Unknown
  RNA secondary structure sequence
ggcgggaaagatccgccggg

SEQ ID NO: 26165 - DNA, 20 bp, Unknown
  RNA secondary structure sequence
gccgccgggttgaatcctcc

SEQ ID NO: 26166 - DNA, 20 bp, Unknown
  RNA secondary structure sequence
acccgtttacctcttaacgg

SEQ ID NO: 26167 - DNA, 20 bp, Unknown
  RNA secondary structure sequence
ctcttaacggtttcacgccc

SEQ ID NO: 26168 - DNA, 20 bp, Unknown
  RNA secondary structure sequence
tcttgaactctctcttcaaa

SEQ ID NO: 26169 - DNA, 20 bp, Unknown
  RNA secondary structure sequence
gttcttttcaactttccctt

SEQ ID NO: 26170 - DNA, 20 bp, Unknown
  RNA secondary structure sequence
actttcccttacggtacttg

SEQ ID NO: 26171 - DNA, 20 bp, Unknown
  RNA secondary structure sequence
acggtacttgttgactatcg

SEQ ID NO: 26172 - DNA, 20 bp, Unknown
  RNA secondary structure sequence
gtttaccacccgctttgggc

SEQ ID NO: 26173 - DNA, 20 bp, Unknown
  RNA secondary structure sequence
cgctttgggctgcattccca

SEQ ID NO: 26174 - DNA, 20 bp, Unknown
  RNA secondary structure sequence
acccgggccccgcgcgccgg

SEQ ID NO: 26175 - DNA, 20 bp, Unknown
  RNA secondary structure sequence
cgcgcgccgggggccgctac

SEQ ID NO: 26176 - DNA, 20 bp, Unknown
  RNA secondary structure sequence
gatcagaaggacttgggccc

SEQ ID NO: 26177 - DNA, 20 bp, Unknown
  RNA secondary structure sequence
cccacgagcggcgccgggga

SEQ ID NO: 26178 - DNA, 20 bp, Unknown
  RNA secondary structure sequence
cgtacgccacatgtcccgcg

SEQ ID NO: 26179 - DNA, 20 bp, Unknown
  RNA secondary structure sequence
atgtcccgcgccccgccgcg

SEQ ID NO: 26180 - DNA, 20 bp, Unknown
  RNA secondary structure sequence
aacattccgcgctaccgagt

SEQ ID NO: 26181 - DNA, 20 bp, Unknown
  RNA secondary structure sequence
tatctcgcttctgttatttt

SEQ ID NO: 26182 - DNA, 20 bp, Unknown
  RNA secondary structure sequence
cctgtgagggctacctgtgc

SEQ ID NO: 26183 - DNA, 20 bp, Unknown
  RNA secondary structure sequence
agtggagtcttgggagcgct

SEQ ID NO: 26184 - DNA, 20 bp, Unknown
  RNA secondary structure sequence
tgcaagagtaccatttgtcg

SEQ ID NO: 26185 - DNA, 20 bp, Unknown
  RNA secondary structure sequence
ttagattcctgaagcttctg

SEQ ID NO: 26186 - DNA, 20 bp, Unknown
  RNA secondary structure sequence
tggattcgccgccgtcctgc

SEQ ID NO: 26187 - DNA, 20 bp, Unknown
  RNA secondary structure sequence
gctgggtcctgtttactccc

SEQ ID NO: 26188 - DNA, 20 bp, Unknown
  RNA secondary structure sequence
ccttgtaagaacacagccag

SEQ ID NO: 26189 - DNA, 20 bp, Unknown
  RNA secondary structure sequence
ctgagtcgcgtggcaggccg

SEQ ID NO: 26190 - DNA, 20 bp, Unknown
  RNA secondary structure sequence
cctctgcccgtgctgctgct

SEQ ID NO: 26191 - DNA, 20 bp, Unknown
  RNA secondary structure sequence
gtcctgggaccacatgggga

SEQ ID NO: 26192 - DNA, 20 bp, Unknown
  RNA secondary structure sequence
agacctgcccccgctcttgc

SEQ ID NO: 26193 - DNA, 20 bp, Unknown
  RNA secondary structure sequence
agtgcctgaggcagagactg

SEQ ID NO: 26194 - DNA, 20 bp, Unknown
  RNA secondary structure sequence
tgaacttccaaccgtatgta

SEQ ID NO: 26195 - DNA, 20 bp, Unknown
  RNA secondary structure sequence
gcaggcccgatttgttgaag

SEQ ID NO: 26196 - DNA, 20 bp, Unknown
  RNA secondary structure sequence
gtgtgtgtgtgtgtgcatgc

SEQ ID NO: 26197 - DNA, 20 bp, Unknown
  RNA secondary structure sequence
tcaatcgggtactccctcca

SEQ ID NO: 26198 - DNA, 20 bp, Unknown
  RNA secondary structure sequence
aacttcctctttcaacaaca

SEQ ID NO: 26199 - DNA, 20 bp, Unknown
  RNA secondary structure sequence
gccatgctgctcttcctcct

SEQ ID NO: 26200 - DNA, 20 bp, Unknown
  RNA secondary structure sequence
gacaaagccacgccttgccc

SEQ ID NO: 26201 - DNA, 20 bp, Unknown
  RNA secondary structure sequence
acccgaaaggccggacctac

SEQ ID NO: 26202 - DNA, 20 bp, Unknown
  RNA secondary structure sequence
gagatccgctgtcccttgag

SEQ ID NO: 26203 - DNA, 20 bp, Unknown
  RNA secondary structure sequence
cctgccccgaactgcccacg

SEQ ID NO: 26204 - DNA, 20 bp, Unknown
  RNA secondary structure sequence
acaaagctcccgctgccatt

SEQ ID NO: 26205 - DNA, 20 bp, Unknown
  RNA secondary structure sequence
agcggctctttcagcattgg

SEQ ID NO: 26206 - DNA, 20 bp, Unknown
  RNA secondary structure sequence
aacagtggagaacctaacgt

SEQ ID NO: 26207 - DNA, 20 bp, Unknown
  RNA secondary structure sequence
gccccgcgcgtcctgcgccg

SEQ ID NO: 26208 - DNA, 20 bp, Unknown
  RNA secondary structure sequence
gatctcttggagacggcgac

SEQ ID NO: 26209 - DNA, 20 bp, Unknown
  RNA secondary structure sequence
tgcccgctccccagacacac

SEQ ID NO: 26210 - DNA, 20 bp, Unknown
  RNA secondary structure sequence
tgtgcctatccctgctgtcc

SEQ ID NO: 26211 - DNA, 20 bp, Unknown
  RNA secondary structure sequence
cacccgggatggagccatgt

SEQ ID NO: 26212 - DNA, 20 bp, Unknown
  RNA secondary structure sequence
cttccagcgaagtctactcc

SEQ ID NO: 26213 - DNA, 20 bp, Unknown
  RNA secondary structure sequence
ggcccagcctctcctctgtc

SEQ ID NO: 26214 - DNA, 20 bp, Unknown
  RNA secondary structure sequence
ttggagacgtagaaccgtta

SEQ ID NO: 26215 - DNA, 20 bp, Unknown
  RNA secondary structure sequence
cggctggcagaagggggtga

SEQ ID NO: 26216 - DNA, 20 bp, Unknown
  RNA secondary structure sequence
gcggcgctgagcgggtcccc

SEQ ID NO: 26217 - DNA, 20 bp, Unknown
  RNA secondary structure sequence
tagagactggacaggggaga

SEQ ID NO: 26218 - DNA, 20 bp, Unknown
  RNA secondary structure sequence
tatcaggttctcataccgga

SEQ ID NO: 26219 - DNA, 20 bp, Unknown
  RNA secondary structure sequence
gactcgcgggtatcggagct

SEQ ID NO: 26220 - DNA, 20 bp, Unknown
  RNA secondary structure sequence
gggagcacaagcgcttccgg

SEQ ID NO: 26221 - DNA, 20 bp, Unknown
  RNA secondary structure sequence
actcactgcacgccatgaac

SEQ ID NO: 26222 - DNA, 20 bp, Unknown
  RNA secondary structure sequence
gtctccgccggcgcccgccc

SEQ ID NO: 26223 - DNA, 20 bp, Unknown
  RNA secondary structure sequence
gacgaagctgccggccaatg

SEQ ID NO: 26224 - DNA, 20 bp, Unknown
  RNA secondary structure sequence
tcgcgggctcagctggttgg

SEQ ID NO: 26225 - DNA, 20 bp, Unknown
  RNA secondary structure sequence
cgcggctgcggtacggcgtg

SEQ ID NO: 26226 - DNA, 20 bp, Unknown
  RNA secondary structure sequence
gtgcgcggctgcggtacggc

SEQ ID NO: 26227 - DNA, 20 bp, Unknown
  RNA secondary structure sequence
caccggcccttacactgtgg

SEQ ID NO: 26228 - DNA, 20 bp, Unknown
  RNA secondary structure sequence
gagccccgagagacgccccg

SEQ ID NO: 26229 - DNA, 20 bp, Unknown
  RNA secondary structure sequence
cgccgacagcccgagaaacc

SEQ ID NO: 26230 - DNA, 20 bp, Unknown
  RNA secondary structure sequence
cgcagccacgggatgggtcg

SEQ ID NO: 26231 - DNA, 20 bp, Unknown
  RNA secondary structure sequence
tcatcggccaccccagaagc

SEQ ID NO: 26232 - DNA, 20 bp, Unknown
  RNA secondary structure sequence
actgggcggggagaccaagg

SEQ ID NO: 26233 - DNA, 20 bp, Unknown
  RNA secondary structure sequence
cgctggcgctctactcgtgc

SEQ ID NO: 26234 - DNA, 20 bp, Unknown
  RNA secondary structure sequence
ccagcgccgccgaagcagct

SEQ ID NO: 26235 - DNA, 20 bp, Unknown
  RNA secondary structure sequence
cctccaccggcccttgcagg

SEQ ID NO: 26236 - DNA, 20 bp, Unknown
  RNA secondary structure sequence
ctccaggccacgcgagccgg

SEQ ID NO: 26237 - DNA, 20 bp, Unknown
  RNA secondary structure sequence
ccgcgggtgtgagcgcgcgc

SEQ ID NO: 26238 - DNA, 20 bp, Unknown
  RNA secondary structure sequence
ccctctgaccccagcccgga

SEQ ID NO: 26239 - DNA, 20 bp, Unknown
  RNA secondary structure sequence
gacagggagcttccttggct

SEQ ID NO: 26240 - DNA, 20 bp, Unknown
  RNA secondary structure sequence
ctgggcagctgggcactggg

SEQ ID NO: 26241 - DNA, 20 bp, Unknown
  RNA secondary structure sequence
ttgttccctatcctgggcca

SEQ ID NO: 26242 - DNA, 20 bp, Unknown
  RNA secondary structure sequence
ccgggtccgggccattttcc

SEQ ID NO: 26243 - DNA, 20 bp, Unknown
  RNA secondary structure sequence
ttctgcagtcggcgctccct

SEQ ID NO: 26244 - DNA, 20 bp, Unknown
  RNA secondary structure sequence
ttgctgccctcacagacttg

SEQ ID NO: 26245 - DNA, 20 bp, Unknown
  RNA secondary structure sequence
tgatccacttcctcctcagg

SEQ ID NO: 26246 - DNA, 20 bp, Unknown
  RNA secondary structure sequence
caccggcggtaccagtaagt

SEQ ID NO: 26247 - DNA, 20 bp, Unknown
  RNA secondary structure sequence
gaaagccgccggcggggaat

SEQ ID NO: 26248 - DNA, 20 bp, Unknown
  RNA secondary structure sequence
actggggatcccgccgccgg

SEQ ID NO: 26249 - DNA, 20 bp, Unknown
  RNA secondary structure sequence
ctgtgttgaacggttcttgt

SEQ ID NO: 26250 - DNA, 20 bp, Unknown
  RNA secondary structure sequence
ggctcaccatggaccgccgg

SEQ ID NO: 26251 - DNA, 20 bp, Unknown
  RNA secondary structure sequence
cctgagccgggaccgctagg

SEQ ID NO: 26252 - DNA, 20 bp, Unknown
  RNA secondary structure sequence
accggccgccgggcctctgg

SEQ ID NO: 26253 - DNA, 20 bp, Unknown
  RNA secondary structure sequence
aggaggtgccggccgagcac

SEQ ID NO: 26254 - DNA, 20 bp, Unknown
  RNA secondary structure sequence
aaatagtgagatttccaatg

SEQ ID NO: 26255 - DNA, 20 bp, Unknown
  RNA secondary structure sequence
tctgcaccgtcatctcctgc

SEQ ID NO: 26256 - DNA, 20 bp, Unknown
  RNA secondary structure sequence
ccctgagagtctgagcgctc

SEQ ID NO: 26257 - DNA, 20 bp, Unknown
  RNA secondary structure sequence
gtaaagcgccacgcaagcag

SEQ ID NO: 26258 - DNA, 20 bp, Unknown
  RNA secondary structure sequence
gccgccgcctgccgcgcccc

SEQ ID NO: 26259 - DNA, 20 bp, Unknown
  RNA secondary structure sequence
tttttggatagggttgacgt

SEQ ID NO: 26260 - DNA, 20 bp, Unknown
  RNA secondary structure sequence
gggctgcgcgcgcttttggg

SEQ ID NO: 26261 - DNA, 20 bp, Unknown
  RNA secondary structure sequence
tccaccggcggcaaggctcc

SEQ ID NO: 26262 - DNA, 20 bp, Unknown
  RNA secondary structure sequence
cagccaccggttccttatcc

SEQ ID NO: 26263 - DNA, 20 bp, Unknown
  RNA secondary structure sequence
taactaggtggagtaggtgt

SEQ ID NO: 26264 - DNA, 20 bp, Unknown
  RNA secondary structure sequence
ctctccctctttcataccca

SEQ ID NO: 26265 - DNA, 20 bp, Unknown
  RNA secondary structure sequence
ccgttatttaatacctgtca

SEQ ID NO: 26266 - DNA, 20 bp, Unknown
  RNA secondary structure sequence
gtggccactgttggcttctg

SEQ ID NO: 26267 - DNA, 20 bp, Unknown
  RNA secondary structure sequence
ccagcacccagactccagca

SEQ ID NO: 26268 - DNA, 20 bp, Unknown
  RNA secondary structure sequence
cgcccggctgctcctcactt

SEQ ID NO: 26269 - DNA, 20 bp, Unknown
  RNA secondary structure sequence
gtggcggcgggcggcgggcg

SEQ ID NO: 26270 - DNA, 20 bp, Unknown
  RNA secondary structure sequence
gggaaacatctgccgttggt

SEQ ID NO: 26271 - DNA, 20 bp, Unknown
  RNA secondary structure sequence
cggtagctgccccctgagct

SEQ ID NO: 26272 - DNA, 20 bp, Unknown
  RNA secondary structure sequence
cagcacctcctgagaccggc

SEQ ID NO: 26273 - DNA, 20 bp, Unknown
  RNA secondary structure sequence
cgaaactctcagggttggca

SEQ ID NO: 26274 - DNA, 20 bp, Unknown
  RNA secondary structure sequence
cgtgttcgcgcctggtagag

SEQ ID NO: 26275 - DNA, 20 bp, Unknown
  RNA secondary structure sequence
cgcggggtccaagatggtgg

SEQ ID NO: 26276 - DNA, 20 bp, Unknown
  RNA secondary structure sequence
ggggtgagcgtccccgtccc

SEQ ID NO: 26277 - DNA, 20 bp, Unknown
  RNA secondary structure sequence
ggcgttatttttattaactg

SEQ ID NO: 26278 - DNA, 20 bp, Unknown
  RNA secondary structure sequence
cgcgtctcttcgccacattc

SEQ ID NO: 26279 - DNA, 20 bp, Unknown
  RNA secondary structure sequence
cccggccgtgcgcccagctt

SEQ ID NO: 26280 - DNA, 20 bp, Unknown
  RNA secondary structure sequence
ccctctcctataaagcagac

SEQ ID NO: 26281 - DNA, 20 bp, Unknown
  RNA secondary structure sequence
tggggtgcttggggcgcacc

SEQ ID NO: 26282 - DNA, 20 bp, Unknown
  RNA secondary structure sequence
ccccgcgccgcccgcgcccc

SEQ ID NO: 26283 - DNA, 20 bp, Unknown
  RNA secondary structure sequence
tctccaggcagcggccgtcg

SEQ ID NO: 26284 - DNA, 20 bp, Unknown
  RNA secondary structure sequence
gcttataacctgggatgggc

SEQ ID NO: 26285 - DNA, 20 bp, Unknown
  RNA secondary structure sequence
ctcaggaccctcgccatgaa

SEQ ID NO: 26286 - DNA, 20 bp, Unknown
  RNA secondary structure sequence
cccccatgtagaaggtgcac

SEQ ID NO: 26287 - DNA, 20 bp, Unknown
  RNA secondary structure sequence
gggatgcggggctgggaccc

SEQ ID NO: 26288 - DNA, 20 bp, Unknown
  RNA secondary structure sequence
cgcctcgagcggggtccgag

SEQ ID NO: 26289 - DNA, 20 bp, Unknown
  RNA secondary structure sequence
gcccgcctcccgcccgccct

SEQ ID NO: 26290 - DNA, 20 bp, Unknown
  RNA secondary structure sequence
tgggtgctgggaaggggcct

SEQ ID NO: 26291 - DNA, 20 bp, Unknown
  RNA secondary structure sequence
agccacagcccgacgcacgg

SEQ ID NO: 26292 - DNA, 20 bp, Unknown
  RNA secondary structure sequence
aagaaagacatggatgcata

SEQ ID NO: 26293 - DNA, 20 bp, Unknown
  RNA secondary structure sequence
aggaaaaaaaaatcccggga

SEQ ID NO: 26294 - DNA, 20 bp, Unknown
  RNA secondary structure sequence
gccttaagaacccggcaacc

SEQ ID NO: 26295 - DNA, 20 bp, Unknown
  RNA secondary structure sequence
ggaggggcggggaggtggac

SEQ ID NO: 26296 - DNA, 20 bp, Unknown
  RNA secondary structure sequence
atgtattgctgtgctctccg

SEQ ID NO: 26297 - DNA, 20 bp, Unknown
  RNA secondary structure sequence
caccttctctgcctccagtc

SEQ ID NO: 26298 - DNA, 20 bp, Unknown
  RNA secondary structure sequence
ctgccctgaaactctagtcg

SEQ ID NO: 26299 - DNA, 20 bp, Unknown
  RNA secondary structure sequence
ggtcgggtgccgtacgccga

SEQ ID NO: 26300 - DNA, 20 bp, Unknown
  RNA secondary structure sequence
gcccgggtgtagcgcatcac

SEQ ID NO: 26301 - DNA, 20 bp, Unknown
  RNA secondary structure sequence
gagaaaaccctgtcggtctt

SEQ ID NO: 26302 - DNA, 20 bp, Unknown
  RNA secondary structure sequence
gaggcagccgaaccctagcg

SEQ ID NO: 26303 - DNA, 20 bp, Unknown
  RNA secondary structure sequence
gggtgcccggccatgggctg

SEQ ID NO: 26304 - DNA, 20 bp, Unknown
  RNA secondary structure sequence
tgtatgggggacagcaggcg

SEQ ID NO: 26305 - DNA, 20 bp, Unknown
  RNA secondary structure sequence
gctggtcccctcagagggtt

SEQ ID NO: 26306 - DNA, 20 bp, Unknown
  RNA secondary structure sequence
ggcgttccagagagtgggga

SEQ ID NO: 26307 - DNA, 20 bp, Unknown
  RNA secondary structure sequence
ggggaggaggtttactcagc

SEQ ID NO: 26308 - DNA, 20 bp, Unknown
  RNA secondary structure sequence
acccgcaagcaagggggcgg

SEQ ID NO: 26309 - DNA, 20 bp, Unknown
  RNA secondary structure sequence
acatttaagtatcttcgacc

SEQ ID NO: 26310 - DNA, 20 bp, Unknown
  RNA secondary structure sequence
gccagcagctgcagcagcta

SEQ ID NO: 26311 - DNA, 20 bp, Unknown
  RNA secondary structure sequence
ctggggcgccggcgggtgcg

SEQ ID NO: 26312 - DNA, 20 bp, Unknown
  RNA secondary structure sequence
acacgttggactcgctgggc

SEQ ID NO: 26313 - DNA, 20 bp, Unknown
  RNA secondary structure sequence
ggtgcggtggcggaagtgca

SEQ ID NO: 26314 - DNA, 20 bp, Unknown
  RNA secondary structure sequence
gtgaaggcaaggtccctgga

SEQ ID NO: 26315 - DNA, 20 bp, Unknown
  RNA secondary structure sequence
aaatttctatcttcttttgt

SEQ ID NO: 26316 - DNA, 20 bp, Unknown
  RNA secondary structure sequence
gaaagactttctgggcaaaa

SEQ ID NO: 26317 - DNA, 20 bp, Unknown
  RNA secondary structure sequence
ccggagcatcctgcactgca

SEQ ID NO: 26318 - DNA, 20 bp, Unknown
  RNA secondary structure sequence
cgggagctggggagccaggg

SEQ ID NO: 26319 - DNA, 20 bp, Unknown
  RNA secondary structure sequence
ggggacagagcccctttttt

SEQ ID NO: 26320 - DNA, 20 bp, Unknown
  RNA secondary structure sequence
gcttcccaggcatggagaag

SEQ ID NO: 26321 - DNA, 20 bp, Unknown
  RNA secondary structure sequence
actttgattattggcaaata

SEQ ID NO: 26322 - DNA, 20 bp, Unknown
  RNA secondary structure sequence
gaggtgcaggcagagcagcc

SEQ ID NO: 26323 - DNA, 20 bp, Unknown
  RNA secondary structure sequence
gcgtcaccaccctgcccacc

SEQ ID NO: 26324 - DNA, 20 bp, Unknown
  RNA secondary structure sequence
caaggactaattggtcttta

SEQ ID NO: 26325 - DNA, 20 bp, Unknown
  RNA secondary structure sequence
gagtccatgaaggtccccgc

SEQ ID NO: 26326 - DNA, 20 bp, Unknown
  RNA secondary structure sequence
tcggtggtgagaggaagcct

SEQ ID NO: 26327 - DNA, 20 bp, Unknown
  RNA secondary structure sequence
ccactgcgcgccagcaggtc

SEQ ID NO: 26328 - DNA, 20 bp, Unknown
  RNA secondary structure sequence
ccaggttgctctgatgatat

SEQ ID NO: 26329 - DNA, 20 bp, Unknown
  RNA secondary structure sequence
cttggactttcgccgaaagt

SEQ ID NO: 26330 - DNA, 20 bp, Unknown
  RNA secondary structure sequence
tacttggagcactatctgga

SEQ ID NO: 26331 - DNA, 20 bp, Unknown
  RNA secondary structure sequence
ttttcagagtagttcacaac

SEQ ID NO: 26332 - DNA, 20 bp, Unknown
  RNA secondary structure sequence
agaagaagaacccatgaagg

SEQ ID NO: 26333 - DNA, 20 bp, Unknown
  RNA secondary structure sequence
gaagtaccgcgagcaaggag

SEQ ID NO: 26334 - DNA, 20 bp, Unknown
  RNA secondary structure sequence
gcccccaggacccctgggga

SEQ ID NO: 26335 - DNA, 20 bp, Unknown
  RNA secondary structure sequence
agtccagaagcaagacctgt

SEQ ID NO: 26336 - DNA, 20 bp, Unknown
  RNA secondary structure sequence
ctcccctttctcgcccagcg

SEQ ID NO: 26337 - DNA, 20 bp, Unknown
  RNA secondary structure sequence
tgcggccgctgccccagggc

SEQ ID NO: 26338 - DNA, 20 bp, Unknown
  RNA secondary structure sequence
agtgcagccactgccgccgc

SEQ ID NO: 26339 - DNA, 20 bp, Unknown
  RNA secondary structure sequence
gccttttccctcgggtagta

SEQ ID NO: 26340 - DNA, 20 bp, Unknown
  RNA secondary structure sequence
caacgatgactcctgggaag

SEQ ID NO: 26341 - DNA, 20 bp, Unknown
  RNA secondary structure sequence
agccctgactacagctcttg

SEQ ID NO: 26342 - DNA, 20 bp, Unknown
  RNA secondary structure sequence
cggccggcctcgggcaccgg

SEQ ID NO: 26343 - DNA, 20 bp, Unknown
  RNA secondary structure sequence
ggcgtgtgaagataacccaa

SEQ ID NO: 26344 - DNA, 20 bp, Unknown
  RNA secondary structure sequence
gtacctttgcactccagcct

SEQ ID NO: 26345 - DNA, 20 bp, Unknown
  RNA secondary structure sequence
acgcagggctctcccaagtt

SEQ ID NO: 26346 - DNA, 20 bp, Unknown
  RNA secondary structure sequence
gagtgaagcatacagtcaaa

SEQ ID NO: 26347 - DNA, 20 bp, Unknown
  RNA secondary structure sequence
gataggagcaacatgcatgt

SEQ ID NO: 26348 - DNA, 20 bp, Unknown
  RNA secondary structure sequence
catccgagcatgaaacgctg

SEQ ID NO: 26349 - DNA, 20 bp, Unknown
  RNA secondary structure sequence
caagtgaaagagattagtcc

SEQ ID NO: 26350 - DNA, 20 bp, Unknown
  RNA secondary structure sequence
gcaggacccaggcagaaaag

SEQ ID NO: 26351 - DNA, 20 bp, Unknown
  RNA secondary structure sequence
ctgccatcttctccgcgcta

SEQ ID NO: 26352 - DNA, 20 bp, Unknown
  RNA secondary structure sequence
ctcccctgccctctaaaacc

SEQ ID NO: 26353 - DNA, 20 bp, Unknown
  RNA secondary structure sequence
cttcagagtttgaaaaaaaa

SEQ ID NO: 26354 - DNA, 20 bp, Unknown
  RNA secondary structure sequence
tcctttataaagcctggctc

SEQ ID NO: 26355 - DNA, 20 bp, Unknown
  RNA secondary structure sequence
gggctgctgtggctgttctg

SEQ ID NO: 26356 - DNA, 20 bp, Unknown
  RNA secondary structure sequence
gattaacagatgaccccaat

SEQ ID NO: 26357 - DNA, 20 bp, Unknown
  RNA secondary structure sequence
gcccatggatgagaaattga

SEQ ID NO: 26358 - DNA, 20 bp, Unknown
  RNA secondary structure sequence
aggagaagtaaggccctgga

SEQ ID NO: 26359 - DNA, 20 bp, Unknown
  RNA secondary structure sequence
ttgaggggctcttcgatgac

SEQ ID NO: 26360 - DNA, 20 bp, Unknown
  RNA secondary structure sequence
atgccgcctacgtgccccct

SEQ ID NO: 26361 - DNA, 20 bp, Unknown
  RNA secondary structure sequence
ataaagagaaagactcttat

SEQ ID NO: 26362 - DNA, 20 bp, Unknown
  RNA secondary structure sequence
cgttacttctgctgtggaag

SEQ ID NO: 26363 - DNA, 20 bp, Unknown
  RNA secondary structure sequence
gtgagaaggggagcaaggga

SEQ ID NO: 26364 - DNA, 20 bp, Unknown
  RNA secondary structure sequence
agatggagaggctggcccca

SEQ ID NO: 26365 - DNA, 20 bp, Unknown
  RNA secondary structure sequence
ctgcaggaccacctgctgga

SEQ ID NO: 26366 - DNA, 20 bp, Unknown
  RNA secondary structure sequence
ccaagttcaaggtcaccttc

SEQ ID NO: 26367 - DNA, 20 bp, Unknown
  RNA secondary structure sequence
tactatgtaaggaattgtcg

SEQ ID NO: 26368 - DNA, 20 bp, Unknown
  RNA secondary structure sequence
cctccttggtagggatcctc

SEQ ID NO: 26369 - DNA, 20 bp, Unknown
  RNA secondary structure sequence
ctccagcatggccgcctcca

SEQ ID NO: 26370 - DNA, 20 bp, Unknown
  RNA secondary structure sequence
gcccaccaagaagaaagcag

SEQ ID NO: 26371 - DNA, 20 bp, Unknown
  RNA secondary structure sequence
gagacttttctccctgaagt

SEQ ID NO: 26372 - DNA, 20 bp, Unknown
  RNA secondary structure sequence
gaggtgactgaagcgagcct

SEQ ID NO: 26373 - DNA, 20 bp, Unknown
  RNA secondary structure sequence
acggacggtggacgctggga

SEQ ID NO: 26374 - DNA, 20 bp, Unknown
  RNA secondary structure sequence
tccctgcaccatgccctaca

SEQ ID NO: 26375 - DNA, 20 bp, Unknown
  RNA secondary structure sequence
aacattttgggaggacgaag

SEQ ID NO: 26376 - DNA, 20 bp, Unknown
  RNA secondary structure sequence
gcaccatgtcttacagttgt

SEQ ID NO: 26377 - DNA, 20 bp, Unknown
  RNA secondary structure sequence
gatgggaggatgctcagggt

SEQ ID NO: 26378 - DNA, 20 bp, Unknown
  RNA secondary structure sequence
tgggttcgtgcgccttctac

SEQ ID NO: 26379 - DNA, 20 bp, Unknown
  RNA secondary structure sequence
tgctcccggtgccatgaacg

SEQ ID NO: 26380 - DNA, 20 bp, Unknown
  RNA secondary structure sequence
gacactccctaatgaaaaag

SEQ ID NO: 26381 - DNA, 20 bp, Unknown
  RNA secondary structure sequence
tcctcttgcccgcgcaggca

SEQ ID NO: 26382 - DNA, 20 bp, Unknown
  RNA secondary structure sequence
aaatcaaacctttgagaagc

SEQ ID NO: 26383 - DNA, 20 bp, Unknown
  RNA secondary structure sequence
gagggccctgcgccgccttt

SEQ ID NO: 26384 - DNA, 20 bp, Unknown
  RNA secondary structure sequence
gcgctggcggagacgccggc

SEQ ID NO: 26385 - DNA, 20 bp, Unknown
  RNA secondary structure sequence
tccttcccagccgcgcggct

SEQ ID NO: 26386 - DNA, 20 bp, Unknown
  RNA secondary structure sequence
tctgaaattcatcacctctc

SEQ ID NO: 26387 - DNA, 20 bp, Unknown
  RNA secondary structure sequence
ccgctgccgccgtcacccgc

SEQ ID NO: 26388 - DNA, 20 bp, Unknown
  RNA secondary structure sequence
cacatagccgagcccgacgg

SEQ ID NO: 26389 - DNA, 20 bp, Unknown
  RNA secondary structure sequence
ggtctgggtcggccacacag

SEQ ID NO: 26390 - DNA, 20 bp, Unknown
  RNA secondary structure sequence
tccacattcctctgtgggct

SEQ ID NO: 26391 - DNA, 20 bp, Unknown
  RNA secondary structure sequence
caacagccgacttagatgtg

SEQ ID NO: 26392 - DNA, 20 bp, Unknown
  RNA secondary structure sequence
aggtccggcacctgctgcgc

SEQ ID NO: 26393 - DNA, 20 bp, Unknown
  RNA secondary structure sequence
cgccgcgggaacgctgtcct

SEQ ID NO: 26394 - DNA, 20 bp, Unknown
  RNA secondary structure sequence
gatcgtctgctccctcagcc

SEQ ID NO: 26395 - DNA, 20 bp, Unknown
  RNA secondary structure sequence
ccaggctgggagcatcccct

SEQ ID NO: 26396 - DNA, 20 bp, Unknown
  RNA secondary structure sequence
cggccccacgcttcccactt

SEQ ID NO: 26397 - DNA, 20 bp, Unknown
  RNA secondary structure sequence
tctctgggccaggtggaacc

SEQ ID NO: 26398 - DNA, 20 bp, Unknown
  RNA secondary structure sequence
gtacctgcacttatttattg

SEQ ID NO: 26399 - DNA, 20 bp, Unknown
  RNA secondary structure sequence
ttgctggaggggctaccagg

SEQ ID NO: 26400 - DNA, 20 bp, Unknown
  RNA secondary structure sequence
agtaacaccatcaggtccta

SEQ ID NO: 26401 - DNA, 20 bp, Unknown
  RNA secondary structure sequence
ggagagactggacctaaatg

SEQ ID NO: 26402 - DNA, 20 bp, Unknown
  RNA secondary structure sequence
gaatatttgagattgaagat

SEQ ID NO: 26403 - DNA, 20 bp, Unknown
  RNA secondary structure sequence
ccagctctgagatttccagc

SEQ ID NO: 26404 - DNA, 20 bp, Unknown
  RNA secondary structure sequence
tccttcccctgaccagccca

SEQ ID NO: 26405 - DNA, 20 bp, Unknown
  RNA secondary structure sequence
ctctcagcttcagagggaaa

SEQ ID NO: 26406 - DNA, 20 bp, Unknown
  RNA secondary structure sequence
gaccctacagcttggggcct

SEQ ID NO: 26407 - DNA, 20 bp, Unknown
  RNA secondary structure sequence
gtcccgagcgcgatgacttg

SEQ ID NO: 26408 - DNA, 20 bp, Unknown
  RNA secondary structure sequence
aggtctgaattccagactcc

SEQ ID NO: 26409 - DNA, 20 bp, Unknown
  RNA secondary structure sequence
gcggatcccgagagggaaag

SEQ ID NO: 26410 - DNA, 20 bp, Unknown
  RNA secondary structure sequence
tccggcagcttctcgcggct

SEQ ID NO: 26411 - DNA, 20 bp, Unknown
  RNA secondary structure sequence
tggactccctgctgagcaag

SEQ ID NO: 26412 - DNA, 20 bp, Unknown
  RNA secondary structure sequence
gactgcactgcttctcccag

SEQ ID NO: 26413 - DNA, 20 bp, Unknown
  RNA secondary structure sequence
ccctgcccaccttcctcacc

SEQ ID NO: 26414 - DNA, 20 bp, Unknown
  RNA secondary structure sequence
gcccctcctccctggtttga

SEQ ID NO: 26415 - DNA, 20 bp, Unknown
  RNA secondary structure sequence
ctttcgtaaccgcaccacac

SEQ ID NO: 26416 - DNA, 20 bp, Unknown
  RNA secondary structure sequence
tcatcctaggcctcaggagc

SEQ ID NO: 26417 - DNA, 20 bp, Unknown
  RNA secondary structure sequence
gcggggcgctccggggaggc

SEQ ID NO: 26418 - DNA, 20 bp, Unknown
  RNA secondary structure sequence
accagaggctgctctgcttg

SEQ ID NO: 26419 - DNA, 20 bp, Unknown
  RNA secondary structure sequence
tgggctctgggcggtgccaa

SEQ ID NO: 26420 - DNA, 20 bp, Unknown
  RNA secondary structure sequence
ccaccatgccacccatgctg

SEQ ID NO: 26421 - DNA, 20 bp, Unknown
  RNA secondary structure sequence
agcaccggggcatccccggg

SEQ ID NO: 26422 - DNA, 20 bp, Unknown
  RNA secondary structure sequence
cctttcctctctgcctctgg

SEQ ID NO: 26423 - DNA, 20 bp, Unknown
  RNA secondary structure sequence
ccgcacccggttcagctcgc

SEQ ID NO: 26424 - DNA, 20 bp, Unknown
  RNA secondary structure sequence
ggccccttccccgcgggcgt

SEQ ID NO: 26425 - DNA, 20 bp, Unknown
  RNA secondary structure sequence
aacaccccagggagtgaaag

SEQ ID NO: 26426 - DNA, 20 bp, Unknown
  RNA secondary structure sequence
ctcaggtctgcagctgggtc

SEQ ID NO: 26427 - DNA, 20 bp, Unknown
  RNA secondary structure sequence
gatgggagagaaaggccagg

SEQ ID NO: 26428 - DNA, 20 bp, Unknown
  RNA secondary structure sequence
ggggagactctgcaggagcc

SEQ ID NO: 26429 - DNA, 20 bp, Unknown
  RNA secondary structure sequence
cgcggattgtgcacagttct

SEQ ID NO: 26430 - DNA, 20 bp, Unknown
  RNA secondary structure sequence
tggcccaaccatgcctctgt

SEQ ID NO: 26431 - DNA, 20 bp, Unknown
  RNA secondary structure sequence
ggcttcggccgccggggcca

SEQ ID NO: 26432 - DNA, 20 bp, Unknown
  RNA secondary structure sequence
tgtgtcccacccttcctagc

SEQ ID NO: 26433 - DNA, 20 bp, Unknown
  RNA secondary structure sequence
ggaaaagtgcccttgagcct

SEQ ID NO: 26434 - DNA, 20 bp, Unknown
  RNA secondary structure sequence
ctgcggacattcagggatcg

SEQ ID NO: 26435 - DNA, 20 bp, Unknown
  RNA secondary structure sequence
ggggtcacagctggccactg

SEQ ID NO: 26436 - DNA, 20 bp, Unknown
  RNA secondary structure sequence
cactctccctcgagcgccgc

SEQ ID NO: 26437 - DNA, 20 bp, Unknown
  RNA secondary structure sequence
caggaggactacttccagca

SEQ ID NO: 26438 - DNA, 20 bp, Unknown
  RNA secondary structure sequence
tacacccaccgaggcatggg

SEQ ID NO: 26439 - DNA, 20 bp, Unknown
  RNA secondary structure sequence
gcggatccccagccgtccct

SEQ ID NO: 26440 - DNA, 20 bp, Unknown
  RNA secondary structure sequence
cgcaccaccccccctcccgc

SEQ ID NO: 26441 - DNA, 20 bp, Unknown
  RNA secondary structure sequence
ttggctgcatttctggcctc

SEQ ID NO: 26442 - DNA, 20 bp, Unknown
  RNA secondary structure sequence
ctcttactccaaaaagatgg

SEQ ID NO: 26443 - DNA, 20 bp, Unknown
  RNA secondary structure sequence
gatggagccgttcctcagga

SEQ ID NO: 26444 - DNA, 20 bp, Unknown
  RNA secondary structure sequence
gtcctggccggataccgcgc

SEQ ID NO: 26445 - DNA, 20 bp, Unknown
  RNA secondary structure sequence
tttaacgagcagacgccccc

SEQ ID NO: 26446 - DNA, 20 bp, Unknown
  RNA secondary structure sequence
ctgggctgccggtgacctgg

SEQ ID NO: 26447 - DNA, 20 bp, Unknown
  RNA secondary structure sequence
ctcagcttcgagccgaggtg

SEQ ID NO: 26448 - DNA, 20 bp, Unknown
  RNA secondary structure sequence
ccgcggaggagcaggagagg

SEQ ID NO: 26449 - DNA, 20 bp, Unknown
  RNA secondary structure sequence
atggcgggagctccggacga

SEQ ID NO: 26450 - DNA, 20 bp, Unknown
  RNA secondary structure sequence
actcggattgctctccgccc

SEQ ID NO: 26451 - DNA, 20 bp, Unknown
  RNA secondary structure sequence
cttccgtcgctccttgccgg

SEQ ID NO: 26452 - DNA, 20 bp, Unknown
  RNA secondary structure sequence
ctgggagccgaggcgtcggt

SEQ ID NO: 26453 - DNA, 20 bp, Unknown
  RNA secondary structure sequence
gaagcagtaccttgaagaga

SEQ ID NO: 26454 - DNA, 20 bp, Unknown
  RNA secondary structure sequence
ccgtgtccgcgaccgcgtac

SEQ ID NO: 26455 - DNA, 20 bp, Unknown
  RNA secondary structure sequence
tccggcgggcgtgttgggtg

SEQ ID NO: 26456 - DNA, 20 bp, Unknown
  RNA secondary structure sequence
ctagcccctaaccatgggcc

SEQ ID NO: 26457 - DNA, 20 bp, Unknown
  RNA secondary structure sequence
cccacaggcgtgaacctgct

SEQ ID NO: 26458 - DNA, 20 bp, Unknown
  RNA secondary structure sequence
gccgtgccgggggctaactg

SEQ ID NO: 26459 - DNA, 20 bp, Unknown
  RNA secondary structure sequence
ccttggagccaccgccccct

SEQ ID NO: 26460 - DNA, 20 bp, Unknown
  RNA secondary structure sequence
gggactggtctgaagagacg

SEQ ID NO: 26461 - DNA, 20 bp, Unknown
  RNA secondary structure sequence
atgcggccgtgagccggcgg

SEQ ID NO: 26462 - DNA, 20 bp, Unknown
  RNA secondary structure sequence
tggataaagacctcctgaaa

SEQ ID NO: 26463 - DNA, 20 bp, Unknown
  RNA secondary structure sequence
caccggcaaaggctgtctag

SEQ ID NO: 26464 - DNA, 20 bp, Unknown
  RNA secondary structure sequence
caacaccccacccggcggga

SEQ ID NO: 26465 - DNA, 20 bp, Unknown
  RNA secondary structure sequence
cggtgggttcgggaacctgt

SEQ ID NO: 26466 - DNA, 20 bp, Unknown
  RNA secondary structure sequence
ggtccgatctggacgaacgc

SEQ ID NO: 26467 - DNA, 20 bp, Unknown
  RNA secondary structure sequence
cccttgacccagtggatatc

SEQ ID NO: 26468 - DNA, 20 bp, Unknown
  RNA secondary structure sequence
gtttcctctccgcgtactcg

SEQ ID NO: 26469 - DNA, 20 bp, Unknown
  RNA secondary structure sequence
gcaggcgactcctgtcccgg

SEQ ID NO: 26470 - DNA, 20 bp, Unknown
  RNA secondary structure sequence
ctttccttcgcgtcctgaac

SEQ ID NO: 26471 - DNA, 20 bp, Unknown
  RNA secondary structure sequence
ttgttgacactgcgagcact

SEQ ID NO: 26472 - DNA, 20 bp, Unknown
  RNA secondary structure sequence
caaggggcggccggcgagtc

SEQ ID NO: 26473 - DNA, 20 bp, Unknown
  RNA secondary structure sequence
cgaaggtcccggagcgttca

SEQ ID NO: 26474 - DNA, 20 bp, Unknown
  RNA secondary structure sequence
ttcgcacggccacaggggcg

SEQ ID NO: 26475 - DNA, 20 bp, Unknown
  RNA secondary structure sequence
ggtccgcgtgggcgctgggg

SEQ ID NO: 26476 - DNA, 20 bp, Unknown
  RNA secondary structure sequence
cttccttgaaaaacccggcg

SEQ ID NO: 26477 - DNA, 20 bp, Unknown
  RNA secondary structure sequence
tggagcaggcagggcagtct

SEQ ID NO: 26478 - DNA, 20 bp, Unknown
  RNA secondary structure sequence
gaaagggtctagccatgctg

SEQ ID NO: 26479 - DNA, 20 bp, Unknown
  RNA secondary structure sequence
caagtctctcctccctagcg

SEQ ID NO: 26480 - DNA, 20 bp, Unknown
  RNA secondary structure sequence
gagcgtcccgagacttcttc

SEQ ID NO: 26481 - DNA, 20 bp, Unknown
  RNA secondary structure sequence
ctgcgtgctgcagtagcgcc

SEQ ID NO: 26482 - DNA, 20 bp, Unknown
  RNA secondary structure sequence
gcgcaactgagaggaactga

SEQ ID NO: 26483 - DNA, 20 bp, Unknown
  RNA secondary structure sequence
gagctgggacgggcggcggc

SEQ ID NO: 26484 - DNA, 20 bp, Unknown
  RNA secondary structure sequence
gatgcagcgccccgggccct

SEQ ID NO: 26485 - DNA, 20 bp, Unknown
  RNA secondary structure sequence
tcagaggtaaggagaatttt

SEQ ID NO: 26486 - DNA, 20 bp, Unknown
  RNA secondary structure sequence
ggggcggctgtggagcctgt

SEQ ID NO: 26487 - DNA, 20 bp, Unknown
  RNA secondary structure sequence
gtcagagagcccgcggctta

SEQ ID NO: 26488 - DNA, 20 bp, Unknown
  RNA secondary structure sequence
tgtgagtgggaggcggcggc

SEQ ID NO: 26489 - DNA, 20 bp, Unknown
  RNA secondary structure sequence
tgtggtggtgtgagtgggag

SEQ ID NO: 26490 - DNA, 20 bp, Unknown
  RNA secondary structure sequence
ctcccgcgcggctgactcca

SEQ ID NO: 26491 - DNA, 20 bp, Unknown
  RNA secondary structure sequence
gcacggggggcgcgggagga

SEQ ID NO: 26492 - DNA, 20 bp, Unknown
  RNA secondary structure sequence
cgtgtgctcggcctttctgt

SEQ ID NO: 26493 - DNA, 20 bp, Unknown
  RNA secondary structure sequence
ctctgctgaggatggaagtg

SEQ ID NO: 26494 - DNA, 20 bp, Unknown
  RNA secondary structure sequence
gttttcggctctgaagaggt

SEQ ID NO: 26495 - DNA, 20 bp, Unknown
  RNA secondary structure sequence
gctcgggcggagctggagac

SEQ ID NO: 26496 - DNA, 20 bp, Unknown
  RNA secondary structure sequence
acgggtgcgtccgggcggct

SEQ ID NO: 26497 - DNA, 20 bp, Unknown
  RNA secondary structure sequence
ggtggctgtggcggtggcgc

SEQ ID NO: 26498 - DNA, 20 bp, Unknown
  RNA secondary structure sequence
gagactctgcgctccggcgg

SEQ ID NO: 26499 - DNA, 20 bp, Unknown
  RNA secondary structure sequence
accccgggacagtccctctc

SEQ ID NO: 26500 - DNA, 20 bp, Unknown
  RNA secondary structure sequence
aggcggcgcgggggctgctg

SEQ ID NO: 26501 - DNA, 20 bp, Unknown
  RNA secondary structure sequence
gcggctgacagcagcagcgg

SEQ ID NO: 26502 - DNA, 20 bp, Unknown
  RNA secondary structure sequence
tcctgggaatcttcaatcac

SEQ ID NO: 26503 - DNA, 20 bp, Unknown
  RNA secondary structure sequence
gtttgtctgtgtttctggac

SEQ ID NO: 26504 - DNA, 20 bp, Unknown
  RNA secondary structure sequence
cgaccagtgctgcgatcccg

SEQ ID NO: 26505 - DNA, 20 bp, Unknown
  RNA secondary structure sequence
gcacctggtgactgggaagc

SEQ ID NO: 26506 - DNA, 20 bp, Unknown
  RNA secondary structure sequence
tggctctttctcttcttggg

SEQ ID NO: 26507 - DNA, 20 bp, Unknown
  RNA secondary structure sequence
aaagagcaagcactgaggcc

SEQ ID NO: 26508 - DNA, 20 bp, Unknown
  RNA secondary structure sequence
acctgcgcccggaggtcgcc

SEQ ID NO: 26509 - DNA, 20 bp, Unknown
  RNA secondary structure sequence
tggtcttgaactcagggtcc

SEQ ID NO: 26510 - DNA, 20 bp, Unknown
  RNA secondary structure sequence
gcaggcgccgacgctgcggc

SEQ ID NO: 26511 - DNA, 20 bp, Unknown
  RNA secondary structure sequence
ccgtcgttgacgttagtcgc

SEQ ID NO: 26512 - DNA, 20 bp, Unknown
  RNA secondary structure sequence
cctaaacttcagcttctcag

SEQ ID NO: 26513 - DNA, 20 bp, Unknown
  RNA secondary structure sequence
tgtgcggggcgctgagcctg

SEQ ID NO: 26514 - DNA, 20 bp, Unknown
  RNA secondary structure sequence
acgcatctgcctttttttcc

SEQ ID NO: 26515 - DNA, 20 bp, Unknown
  RNA secondary structure sequence
aagtcagcattggcgcccct

SEQ ID NO: 26516 - DNA, 20 bp, Unknown
  RNA secondary structure sequence
atttgagccgctgttgagat

SEQ ID NO: 26517 - DNA, 20 bp, Unknown
  RNA secondary structure sequence
taaagacaaggattggatta

SEQ ID NO: 26518 - DNA, 20 bp, Unknown
  RNA secondary structure sequence
tggggctgggttcctctctt

SEQ ID NO: 26519 - DNA, 20 bp, Unknown
  RNA secondary structure sequence
gcacctagacctggggccag

SEQ ID NO: 26520 - DNA, 20 bp, Unknown
  RNA secondary structure sequence
caagatggcagcaatgagga

SEQ ID NO: 26521 - DNA, 20 bp, Unknown
  RNA secondary structure sequence
acacaccagccctcagtcac

SEQ ID NO: 26522 - DNA, 20 bp, Unknown
  RNA secondary structure sequence
gaaatttaccactctcctct

SEQ ID NO: 26523 - DNA, 20 bp, Unknown
  RNA secondary structure sequence
catttgcatggtggccctgt

SEQ ID NO: 26524 - DNA, 20 bp, Unknown
  RNA secondary structure sequence
agagagccagcatcttggca

SEQ ID NO: 26525 - DNA, 20 bp, Unknown
  RNA secondary structure sequence
tactgtggtttagggcttgg

SEQ ID NO: 26526 - DNA, 20 bp, Unknown
  RNA secondary structure sequence
gtgaaaactttgaggattac

SEQ ID NO: 26527 - DNA, 20 bp, Unknown
  RNA secondary structure sequence
gccaccctgccctgcccacc

SEQ ID NO: 26528 - DNA, 20 bp, Unknown
  RNA secondary structure sequence
tggcaacgcagtacacaagt

SEQ ID NO: 26529 - DNA, 20 bp, Unknown
  RNA secondary structure sequence
ccaaatctctttttgatttt

SEQ ID NO: 26530 - DNA, 20 bp, Unknown
  RNA secondary structure sequence
cttagagcttgagagtcaaa

SEQ ID NO: 26531 - DNA, 20 bp, Unknown
  RNA secondary structure sequence
tgcttaggctccgcggcctc

SEQ ID NO: 26532 - DNA, 20 bp, Unknown
  RNA secondary structure sequence
gggaacccgtgcggctggag

SEQ ID NO: 26533 - DNA, 20 bp, Unknown
  RNA secondary structure sequence
tttggaatctggcaaccatt

SEQ ID NO: 26534 - DNA, 20 bp, Unknown
  RNA secondary structure sequence
ttacaatcacaagcttttac

SEQ ID NO: 26535 - DNA, 20 bp, Unknown
  RNA secondary structure sequence
gagcgccggggctcccggag

SEQ ID NO: 26536 - DNA, 20 bp, Unknown
  RNA secondary structure sequence
cctccttggccaaggccagg

SEQ ID NO: 26537 - DNA, 20 bp, Unknown
  RNA secondary structure sequence
tgtatttcgggtcttgctgg

SEQ ID NO: 26538 - DNA, 20 bp, Unknown
  RNA secondary structure sequence
ccgggagacttccggcaggg

SEQ ID NO: 26539 - DNA, 20 bp, Unknown
  RNA secondary structure sequence
aatgtggagctaggatcaag

SEQ ID NO: 26540 - DNA, 20 bp, Unknown
  RNA secondary structure sequence
atttctgtgtgcaggcgagc

SEQ ID NO: 26541 - DNA, 20 bp, Unknown
  RNA secondary structure sequence
ttatcactgcacctcttgcc

SEQ ID NO: 26542 - DNA, 20 bp, Unknown
  RNA secondary structure sequence
gatgtggcagactttgctcc

SEQ ID NO: 26543 - DNA, 20 bp, Unknown
  RNA secondary structure sequence
agcgggagagacaaaagtcg

SEQ ID NO: 26544 - DNA, 20 bp, Unknown
  RNA secondary structure sequence
gttttctttgctaagattat

SEQ ID NO: 26545 - DNA, 20 bp, Unknown
  RNA secondary structure sequence
aaagtgtttgaaaatgaaca

SEQ ID NO: 26546 - DNA, 20 bp, Unknown
  RNA secondary structure sequence
atggctcaggttgtgcgcag

SEQ ID NO: 26547 - DNA, 20 bp, Unknown
  RNA secondary structure sequence
aggagacttgacagcttaaa

SEQ ID NO: 26548 - DNA, 20 bp, Unknown
  RNA secondary structure sequence
ggtgtcggaggagaactgtg

SEQ ID NO: 26549 - DNA, 20 bp, Unknown
  RNA secondary structure sequence
taactggttcggcatgttcc

SEQ ID NO: 26550 - DNA, 20 bp, Unknown
  RNA secondary structure sequence
ttctttgaattccgtggtcc

SEQ ID NO: 26551 - DNA, 20 bp, Unknown
  RNA secondary structure sequence
actctgaggagcagttggag

SEQ ID NO: 26552 - DNA, 20 bp, Unknown
  RNA secondary structure sequence
tgtctgctcgggacacggct

SEQ ID NO: 26553 - DNA, 20 bp, Unknown
  RNA secondary structure sequence
ctgtggctacaggcttcagc

SEQ ID NO: 26554 - DNA, 20 bp, Unknown
  RNA secondary structure sequence
gaacaaggcagcggctcctt

SEQ ID NO: 26555 - DNA, 20 bp, Unknown
  RNA secondary structure sequence
tctctggcttctcagccttc

SEQ ID NO: 26556 - DNA, 20 bp, Unknown
  RNA secondary structure sequence
acttctttccccctttgcag

SEQ ID NO: 26557 - DNA, 20 bp, Unknown
  RNA secondary structure sequence
tggtgggcctcttcagtcac

SEQ ID NO: 26558 - DNA, 20 bp, Unknown
  RNA secondary structure sequence
gcttctcctcctttggtgag

SEQ ID NO: 26559 - DNA, 20 bp, Unknown
  RNA secondary structure sequence
gtgaggagatggaagaggaa

SEQ ID NO: 26560 - DNA, 20 bp, Unknown
  RNA secondary structure sequence
tgcccgtatctatcgtggcg

SEQ ID NO: 26561 - DNA, 20 bp, Unknown
  RNA secondary structure sequence
agccatgaggatgcttctgc

SEQ ID NO: 26562 - DNA, 20 bp, Unknown
  RNA secondary structure sequence
gcatcgccgccgccagagga

SEQ ID NO: 26563 - DNA, 20 bp, Unknown
  RNA secondary structure sequence
ttggactccgcccgtggagc

SEQ ID NO: 26564 - DNA, 20 bp, Unknown
  RNA secondary structure sequence
tttctgattgataggctttg

SEQ ID NO: 26565 - DNA, 20 bp, Unknown
  RNA secondary structure sequence
aaaaatgagggagagagaaa

SEQ ID NO: 26566 - DNA, 20 bp, Unknown
  RNA secondary structure sequence
acgttggaagaagacctggc

SEQ ID NO: 26567 - DNA, 20 bp, Unknown
  RNA secondary structure sequence
agattggcagggataagcag

SEQ ID NO: 26568 - DNA, 20 bp, Unknown
  RNA secondary structure sequence
acatccaacaagatcggcgt

SEQ ID NO: 26569 - DNA, 20 bp, Unknown
  RNA secondary structure sequence
aactccttgtgctagctgtg

SEQ ID NO: 26570 - DNA, 20 bp, Unknown
  RNA secondary structure sequence
tttctgttgcgggaagctcc

SEQ ID NO: 26571 - DNA, 20 bp, Unknown
  RNA secondary structure sequence
ttccagtgggcctgggccca

SEQ ID NO: 26572 - DNA, 20 bp, Unknown
  RNA secondary structure sequence
tgttgcacctgttcctccct

SEQ ID NO: 26573 - DNA, 20 bp, Unknown
  RNA secondary structure sequence
tctgccttcccagtgcataa

SEQ ID NO: 26574 - DNA, 20 bp, Unknown
  RNA secondary structure sequence
acctcagccagagtccggga

SEQ ID NO: 26575 - DNA, 20 bp, Unknown
  RNA secondary structure sequence
gcaaggcagacttcgtgctg

SEQ ID NO: 26576 - DNA, 20 bp, Unknown
  RNA secondary structure sequence
ttcgtttcttgccagatttg

SEQ ID NO: 26577 - DNA, 20 bp, Unknown
  RNA secondary structure sequence
tcgaccccagccagcgcagc

SEQ ID NO: 26578 - DNA, 20 bp, Unknown
  RNA secondary structure sequence
taaacatggccgtcaccgac

SEQ ID NO: 26579 - DNA, 20 bp, Unknown
  RNA secondary structure sequence
ggacaaccttctcctgacag

SEQ ID NO: 26580 - DNA, 20 bp, Unknown
  RNA secondary structure sequence
ggcctggtgtgaatgctccg

SEQ ID NO: 26581 - DNA, 20 bp, Unknown
  RNA secondary structure sequence
cgctcgactggcctaggagc

SEQ ID NO: 26582 - DNA, 20 bp, Unknown
  RNA secondary structure sequence
cctttccttctgctgctact

SEQ ID NO: 26583 - DNA, 20 bp, Unknown
  RNA secondary structure sequence
ggagtggagcttggtttcgg

SEQ ID NO: 26584 - DNA, 20 bp, Unknown
  RNA secondary structure sequence
caggcacccgtgtggctgcc

SEQ ID NO: 26585 - DNA, 20 bp, Unknown
  RNA secondary structure sequence
cctgtctaccatgttctctg

SEQ ID NO: 26586 - DNA, 20 bp, Unknown
  RNA secondary structure sequence
ggctgactcaactgaaatca

SEQ ID NO: 26587 - DNA, 20 bp, Unknown
  RNA secondary structure sequence
gtggtctgtacaggcggcac

SEQ ID NO: 26588 - DNA, 20 bp, Unknown
  RNA secondary structure sequence
gcagctcatggagaggctga

SEQ ID NO: 26589 - DNA, 20 bp, Unknown
  RNA secondary structure sequence
taagaagccgccccaactcc

SEQ ID NO: 26590 - DNA, 20 bp, Unknown
  RNA secondary structure sequence
tgtatgcacaaagcagggtc

SEQ ID NO: 26591 - DNA, 20 bp, Unknown
  RNA secondary structure sequence
tcgttagcaccctttagcgt

SEQ ID NO: 26592 - DNA, 20 bp, Unknown
  RNA secondary structure sequence
acgagagatccaatgaaagt

SEQ ID NO: 26593 - DNA, 20 bp, Unknown
  RNA secondary structure sequence
gctaatacaacaaatagcaa

SEQ ID NO: 26594 - DNA, 20 bp, Unknown
  RNA secondary structure sequence
actcggcctataaacatcag

SEQ ID NO: 26595 - DNA, 20 bp, Unknown
  RNA secondary structure sequence
cgcatctgagccagccacgc

SEQ ID NO: 26596 - DNA, 20 bp, Unknown
  RNA secondary structure sequence
tagtagatggattacacggt

SEQ ID NO: 26597 - DNA, 20 bp, Unknown
  RNA secondary structure sequence
tcggtgtaccccccccggtg

SEQ ID NO: 26598 - DNA, 20 bp, Unknown
  RNA secondary structure sequence
cacgcgcggtctctgcggaa

SEQ ID NO: 26599 - DNA, 20 bp, Unknown
  RNA secondary structure sequence
gcacatggcggccaatctgt

SEQ ID NO: 26600 - DNA, 20 bp, Unknown
  RNA secondary structure sequence
agagccgcaatgctggagcc

SEQ ID NO: 26601 - DNA, 20 bp, Unknown
  RNA secondary structure sequence
aggccccatggagaaaggtc

SEQ ID NO: 26602 - DNA, 20 bp, Unknown
  RNA secondary structure sequence
cgaggggatcgcccctgaag

SEQ ID NO: 26603 - DNA, 20 bp, Unknown
  RNA secondary structure sequence
catggccggtcacactaaat

SEQ ID NO: 26604 - DNA, 20 bp, Unknown
  RNA secondary structure sequence
accattaatcctgcgacctg

SEQ ID NO: 26605 - DNA, 20 bp, Unknown
  RNA secondary structure sequence
cgacaagaggtgggcgacct

SEQ ID NO: 26606 - DNA, 20 bp, Unknown
  RNA secondary structure sequence
cctaaattacccaccccccg

SEQ ID NO: 26607 - DNA, 20 bp, Unknown
  RNA secondary structure sequence
tcgcccccttgtgtctttac

SEQ ID NO: 26608 - DNA, 20 bp, Unknown
  RNA secondary structure sequence
ccacttggcatccctcccct

SEQ ID NO: 26609 - DNA, 20 bp, Unknown
  RNA secondary structure sequence
attccggcgcctgcgaagca

SEQ ID NO: 26610 - DNA, 20 bp, Unknown
  RNA secondary structure sequence
atcgcacgactagggatggg

SEQ ID NO: 26611 - DNA, 20 bp, Unknown
  RNA secondary structure sequence
gggggtgcagcctcagaatg

SEQ ID NO: 26612 - DNA, 20 bp, Unknown
  RNA secondary structure sequence
atcacatggttgtagtatta

SEQ ID NO: 26613 - DNA, 20 bp, Unknown
  RNA secondary structure sequence
cagggtgtatacgttagttc

SEQ ID NO: 26614 - DNA, 20 bp, Unknown
  RNA secondary structure sequence
ccgcacgcggcatctgcctt

SEQ ID NO: 26615 - DNA, 20 bp, Unknown
  RNA secondary structure sequence
gcccccgatttgacgggcag

SEQ ID NO: 26616 - DNA, 20 bp, Unknown
  RNA secondary structure sequence
tagttctcctcccaggctag

SEQ ID NO: 26617 - DNA, 20 bp, Unknown
  RNA secondary structure sequence
ctcgaccccaaatcccctgt

SEQ ID NO: 26618 - DNA, 20 bp, Unknown
  RNA secondary structure sequence
ccgccacctgtgtccgtgtc

SEQ ID NO: 26619 - DNA, 20 bp, Unknown
  RNA secondary structure sequence
ccgtcacgccgaccagcgat

SEQ ID NO: 26620 - DNA, 20 bp, Unknown
  RNA secondary structure sequence
atccgctcgtcagcccaccg

SEQ ID NO: 26621 - DNA, 20 bp, Unknown
  RNA secondary structure sequence
acgtcgggccccccttagtc

SEQ ID NO: 26622 - DNA, 20 bp, Unknown
  RNA secondary structure sequence
cggtgtgctgtctggtccca

SEQ ID NO: 26623 - DNA, 20 bp, Unknown
  RNA secondary structure sequence
cgtgtaccccggtgcaccct

SEQ ID NO: 26624 - DNA, 20 bp, Unknown
  RNA secondary structure sequence
ccgcttgactaccaccaggt

SEQ ID NO: 26625 - DNA, 20 bp, Unknown
  RNA secondary structure sequence
ctctgctaaccgcaacgccg

SEQ ID NO: 26626 - DNA, 20 bp, Unknown
  RNA secondary structure sequence
ccacgttcccccagaagcga

SEQ ID NO: 26627 - DNA, 20 bp, Unknown
  RNA secondary structure sequence
ccacgcttccgccgcagggc

SEQ ID NO: 26628 - DNA, 20 bp, Unknown
  RNA secondary structure sequence
accgcgaagagacgggaaat

SEQ ID NO: 26629 - DNA, 20 bp, Unknown
  RNA secondary structure sequence
tgtgtttatactacgagtat

SEQ ID NO: 26630 - DNA, 20 bp, Unknown
  RNA secondary structure sequence
agcgctaagcgctcgtgccc

SEQ ID NO: 26631 - DNA, 20 bp, Unknown
  RNA secondary structure sequence
tgctttcctagtaacaatgg

SEQ ID NO: 26632 - DNA, 20 bp, Unknown
  RNA secondary structure sequence
agtccactcatagaatatct

SEQ ID NO: 26633 - DNA, 20 bp, Unknown
  RNA secondary structure sequence
tgaaatgggacctcctgcag

SEQ ID NO: 26634 - DNA, 20 bp, Unknown
  RNA secondary structure sequence
gagatatgcgataactaagt

SEQ ID NO: 26635 - DNA, 20 bp, Unknown
  RNA secondary structure sequence
gtccctgctcgagtgtcggg

SEQ ID NO: 26636 - DNA, 20 bp, Unknown
  RNA secondary structure sequence
ggttggcgcgtgggtccggg

SEQ ID NO: 26637 - DNA, 20 bp, Unknown
  RNA secondary structure sequence
cggggtctggcactagtcac

SEQ ID NO: 26638 - DNA, 20 bp, Unknown
  RNA secondary structure sequence
ttatacgaacccactttatt

SEQ ID NO: 26639 - DNA, 20 bp, Unknown
  RNA secondary structure sequence
gacaggagtgcggactttga

SEQ ID NO: 26640 - DNA, 20 bp, Unknown
  RNA secondary structure sequence
tgataataattaccctgtct

SEQ ID NO: 26641 - DNA, 20 bp, Unknown
  RNA secondary structure sequence
tgtcgtagcgtaaaacccgc

SEQ ID NO: 26642 - DNA, 20 bp, Unknown
  RNA secondary structure sequence
agagaagccgtaaacgaagt

SEQ ID NO: 26643 - DNA, 20 bp, Unknown
  RNA secondary structure sequence
ttatgtttaacttcacgaaa

SEQ ID NO: 26644 - DNA, 20 bp, Unknown
  RNA secondary structure sequence
ggtaatagagttatatattt

SEQ ID NO: 26645 - DNA, 20 bp, Unknown
  RNA secondary structure sequence
tacatcataccagaatcacc

SEQ ID NO: 26646 - DNA, 20 bp, Unknown
  RNA secondary structure sequence
gccacgattttggctttggt

SEQ ID NO: 26647 - DNA, 20 bp, Unknown
  RNA secondary structure sequence
gataaggacaaagagcatac

SEQ ID NO: 26648 - DNA, 20 bp, Unknown
  RNA secondary structure sequence
gcgtgctaagataggtaaga

SEQ ID NO: 26649 - DNA, 20 bp, Unknown
  RNA secondary structure sequence
ctttgcaccggtgtcgttgt

SEQ ID NO: 26650 - DNA, 20 bp, Unknown
  RNA secondary structure sequence
ctacgcgggtttctggcgaa

SEQ ID NO: 26651 - DNA, 20 bp, Unknown
  RNA secondary structure sequence
ccatggattgggtggcccac

SEQ ID NO: 26652 - DNA, 20 bp, Unknown
  RNA secondary structure sequence
caagcgcgcagcagggatcc

SEQ ID NO: 26653 - DNA, 20 bp, Unknown
  RNA secondary structure sequence
gaaagtgtggtggtatacgt

SEQ ID NO: 26654 - DNA, 20 bp, Unknown
  RNA secondary structure sequence
acccccagctctgggggcga

SEQ ID NO: 26655 - DNA, 20 bp, Unknown
  RNA secondary structure sequence
aagttcggtgaggttgtact

SEQ ID NO: 26656 - DNA, 20 bp, Unknown
  RNA secondary structure sequence
gtatctagatgatcaagagg

SEQ ID NO: 26657 - DNA, 20 bp, Unknown
  RNA secondary structure sequence
tagttctagcgaaatcctga

SEQ ID NO: 26658 - DNA, 20 bp, Unknown
  RNA secondary structure sequence
aactaacagactcaaacaag

SEQ ID NO: 26659 - DNA, 20 bp, Unknown
  RNA secondary structure sequence
aaggtaccccattgtatggg

SEQ ID NO: 26660 - DNA, 20 bp, Unknown
  RNA secondary structure sequence
agttatttttatgtcataag

SEQ ID NO: 26661 - DNA, 20 bp, Unknown
  RNA secondary structure sequence
aaagcgaaagggaaaccaga

SEQ ID NO: 26662 - DNA, 20 bp, Unknown
  RNA secondary structure sequence
actcctgttgccgtttccct

SEQ ID NO: 26663 - DNA, 20 bp, Unknown
  RNA secondary structure sequence
acagtacccgaagatggcag

SEQ ID NO: 26664 - DNA, 20 bp, Unknown
  RNA secondary structure sequence
acagccgggacgccgaggcg

SEQ ID NO: 26665 - DNA, 20 bp, Unknown
  RNA secondary structure sequence
gcggatgaagaagaaaaccc

SEQ ID NO: 26666 - DNA, 20 bp, Unknown
  RNA secondary structure sequence
ccccctcgtccaagaatgca

SEQ ID NO: 26667 - DNA, 20 bp, Unknown
  RNA secondary structure sequence
ggatcctgaggaggcagctg

SEQ ID NO: 26668 - DNA, 20 bp, Unknown
  RNA secondary structure sequence
gggtggggagttggcccaga

SEQ ID NO: 26669 - DNA, 20 bp, Unknown
  RNA secondary structure sequence
gccttctcagccccgccagc

SEQ ID NO: 26670 - DNA, 20 bp, Unknown
  RNA secondary structure sequence
ctgcagcagcctgcctgcag

SEQ ID NO: 26671 - DNA, 20 bp, Unknown
  RNA secondary structure sequence
ttgagttggtgggggttttg

SEQ ID NO: 26672 - DNA, 20 bp, Unknown
  RNA secondary structure sequence
cgaacctgtgcggctgcagg

SEQ ID NO: 26673 - DNA, 20 bp, Unknown
  RNA secondary structure sequence
ttgtccccgggtcttccaac

SEQ ID NO: 26674 - DNA, 20 bp, Unknown
  RNA secondary structure sequence
ctttgggctcgggggctccc

SEQ ID NO: 26675 - DNA, 20 bp, Unknown
  RNA secondary structure sequence
aaggctctggatggtgtact

SEQ ID NO: 26676 - DNA, 20 bp, Unknown
  RNA secondary structure sequence
aggacatttaaagctaaatt

SEQ ID NO: 26677 - DNA, 20 bp, Unknown
  RNA secondary structure sequence
attacgccgcttttgaaaaa

SEQ ID NO: 26678 - DNA, 20 bp, Unknown
  RNA secondary structure sequence
agaatgtaaaagagccagag

SEQ ID NO: 26679 - DNA, 20 bp, Unknown
  RNA secondary structure sequence
ccacatccaggcagcgcagg

SEQ ID NO: 26680 - DNA, 20 bp, Unknown
  RNA secondary structure sequence
tgccgctgcgcagcagtatc

SEQ ID NO: 26681 - DNA, 20 bp, Unknown
  RNA secondary structure sequence
gatctacaatttgaagtact

SEQ ID NO: 26682 - DNA, 20 bp, Unknown
  RNA secondary structure sequence
ataggtgaccggaggccggc

SEQ ID NO: 26683 - DNA, 20 bp, Unknown
  RNA secondary structure sequence
aagccgtgtattcccccgca

SEQ ID NO: 26684 - DNA, 20 bp, Unknown
  RNA secondary structure sequence
gtgctaaaaaatcaaaaaac

SEQ ID NO: 26685 - DNA, 20 bp, Unknown
  RNA secondary structure sequence
cggagagctatcgtgctgag

SEQ ID NO: 26686 - DNA, 20 bp, Unknown
  RNA secondary structure sequence
caaaagaatggagagaacag

SEQ ID NO: 26687 - DNA, 20 bp, Unknown
  RNA secondary structure sequence
caggtagttggtctatcaac

SEQ ID NO: 26688 - DNA, 20 bp, Unknown
  RNA secondary structure sequence
ccctcttaccaattcaaggg

SEQ ID NO: 26689 - DNA, 20 bp, Unknown
  RNA secondary structure sequence
gtttgcgcttgtcggcatct

SEQ ID NO: 26690 - DNA, 20 bp, Unknown
  RNA secondary structure sequence
ccgcacgcacccaccgggac

SEQ ID NO: 26691 - DNA, 20 bp, Unknown
  RNA secondary structure sequence
taacagaaatggttccggag

SEQ ID NO: 26692 - DNA, 20 bp, Unknown
  RNA secondary structure sequence
tgaatgcatcctgtgcagcc

SEQ ID NO: 26693 - DNA, 20 bp, Unknown
  RNA secondary structure sequence
ttaatgcatcctgtgcagca

SEQ ID NO: 26694 - DNA, 20 bp, Unknown
  RNA secondary structure sequence
ccaaggccattagaagccaa

SEQ ID NO: 26695 - DNA, 20 bp, Unknown
  RNA secondary structure sequence
cgaggagatctggagctgct

SEQ ID NO: 26696 - DNA, 20 bp, Unknown
  RNA secondary structure sequence
actcgggtggtggccgctga

SEQ ID NO: 26697 - DNA, 20 bp, Unknown
  RNA secondary structure sequence
tctatagacgaacgtgtcat

SEQ ID NO: 26698 - DNA, 20 bp, Unknown
  RNA secondary structure sequence
gtacccccgtcgttggcgtg

SEQ ID NO: 26699 - DNA, 20 bp, Unknown
  RNA secondary structure sequence
agtccgggactttttgaagc

SEQ ID NO: 26700 - DNA, 20 bp, Unknown
  RNA secondary structure sequence
acgccactcgatctcgctcc

SEQ ID NO: 26701 - DNA, 20 bp, Unknown
  RNA secondary structure sequence
gaatattaataaatatcttc

SEQ ID NO: 26702 - DNA, 20 bp, Unknown
  RNA secondary structure sequence
atggcgggaccgtcgattcc

SEQ ID NO: 26703 - DNA, 20 bp, Unknown
  RNA secondary structure sequence
atggcgggaccgttgattcc

SEQ ID NO: 26704 - DNA, 20 bp, Unknown
  RNA secondary structure sequence
tagggactgttctcttcagt

SEQ ID NO: 26705 - DNA, 20 bp, Unknown
  RNA secondary structure sequence
cttgcacctattaaagaggg

SEQ ID NO: 26706 - DNA, 20 bp, Unknown
  RNA secondary structure sequence
tcgtcggaaacgagaagaca

SEQ ID NO: 26707 - DNA, 20 bp, Unknown
  RNA secondary structure sequence
cggttgctgcttgctgtcct

SEQ ID NO: 26708 - DNA, 20 bp, Unknown
  RNA secondary structure sequence
gctttggaagcagttagatc

SEQ ID NO: 26709 - DNA, 20 bp, Unknown
  RNA secondary structure sequence
atgcctacctgacctcccac

SEQ ID NO: 26710 - DNA, 20 bp, Unknown
  RNA secondary structure sequence
ttgcaaattatttaaaaggt

SEQ ID NO: 26711 - DNA, 20 bp, Unknown
  RNA secondary structure sequence
agaagccaagaggaccccgg

SEQ ID NO: 26712 - DNA, 20 bp, Unknown
  RNA secondary structure sequence
aaataagggtgcatgagggg

SEQ ID NO: 26713 - DNA, 20 bp, Unknown
  RNA secondary structure sequence
agcagatctgaggacatctc

SEQ ID NO: 26714 - DNA, 20 bp, Unknown
  RNA secondary structure sequence
tcgatatcgtcgatcccatt

SEQ ID NO: 26715 - DNA, 20 bp, Unknown
  RNA secondary structure sequence
atgtaaagacttgcagatga

SEQ ID NO: 26716 - DNA, 20 bp, Unknown
  RNA secondary structure sequence
ggctaaaacggtttccgccc

SEQ ID NO: 26717 - DNA, 20 bp, Unknown
  RNA secondary structure sequence
tgacaataacatattcatcc

SEQ ID NO: 26718 - DNA, 20 bp, Unknown
  RNA secondary structure sequence
acgagcaacaccggctcttt

SEQ ID NO: 26719 - DNA, 20 bp, Unknown
  RNA secondary structure sequence
gtacctttttgctcacacca

SEQ ID NO: 26720 - DNA, 20 bp, Unknown
  RNA secondary structure sequence
ttccgtgtagaagggcacac

SEQ ID NO: 26721 - DNA, 20 bp, Unknown
  RNA secondary structure sequence
ggttgaaggtatcttcagac

SEQ ID NO: 26722 - DNA, 20 bp, Unknown
  RNA secondary structure sequence
cgtgtgtcggtcgcctagtc

SEQ ID NO: 26723 - DNA, 20 bp, Unknown
  RNA secondary structure sequence
ttctatctatcccggccata

SEQ ID NO: 26724 - DNA, 20 bp, Unknown
  RNA secondary structure sequence
tatgactactgacaatctta

SEQ ID NO: 26725 - DNA, 20 bp, Unknown
  RNA secondary structure sequence
cagatggagaggagaaaacc

SEQ ID NO: 26726 - DNA, 20 bp, Unknown
  RNA secondary structure sequence
ccagcggtcataaaagaatt

SEQ ID NO: 26727 - DNA, 20 bp, Unknown
  RNA secondary structure sequence
ccccacgcactacgtgccgg

SEQ ID NO: 26728 - DNA, 20 bp, Unknown
  RNA secondary structure sequence
cagaagtttggacagctcaa

SEQ ID NO: 26729 - DNA, 20 bp, Unknown
  RNA secondary structure sequence
tggctcgggaggcaactcag

SEQ ID NO: 26730 - DNA, 20 bp, Unknown
  RNA secondary structure sequence
ctatccacgctatcattgct

SEQ ID NO: 26731 - DNA, 20 bp, Unknown
  RNA secondary structure sequence
acaaaagatatggacccgca

SEQ ID NO: 26732 - DNA, 20 bp, Unknown
  RNA secondary structure sequence
acatgtgtgaaaggcgagcc

SEQ ID NO: 26733 - DNA, 20 bp, Unknown
  RNA secondary structure sequence
tgtgcgaataactatgagga

SEQ ID NO: 26734 - DNA, 20 bp, Unknown
  RNA secondary structure sequence
gaagtagcagctcacacgcc

SEQ ID NO: 26735 - DNA, 20 bp, Unknown
  RNA secondary structure sequence
aagatgtcaatatgggtgca

SEQ ID NO: 26736 - DNA, 20 bp, Unknown
  RNA secondary structure sequence
cctttgggggctacctgtac

SEQ ID NO: 26737 - DNA, 20 bp, Unknown
  RNA secondary structure sequence
cccacgggggttacttgcac

SEQ ID NO: 26738 - DNA, 20 bp, Unknown
  RNA secondary structure sequence
gccaagtgtgtttgaagaac

SEQ ID NO: 26739 - DNA, 20 bp, Unknown
  RNA secondary structure sequence
tgcttctgattgtgaacgtt

SEQ ID NO: 26740 - DNA, 20 bp, Unknown
  RNA secondary structure sequence
gtccgtgtttcttttgttca

SEQ ID NO: 26741 - DNA, 20 bp, Unknown
  RNA secondary structure sequence
atccttgcgaccacgttggc

SEQ ID NO: 26742 - DNA, 20 bp, Unknown
  RNA secondary structure sequence
acgtggggagctcaactggt

SEQ ID NO: 26743 - DNA, 20 bp, Unknown
  RNA secondary structure sequence
ggtgttcgggtatgaggctg

SEQ ID NO: 26744 - DNA, 20 bp, Unknown
  RNA secondary structure sequence
ttcacgctcaccgtgcccag

SEQ ID NO: 26745 - DNA, 20 bp, Unknown
  RNA secondary structure sequence
aaaaaccttaaaggctggtc

SEQ ID NO: 26746 - DNA, 20 bp, Unknown
  RNA secondary structure sequence
tgtgtcaagctttcaggtag

SEQ ID NO: 26747 - DNA, 20 bp, Unknown
  RNA secondary structure sequence
aaatcatggcgtcccaaggc

SEQ ID NO: 26748 - DNA, 20 bp, Unknown
  RNA secondary structure sequence
gacaatgcttcaacccgatg

SEQ ID NO: 26749 - DNA, 20 bp, Unknown
  RNA secondary structure sequence
tcagctaggacaacaacagc

SEQ ID NO: 26750 - DNA, 20 bp, Unknown
  RNA secondary structure sequence
gggcgagcatcgggtcatcg

SEQ ID NO: 26751 - DNA, 20 bp, Unknown
  RNA secondary structure sequence
agactctgaggcaggacagg

SEQ ID NO: 26752 - DNA, 20 bp, Unknown
  RNA secondary structure sequence
gcagttccgctggctagtgt

SEQ ID NO: 26753 - DNA, 20 bp, Unknown
  RNA secondary structure sequence
caatgatctggagtgtcccg

SEQ ID NO: 26754 - DNA, 20 bp, Unknown
  RNA secondary structure sequence
ggaagcaaattggaaatgac

SEQ ID NO: 26755 - DNA, 20 bp, Unknown
  RNA secondary structure sequence
ggatcaacgtggaccgcatt

SEQ ID NO: 26756 - DNA, 20 bp, Unknown
  RNA secondary structure sequence
acggctggatgggacactag

SEQ ID NO: 26757 - DNA, 20 bp, Unknown
  RNA secondary structure sequence
gccggcggtgctccttctgc

SEQ ID NO: 26758 - DNA, 20 bp, Unknown
  RNA secondary structure sequence
gtagtggtaagaaagcgcca

SEQ ID NO: 26759 - DNA, 20 bp, Unknown
  RNA secondary structure sequence
tggatccactactctcgact

SEQ ID NO: 26760 - DNA, 20 bp, Unknown
  RNA secondary structure sequence
gcagcctagcactagaaggc

SEQ ID NO: 26761 - DNA, 20 bp, Unknown
  RNA secondary structure sequence
ctcggtgcgcttgtcatttc

SEQ ID NO: 26762 - DNA, 20 bp, Unknown
  RNA secondary structure sequence
gcgctagcgatacgctcgac

SEQ ID NO: 26763 - DNA, 20 bp, Unknown
  RNA secondary structure sequence
ctcgatatcttcgacgatag

SEQ ID NO: 26764 - DNA, 20 bp, Unknown
  RNA secondary structure sequence
cagagtcgcaattgacaata

SEQ ID NO: 26765 - DNA, 20 bp, Unknown
  RNA secondary structure sequence
agtgcggatttctatcgaag

SEQ ID NO: 26766 - DNA, 20 bp, Unknown
  RNA secondary structure sequence
ggactgctctgccggggcgg

SEQ ID NO: 26767 - DNA, 20 bp, Unknown
  RNA secondary structure sequence
gagtcgcgggacccccggtt

SEQ ID NO: 26768 - DNA, 20 bp, Unknown
  RNA secondary structure sequence
ccgttctctgtgggctcaaa

SEQ ID NO: 26769 - DNA, 20 bp, Unknown
  RNA secondary structure sequence
gcatagtctcgccgcgcgtc

SEQ ID NO: 26770 - DNA, 20 bp, Unknown
  RNA secondary structure sequence
cgaatcaaccctatctactg

SEQ ID NO: 26771 - DNA, 20 bp, Unknown
  RNA secondary structure sequence
ttctgtcatttgtctgttca

SEQ ID NO: 26772 - DNA, 20 bp, Unknown
  RNA secondary structure sequence
ataccaaacttcgacgcaat

SEQ ID NO: 26773 - DNA, 20 bp, Unknown
  RNA secondary structure sequence
acgtggttgctggtcaggaa

SEQ ID NO: 26774 - DNA, 20 bp, Unknown
  RNA secondary structure sequence
gtatccaataaaccctcttg

SEQ ID NO: 26775 - DNA, 20 bp, Unknown
  RNA secondary structure sequence
tgataatctcgcggtggaga

SEQ ID NO: 26776 - DNA, 20 bp, Unknown
  RNA secondary structure sequence
tctttcttggtttggtgctt

SEQ ID NO: 26777 - DNA, 20 bp, Unknown
  RNA secondary structure sequence
gtcgcgccgcgcgttctttc

SEQ ID NO: 26778 - DNA, 20 bp, Unknown
  RNA secondary structure sequence
ccccaaaccaagtggtcttg

SEQ ID NO: 26779 - DNA, 20 bp, Unknown
  RNA secondary structure sequence
cggaggctctcttcagtaaa

SEQ ID NO: 26780 - DNA, 20 bp, Unknown
  RNA secondary structure sequence
acatggacgaaccctggccc

SEQ ID NO: 26781 - DNA, 20 bp, Unknown
  RNA secondary structure sequence
aatttccaccaagtggagac

SEQ ID NO: 26782 - DNA, 20 bp, Unknown
  RNA secondary structure sequence
attctcggtatccatgtcgc

SEQ ID NO: 26783 - DNA, 20 bp, Unknown
  RNA secondary structure sequence
tcccctgcctttggcgcctt

SEQ ID NO: 26784 - DNA, 20 bp, Unknown
  RNA secondary structure sequence
cttcgcacaccgcgacgctc

SEQ ID NO: 26785 - DNA, 20 bp, Unknown
  RNA secondary structure sequence
catcacccagggcacgatcc

SEQ ID NO: 26786 - DNA, 20 bp, Unknown
  RNA secondary structure sequence
gggtgctggtcaccggggca

SEQ ID NO: 26787 - DNA, 20 bp, Unknown
  RNA secondary structure sequence
gccggttgctgagccgggag

SEQ ID NO: 26788 - DNA, 20 bp, Unknown
  RNA secondary structure sequence
aacatggacttcccgtgcct

SEQ ID NO: 26789 - DNA, 20 bp, Unknown
  RNA secondary structure sequence
atggacgtatctagtggttc

SEQ ID NO: 26790 - DNA, 20 bp, Unknown
  RNA secondary structure sequence
agacggcagcgaactcgtcg

SEQ ID NO: 26791 - DNA, 20 bp, Unknown
  RNA secondary structure sequence
ctacagcgggggagacattt

SEQ ID NO: 26792 - DNA, 20 bp, Unknown
  RNA secondary structure sequence
tcatcaacacaattttgaat

SEQ ID NO: 26793 - DNA, 20 bp, Unknown
  RNA secondary structure sequence
tccgcgtcgctagctagtcg

SEQ ID NO: 26794 - DNA, 20 bp, Unknown
  RNA secondary structure sequence
ccgtaccctaagatacgggg

SEQ ID NO: 26795 - DNA, 20 bp, Unknown
  RNA secondary structure sequence
agaataaatttgcaggtcaa

SEQ ID NO: 26796 - DNA, 20 bp, Unknown
  RNA secondary structure sequence
tatctcttgctggaaaaatc

SEQ ID NO: 26797 - DNA, 20 bp, Unknown
  RNA secondary structure sequence
cacgcgcttttgtatcagag

SEQ ID NO: 26798 - DNA, 20 bp, Unknown
  RNA secondary structure sequence
ttccccatccccttcccaac

SEQ ID NO: 26799 - DNA, 20 bp, Unknown
  RNA secondary structure sequence
cgcgcgcctttgtctcagag

SEQ ID NO: 26800 - DNA, 20 bp, Unknown
  RNA secondary structure sequence
gaactctgcaatttattgag

SEQ ID NO: 26801 - DNA, 20 bp, Unknown
  RNA secondary structure sequence
cccttgcgagtgaacaccac

SEQ ID NO: 26802 - DNA, 20 bp, Unknown
  RNA secondary structure sequence
gcctgtctggccctgttgct

SEQ ID NO: 26803 - DNA, 20 bp, Unknown
  RNA secondary structure sequence
cagcttaatcaactgacccg

SEQ ID NO: 26804 - DNA, 20 bp, Unknown
  RNA secondary structure sequence
cgctgtctccctggagttct

SEQ ID NO: 26805 - DNA, 20 bp, Unknown
  RNA secondary structure sequence
ttccagcagttggggccacg

SEQ ID NO: 26806 - DNA, 20 bp, Unknown
  RNA secondary structure sequence
gggagagttgggagagtaaa

SEQ ID NO: 26807 - DNA, 20 bp, Unknown
  RNA secondary structure sequence
ggatctggataaagatacat

SEQ ID NO: 26808 - DNA, 20 bp, Unknown
  RNA secondary structure sequence
gcctaaaagagcaaggacta

SEQ ID NO: 26809 - DNA, 20 bp, Unknown
  RNA secondary structure sequence
attttccggcccaggctaag

SEQ ID NO: 26810 - DNA, 20 bp, Unknown
  RNA secondary structure sequence
aagagtgtgttctgccaggg

SEQ ID NO: 26811 - DNA, 20 bp, Unknown
  RNA secondary structure sequence
gaagggctattgcaacaccc

SEQ ID NO: 26812 - DNA, 20 bp, Unknown
  RNA secondary structure sequence
gctgttccagtcaacgctag

SEQ ID NO: 26813 - DNA, 20 bp, Unknown
  RNA secondary structure sequence
gcaatctcggctgtctgtac

SEQ ID NO: 26814 - DNA, 20 bp, Unknown
  RNA secondary structure sequence
caggaaatttcctcctccta

SEQ ID NO: 26815 - DNA, 20 bp, Unknown
  RNA secondary structure sequence
cctggatctgtctgacagcg

SEQ ID NO: 26816 - DNA, 20 bp, Unknown
  RNA secondary structure sequence
ggcctagggctccgcttgac

SEQ ID NO: 26817 - DNA, 20 bp, Unknown
  RNA secondary structure sequence
acagtgacaggtatcttttt

SEQ ID NO: 26818 - DNA, 20 bp, Unknown
  RNA secondary structure sequence
ccctgtattaatatggggac

SEQ ID NO: 26819 - DNA, 20 bp, Unknown
  RNA secondary structure sequence
ttctgctacgtcattaccag

SEQ ID NO: 26820 - DNA, 20 bp, Unknown
  RNA secondary structure sequence
agtagcaagaccgggaatag

SEQ ID NO: 26821 - DNA, 20 bp, Unknown
  RNA secondary structure sequence
atctctagcatgaccagacc

SEQ ID NO: 26822 - DNA, 20 bp, Unknown
  RNA secondary structure sequence
tggagacaacatgtggttct

SEQ ID NO: 26823 - DNA, 20 bp, Unknown
  RNA secondary structure sequence
tcagtctgtgtttactctca

SEQ ID NO: 26824 - DNA, 20 bp, Unknown
  RNA secondary structure sequence
cgcgcacctcatggttccgg

SEQ ID NO: 26825 - DNA, 20 bp, Unknown
  RNA secondary structure sequence
gtggcgtagtactctggtat

SEQ ID NO: 26826 - DNA, 20 bp, Unknown
  RNA secondary structure sequence
aaaatcctccctgagagagc

SEQ ID NO: 26827 - DNA, 20 bp, Unknown
  RNA secondary structure sequence
gtggcgtagtacttggtatt

SEQ ID NO: 26828 - DNA, 20 bp, Unknown
  RNA secondary structure sequence
tgggcgctagcactctgatt

SEQ ID NO: 26829 - DNA, 20 bp, Unknown
  RNA secondary structure sequence
tgggcgctagtacactgata

SEQ ID NO: 26830 - DNA, 20 bp, Unknown
  RNA secondary structure sequence
gggcgctagcactctggtat

SEQ ID NO: 26831 - DNA, 20 bp, Unknown
  RNA secondary structure sequence
tgggcgctagtacactggta

SEQ ID NO: 26832 - DNA, 20 bp, Unknown
  RNA secondary structure sequence
gtgaggattaacaacaatta

SEQ ID NO: 26833 - DNA, 20 bp, Unknown
  RNA secondary structure sequence
ttccctccacccgcagtaac

SEQ ID NO: 26834 - DNA, 20 bp, Unknown
  RNA secondary structure sequence
tcacgcgttgtcgcgagctc

SEQ ID NO: 26835 - DNA, 20 bp, Unknown
  RNA secondary structure sequence
ttcgtctccgatgattatga

SEQ ID NO: 26836 - DNA, 20 bp, Unknown
  RNA secondary structure sequence
tcctcctcgcccccacccag

SEQ ID NO: 26837 - DNA, 20 bp, Unknown
  RNA secondary structure sequence
agagatttgaacatgagtat

SEQ ID NO: 26838 - DNA, 20 bp, Unknown
  RNA secondary structure sequence
gtggcggctagtactccggt

SEQ ID NO: 26839 - DNA, 20 bp, Unknown
  RNA secondary structure sequence
ggtcccctccacggaggacc

SEQ ID NO: 26840 - DNA, 20 bp, Unknown
  RNA secondary structure sequence
aatgttcatttcaagccgac

SEQ ID NO: 26841 - DNA, 20 bp, Unknown
  RNA secondary structure sequence
gtcaccgaaataaattcgca

SEQ ID NO: 26842 - DNA, 20 bp, Unknown
  RNA secondary structure sequence
ggagtggtagtgggggctgc

SEQ ID NO: 26843 - DNA, 20 bp, Unknown
  RNA secondary structure sequence
gagtcgcggctggccgactc

SEQ ID NO: 26844 - DNA, 20 bp, Unknown
  RNA secondary structure sequence
tcctgggaatcttcaatcat

SEQ ID NO: 26845 - DNA, 20 bp, Unknown
  RNA secondary structure sequence
ggagcaggacccataaggtt

SEQ ID NO: 26846 - DNA, 20 bp, Unknown
  RNA secondary structure sequence
tacttcattctgcactcaaa

SEQ ID NO: 26847 - DNA, 20 bp, Unknown
  RNA secondary structure sequence
gagcaactctattctagatc

SEQ ID NO: 26848 - DNA, 20 bp, Unknown
  RNA secondary structure sequence
tgtcattttggcagatagtc

SEQ ID NO: 26849 - DNA, 20 bp, Unknown
  RNA secondary structure sequence
aagttttcgacgtggtcaga

SEQ ID NO: 26850 - DNA, 20 bp, Unknown
  RNA secondary structure sequence
gtcacgaaggggagggaata

SEQ ID NO: 26851 - DNA, 20 bp, Unknown
  RNA secondary structure sequence
gtgggtggctgcccagctcg

SEQ ID NO: 26852 - DNA, 20 bp, Unknown
  RNA secondary structure sequence
tcttctcgactgactccatg

SEQ ID NO: 26853 - DNA, 20 bp, Unknown
  RNA secondary structure sequence
cgccactcttgggagaggaa

SEQ ID NO: 26854 - DNA, 20 bp, Unknown
  RNA secondary structure sequence
gggatgtcaaattcctggtc

SEQ ID NO: 26855 - DNA, 20 bp, Unknown
  RNA secondary structure sequence
ccacgggacgctagttgtga

SEQ ID NO: 26856 - DNA, 20 bp, Unknown
  RNA secondary structure sequence
gcgtcggagggagctctact

SEQ ID NO: 26857 - DNA, 20 bp, Unknown
  RNA secondary structure sequence
ggccacaatctttttgatct

SEQ ID NO: 26858 - DNA, 20 bp, Unknown
  RNA secondary structure sequence
cacagttgccgcggacggag

SEQ ID NO: 26859 - DNA, 20 bp, Unknown
  RNA secondary structure sequence
gacagctcctgcgctgcact

SEQ ID NO: 26860 - DNA, 20 bp, Unknown
  RNA secondary structure sequence
cgaccgtccctgcgactcac

SEQ ID NO: 26861 - DNA, 20 bp, Unknown
  RNA secondary structure sequence
gcagtccctgcgatacactc

SEQ ID NO: 26862 - DNA, 20 bp, Unknown
  RNA secondary structure sequence
cccttcattgtccccatggc

SEQ ID NO: 26863 - DNA, 20 bp, Unknown
  RNA secondary structure sequence
gagcgtcatctaataaagat

SEQ ID NO: 26864 - DNA, 20 bp, Unknown
  RNA secondary structure sequence
ttttccggtggccacccgcc

SEQ ID NO: 26865 - DNA, 20 bp, Unknown
  RNA secondary structure sequence
cggggccgggcaagtttgtt

SEQ ID NO: 26866 - DNA, 20 bp, Unknown
  RNA secondary structure sequence
ctgatccgaggctggagcca

SEQ ID NO: 26867 - DNA, 20 bp, Unknown
  RNA secondary structure sequence
aaggtctcgagatgccacgt

SEQ ID NO: 26868 - DNA, 20 bp, Unknown
  RNA secondary structure sequence
aatcaagtcatcgagatttc

SEQ ID NO: 26869 - DNA, 20 bp, Unknown
  RNA secondary structure sequence
gtctggcgatggttatggtc

SEQ ID NO: 26870 - DNA, 20 bp, Unknown
  RNA secondary structure sequence
gttctggaagacaataaccc

SEQ ID NO: 26871 - DNA, 20 bp, Unknown
  RNA secondary structure sequence
atgtgtatcccagaagaagc

SEQ ID NO: 26872 - DNA, 20 bp, Unknown
  RNA secondary structure sequence
cggaagcttgcttaacgtag

SEQ ID NO: 26873 - DNA, 20 bp, Unknown
  RNA secondary structure sequence
tcggagattcgcccgggccc

SEQ ID NO: 26874 - DNA, 20 bp, Unknown
  RNA secondary structure sequence
ttaaacttaagcgcgccgtg

SEQ ID NO: 26875 - DNA, 20 bp, Unknown
  RNA secondary structure sequence
cgcgtgaggctgcggctctg

SEQ ID NO: 26876 - DNA, 20 bp, Unknown
  RNA secondary structure sequence
gcagcgaccaacgcttctct

SEQ ID NO: 26877 - DNA, 20 bp, Unknown
  RNA secondary structure sequence
cagagggccagtacgtttcg

SEQ ID NO: 26878 - DNA, 20 bp, Unknown
  RNA secondary structure sequence
gaggcccactattaggctag

SEQ ID NO: 26879 - DNA, 20 bp, Unknown
  RNA secondary structure sequence
ataccgcaaccaaaatatcg

SEQ ID NO: 26880 - DNA, 20 bp, Unknown
  RNA secondary structure sequence
cagcgagtagagttttctct

SEQ ID NO: 26881 - DNA, 20 bp, Unknown
  RNA secondary structure sequence
tgcggacgcagttgcgtgag

SEQ ID NO: 26882 - DNA, 20 bp, Unknown
  RNA secondary structure sequence
ggaactctccagtttgtgga

SEQ ID NO: 26883 - DNA, 20 bp, Unknown
  RNA secondary structure sequence
gatagggtgcttgcgagtgc

SEQ ID NO: 26884 - DNA, 20 bp, Unknown
  RNA secondary structure sequence
accaaccgcaatggacccag

SEQ ID NO: 26885 - DNA, 20 bp, Unknown
  RNA secondary structure sequence
acgcagatctgtttgtcacg

SEQ ID NO: 26886 - DNA, 20 bp, Unknown
  RNA secondary structure sequence
tcgtcaaccgatgagatagg

SEQ ID NO: 26887 - DNA, 20 bp, Unknown
  RNA secondary structure sequence
aggagaagttgatttccgtg

SEQ ID NO: 26888 - DNA, 20 bp, Unknown
  RNA secondary structure sequence
ggggcgcgggtcactgaccc

SEQ ID NO: 26889 - DNA, 20 bp, Unknown
  RNA secondary structure sequence
tggacatccttaggcaaaac

SEQ ID NO: 26890 - DNA, 20 bp, Unknown
  RNA secondary structure sequence
agcagcagggacttaacttc

SEQ ID NO: 26891 - DNA, 20 bp, Unknown
  RNA secondary structure sequence
cgggggctgtagctgggttt

SEQ ID NO: 26892 - DNA, 20 bp, Unknown
  RNA secondary structure sequence
ccccaggctacctgacgggg

SEQ ID NO: 26893 - DNA, 20 bp, Unknown
  RNA secondary structure sequence
ggcggcggcagtactgggac

SEQ ID NO: 26894 - DNA, 20 bp, Unknown
  RNA secondary structure sequence
ctgcggtctggccttggagg

SEQ ID NO: 26895 - DNA, 20 bp, Unknown
  RNA secondary structure sequence
ctggggtccgacctggaagg

SEQ ID NO: 26896 - DNA, 20 bp, Unknown
  RNA secondary structure sequence
cctccaaagaaggaagcatc

SEQ ID NO: 26897 - DNA, 20 bp, Unknown
  RNA secondary structure sequence
agggcgtggtctaccaagaa

SEQ ID NO: 26898 - DNA, 20 bp, Unknown
  RNA secondary structure sequence
gatctcactccattgaacgt

SEQ ID NO: 26899 - DNA, 20 bp, Unknown
  RNA secondary structure sequence
ccttggttgatgccattgtc

SEQ ID NO: 26900 - DNA, 20 bp, Unknown
  RNA secondary structure sequence
caacatgatatatttgtcct

SEQ ID NO: 26901 - DNA, 20 bp, Unknown
  RNA secondary structure sequence
tttgaacttttatacaaaac

SEQ ID NO: 26902 - DNA, 20 bp, Unknown
  RNA secondary structure sequence
ttcaattgtggctttgacgt

SEQ ID NO: 26903 - DNA, 20 bp, Unknown
  RNA secondary structure sequence
ccgtggaccctctggtataa

SEQ ID NO: 26904 - DNA, 20 bp, Unknown
  RNA secondary structure sequence
agggactccagaccttccta

SEQ ID NO: 26905 - DNA, 20 bp, Unknown
  RNA secondary structure sequence
accaacacacactcgacgtg

SEQ ID NO: 26906 - DNA, 20 bp, Unknown
  RNA secondary structure sequence
ccaagaggcaaagttgtgga

SEQ ID NO: 26907 - DNA, 20 bp, Unknown
  RNA secondary structure sequence
agtccaaagtggaccaggcc

SEQ ID NO: 26908 - DNA, 20 bp, Unknown
  RNA secondary structure sequence
atatgacgcttgtttctttt

SEQ ID NO: 26909 - DNA, 20 bp, Unknown
  RNA secondary structure sequence
cggctagtaatgattctgga

SEQ ID NO: 26910 - DNA, 20 bp, Unknown
  RNA secondary structure sequence
gaggtgactgacagttacga

SEQ ID NO: 26911 - DNA, 20 bp, Unknown
  RNA secondary structure sequence
attgggtgcgcgactcggtt

SEQ ID NO: 26912 - DNA, 20 bp, Unknown
  RNA secondary structure sequence
cacgtaaaggctgccgacac

SEQ ID NO: 26913 - DNA, 20 bp, Unknown
  RNA secondary structure sequence
cagattctgctctgagtgtg

SEQ ID NO: 26914 - DNA, 20 bp, Unknown
  RNA secondary structure sequence
accgtggaacatctcgagaa

SEQ ID NO: 26915 - DNA, 20 bp, Unknown
  RNA secondary structure sequence
ccatcatcaacaccatcatc

SEQ ID NO: 26916 - DNA, 20 bp, Unknown
  RNA secondary structure sequence
tgcaatggcaacccagtcgc

SEQ ID NO: 26917 - DNA, 20 bp, Unknown
  RNA secondary structure sequence
caaggggagaagaaggaaga

SEQ ID NO: 26918 - DNA, 20 bp, Unknown
  RNA secondary structure sequence
aagaaggctttacccacttc

SEQ ID NO: 26919 - DNA, 20 bp, Unknown
  RNA secondary structure sequence
gtaggggaagcccccactat

SEQ ID NO: 26920 - DNA, 20 bp, Unknown
  RNA secondary structure sequence
cctccgcggctggccattgt

SEQ ID NO: 26921 - DNA, 20 bp, Unknown
  RNA secondary structure sequence
ggacctgttgggaacagatg

SEQ ID NO: 26922 - DNA, 20 bp, Unknown
  RNA secondary structure sequence
caaagttggcgttttattat

SEQ ID NO: 26923 - DNA, 20 bp, Unknown
  RNA secondary structure sequence
tgacaaggagagaagtccac

SEQ ID NO: 26924 - DNA, 20 bp, Unknown
  RNA secondary structure sequence
ctggtttgtttccccggtgc

SEQ ID NO: 26925 - DNA, 20 bp, Unknown
  RNA secondary structure sequence
gagaacagagtatcgttctg

SEQ ID NO: 26926 - DNA, 20 bp, Unknown
  RNA secondary structure sequence
aagtcgaaaggttaaaacat

SEQ ID NO: 26927 - DNA, 20 bp, Unknown
  RNA secondary structure sequence
agcaaaatgggtgtttattt

SEQ ID NO: 26928 - DNA, 20 bp, Unknown
  RNA secondary structure sequence
gggtaagaactgagggggca

SEQ ID NO: 26929 - DNA, 20 bp, Unknown
  RNA secondary structure sequence
cagaacggcggagacccagg

SEQ ID NO: 26930 - DNA, 20 bp, Unknown
  RNA secondary structure sequence
ggcctccttcttgataaagt

SEQ ID NO: 26931 - DNA, 20 bp, Unknown
  RNA secondary structure sequence
ttcgtggaacgttgttcccg

SEQ ID NO: 26932 - DNA, 20 bp, Unknown
  RNA secondary structure sequence
atagatgaaatagcaggagg

SEQ ID NO: 26933 - DNA, 20 bp, Unknown
  RNA secondary structure sequence
aggcagcgactgtgattgtg

SEQ ID NO: 26934 - DNA, 20 bp, Unknown
  RNA secondary structure sequence
ttctgtgtttttacgtaggt

SEQ ID NO: 26935 - DNA, 20 bp, Unknown
  RNA secondary structure sequence
tttccttctttcttacctta

SEQ ID NO: 26936 - DNA, 20 bp, Unknown
  RNA secondary structure sequence
ctcgaaagcgaaagttccag

SEQ ID NO: 26937 - DNA, 20 bp, Unknown
  RNA secondary structure sequence
gcgaaagcgaaagtagaacc

SEQ ID NO: 26938 - DNA, 20 bp, Unknown
  RNA secondary structure sequence
tcgaaagcgaaagtgttcca

SEQ ID NO: 26939 - DNA, 20 bp, Unknown
  RNA secondary structure sequence
ttgaaagcgaaagttccaga

SEQ ID NO: 26940 - DNA, 20 bp, Unknown
  RNA secondary structure sequence
ttgaaagcgacagtagaacc

SEQ ID NO: 26941 - DNA, 20 bp, Unknown
  RNA secondary structure sequence
gagaaagcgaaagtagaacc

SEQ ID NO: 26942 - DNA, 20 bp, Unknown
  RNA secondary structure sequence
ggaaagcgaaagagaaacca

SEQ ID NO: 26943 - DNA, 20 bp, Unknown
  RNA secondary structure sequence
tgaaagcgaaagtaccagag

SEQ ID NO: 26944 - DNA, 20 bp, Unknown
  RNA secondary structure sequence
cgaaagcgaaagtagaacca

SEQ ID NO: 26945 - DNA, 20 bp, Unknown
  RNA secondary structure sequence
cgaaagcgaaagttccagag

SEQ ID NO: 26946 - DNA, 20 bp, Unknown
  RNA secondary structure sequence
ggaaaagcgaaagtaaaacc

SEQ ID NO: 26947 - DNA, 20 bp, Unknown
  RNA secondary structure sequence
tgaaagcgaaagagaaacca

SEQ ID NO: 26948 - DNA, 20 bp, Unknown
  RNA secondary structure sequence
tgaaagtgaaagtagaacca

SEQ ID NO: 26949 - DNA, 20 bp, Unknown
  RNA secondary structure sequence
ctcgaaagcggaagttccca

SEQ ID NO: 26950 - DNA, 20 bp, Unknown
  RNA secondary structure sequence
gtaaaaatctctagcagtgg

SEQ ID NO: 26951 - DNA, 20 bp, Unknown
  RNA secondary structure sequence
ataaaaatctctagcagtgg

SEQ ID NO: 26952 - DNA, 20 bp, Unknown
  RNA secondary structure sequence
gtaaaattctctagcagtgg

SEQ ID NO: 26953 - DNA, 20 bp, Unknown
  RNA secondary structure sequence
gaaagcgaaagtagaaccag

SEQ ID NO: 26954 - DNA, 20 bp, Unknown
  RNA secondary structure sequence
gaaagcgaaagtaaaaccag

SEQ ID NO: 26955 - DNA, 20 bp, Unknown
  RNA secondary structure sequence
gaaagcgaaagtaagaccag

SEQ ID NO: 26956 - DNA, 20 bp, Unknown
  RNA secondary structure sequence
gaaaacgaaagtaaaaccag

SEQ ID NO: 26957 - DNA, 20 bp, Unknown
  RNA secondary structure sequence
gaaagcgaaagagaaaccag

SEQ ID NO: 26958 - DNA, 20 bp, Unknown
  RNA secondary structure sequence
gaaagcgaaagtgagaccag

SEQ ID NO: 26959 - DNA, 20 bp, Unknown
  RNA secondary structure sequence
gaaaacgaaagtaaactgga

SEQ ID NO: 26960 - DNA, 20 bp, Unknown
  RNA secondary structure sequence
gaaaacgaaagtagaaccag

SEQ ID NO: 26961 - DNA, 20 bp, Unknown
  RNA secondary structure sequence
gaaaacgaaagtagaaccgg

SEQ ID NO: 26962 - DNA, 20 bp, Unknown
  RNA secondary structure sequence
gaaagcgaaagtagaaccgg

SEQ ID NO: 26963 - DNA, 20 bp, Unknown
  RNA secondary structure sequence
gaaaaggaaaatgagacccg

SEQ ID NO: 26964 - DNA, 20 bp, Unknown
  RNA secondary structure sequence
gaaaacgaaagcggaaccgg

SEQ ID NO: 26965 - DNA, 20 bp, Unknown
  RNA secondary structure sequence
gaaagccaaagttagaaccc

SEQ ID NO: 26966 - DNA, 20 bp, Unknown
  RNA secondary structure sequence
aagaaaacctccgacgcaac

SEQ ID NO: 26967 - DNA, 20 bp, Unknown
  RNA secondary structure sequence
tcgaaagcgaaagttccaga

SEQ ID NO: 26968 - DNA, 20 bp, Unknown
  RNA secondary structure sequence
cgaaagcggaagttccagag

SEQ ID NO: 26969 - DNA, 20 bp, Unknown
  RNA secondary structure sequence
taaaaatctctagcagtggc

SEQ ID NO: 26970 - DNA, 20 bp, Unknown
  RNA secondary structure sequence
taaaaatctctaccagtggc

SEQ ID NO: 26971 - DNA, 20 bp, Unknown
  RNA secondary structure sequence
taaaaatctctagaagtggc

SEQ ID NO: 26972 - DNA, 20 bp, Unknown
  RNA secondary structure sequence
aatcaaaagaaggttgccaa

SEQ ID NO: 26973 - DNA, 20 bp, Unknown
  RNA secondary structure sequence
aaagcaaagaaggatgtcaa

SEQ ID NO: 26974 - DNA, 20 bp, Unknown
  RNA secondary structure sequence
aaagtaggaccagaggagat

SEQ ID NO: 26975 - DNA, 20 bp, Unknown
  RNA secondary structure sequence
ctcagacctctttagtccgg

SEQ ID NO: 26976 - DNA, 20 bp, Unknown
  RNA secondary structure sequence
ctcagatattaagtgtctgt

SEQ ID NO: 26977 - DNA, 20 bp, Unknown
  RNA secondary structure sequence
ctcagaccatctggactgag

SEQ ID NO: 26978 - DNA, 20 bp, Unknown
  RNA secondary structure sequence
aaagcgaaagtagaaccaga

SEQ ID NO: 26979 - DNA, 20 bp, Unknown
  RNA secondary structure sequence
aaagcgaaagtgagaccaga

SEQ ID NO: 26980 - DNA, 20 bp, Unknown
  RNA secondary structure sequence
aaagtgaaagtaagaccaga

SEQ ID NO: 26981 - DNA, 20 bp, Unknown
  RNA secondary structure sequence
aaaagcgaaagtaaaaccag

SEQ ID NO: 26982 - DNA, 20 bp, Unknown
  RNA secondary structure sequence
aaagcgaaagtaagaccaga

SEQ ID NO: 26983 - DNA, 20 bp, Unknown
  RNA secondary structure sequence
aaaagcgaaaataaaaccag

SEQ ID NO: 26984 - DNA, 20 bp, Unknown
  RNA secondary structure sequence
gaaagtgaaagagaaaccag

SEQ ID NO: 26985 - DNA, 20 bp, Unknown
  RNA secondary structure sequence
aaaacgaaagtaaggccaga

SEQ ID NO: 26986 - DNA, 20 bp, Unknown
  RNA secondary structure sequence
aaaacgaaagtgtaaccgga

SEQ ID NO: 26987 - DNA, 20 bp, Unknown
  RNA secondary structure sequence
aaagcgaaagagaaaccaga

SEQ ID NO: 26988 - DNA, 20 bp, Unknown
  RNA secondary structure sequence
aaagcgaaagtaaaaccaga

SEQ ID NO: 26989 - DNA, 20 bp, Unknown
  RNA secondary structure sequence
aagcgaaagcgaaagccaga

SEQ ID NO: 26990 - DNA, 20 bp, Unknown
  RNA secondary structure sequence
agatcacttagactgaagca

SEQ ID NO: 26991 - DNA, 20 bp, Unknown
  RNA secondary structure sequence
ctcaaacccttttagtcagt

SEQ ID NO: 26992 - DNA, 20 bp, Unknown
  RNA secondary structure sequence
ctcagaccattctagtcagt

SEQ ID NO: 26993 - DNA, 20 bp, Unknown
  RNA secondary structure sequence
actgtctgcgtcatttggtg

SEQ ID NO: 26994 - DNA, 20 bp, Unknown
  RNA secondary structure sequence
agaaaacctccgacgcaacg

SEQ ID NO: 26995 - DNA, 20 bp, Unknown
  RNA secondary structure sequence
cgaaaacgaaagttccagag

SEQ ID NO: 26996 - DNA, 20 bp, Unknown
  RNA secondary structure sequence
cctcagaccatctagactga

SEQ ID NO: 26997 - DNA, 20 bp, Unknown
  RNA secondary structure sequence
cctcagacctctttggtcag

SEQ ID NO: 26998 - DNA, 20 bp, Unknown
  RNA secondary structure sequence
agcctttttaatactgtctg

SEQ ID NO: 26999 - DNA, 20 bp, Unknown
  RNA secondary structure sequence
gaaaacctccgacgcaacgg

SEQ ID NO: 27000 - DNA, 20 bp, Unknown
  RNA secondary structure sequence
tccctcagaccactctagac

SEQ ID NO: 27001 - DNA, 20 bp, Unknown
  RNA secondary structure sequence
ggactcgaaagcggaagttc

SEQ ID NO: 27002 - DNA, 20 bp, Unknown
  RNA secondary structure sequence
ggactcgaaagcgaaagttc

SEQ ID NO: 27003 - DNA, 20 bp, Unknown
  RNA secondary structure sequence
gactcgaaagcgaaagttcc

SEQ ID NO: 27004 - DNA, 20 bp, Unknown
  RNA secondary structure sequence
ccctcagaccctttagtcag

SEQ ID NO: 27005 - DNA, 20 bp, Unknown
  RNA secondary structure sequence
ccctcagaccactctagact

SEQ ID NO: 27006 - DNA, 20 bp, Unknown
  RNA secondary structure sequence
atgaattagaaaaagttagg

SEQ ID NO: 27007 - DNA, 20 bp, Unknown
  RNA secondary structure sequence
cctcagactactctagacag

SEQ ID NO: 27008 - DNA, 20 bp, Unknown
  RNA secondary structure sequence
cctcagaccaatttggtagt

SEQ ID NO: 27009 - DNA, 20 bp, Unknown
  RNA secondary structure sequence
cctcagacctctgtagtcag

SEQ ID NO: 27010 - DNA, 20 bp, Unknown
  RNA secondary structure sequence
cctcagacctttttggcagt

SEQ ID NO: 27011 - DNA, 20 bp, Unknown
  RNA secondary structure sequence
cctcagacctttttggtagt

SEQ ID NO: 27012 - DNA, 20 bp, Unknown
  RNA secondary structure sequence
ctcagacaattctagtcagt

SEQ ID NO: 27013 - DNA, 20 bp, Unknown
  RNA secondary structure sequence
cctcagaccattttggtagt

SEQ ID NO: 27014 - DNA, 20 bp, Unknown
  RNA secondary structure sequence
aaaaatctctagcagtggcg

SEQ ID NO: 27015 - DNA, 20 bp, Unknown
  RNA secondary structure sequence
cgaaagtagaaccagagacg

SEQ ID NO: 27016 - DNA, 20 bp, Unknown
  RNA secondary structure sequence
ccctcagattaaattatagt

SEQ ID NO: 27017 - DNA, 20 bp, Unknown
  RNA secondary structure sequence
cctcagaccttttagtcagt

SEQ ID NO: 27018 - DNA, 20 bp, Unknown
  RNA secondary structure sequence
agcgaaaggaaaaccagagg

SEQ ID NO: 27019 - DNA, 20 bp, Unknown
  RNA secondary structure sequence
agactgtgtaaaaatctcta

SEQ ID NO: 27020 - DNA, 20 bp, Unknown
  RNA secondary structure sequence
gtttgtgtaaaaatctctag

SEQ ID NO: 27021 - DNA, 20 bp, Unknown
  RNA secondary structure sequence
acttagtgaaaaatctctag

SEQ ID NO: 27022 - DNA, 20 bp, Unknown
  RNA secondary structure sequence
actgtgtaaaaaatctctag

SEQ ID NO: 27023 - DNA, 20 bp, Unknown
  RNA secondary structure sequence
atcacttagactgaagcaga

SEQ ID NO: 27024 - DNA, 20 bp, Unknown
  RNA secondary structure sequence
cagaccaccttagcagagtg

SEQ ID NO: 27025 - DNA, 20 bp, Unknown
  RNA secondary structure sequence
cagactctcgtagtcagtgt

SEQ ID NO: 27026 - DNA, 20 bp, Unknown
  RNA secondary structure sequence
ctcagaccaattgtggtagt

SEQ ID NO: 27027 - DNA, 20 bp, Unknown
  RNA secondary structure sequence
atgaattagaaaaaattagg

SEQ ID NO: 27028 - DNA, 20 bp, Unknown
  RNA secondary structure sequence
ctcgaaagcgaaagttacag

SEQ ID NO: 27029 - DNA, 20 bp, Unknown
  RNA secondary structure sequence
cgcgaaagcgaaagtagaac

SEQ ID NO: 27030 - DNA, 20 bp, Unknown
  RNA secondary structure sequence
cttgaaagcgaaagtagaac

SEQ ID NO: 27031 - DNA, 20 bp, Unknown
  RNA secondary structure sequence
gaagaaaacctccgacgcga

SEQ ID NO: 27032 - DNA, 20 bp, Unknown
  RNA secondary structure sequence
actcgaaagcggcggttcca

SEQ ID NO: 27033 - DNA, 20 bp, Unknown
  RNA secondary structure sequence
actcgaaagcggaagttcca

SEQ ID NO: 27034 - DNA, 20 bp, Unknown
  RNA secondary structure sequence
ctcgaaaacgaaagttccag

SEQ ID NO: 27035 - DNA, 20 bp, Unknown
  RNA secondary structure sequence
actcgaaagcgaaagttcca

SEQ ID NO: 27036 - DNA, 20 bp, Unknown
  RNA secondary structure sequence
atgaattagaaagaattagg

SEQ ID NO: 27037 - DNA, 20 bp, Unknown
  RNA secondary structure sequence
ctcagacccttgttggttgc

SEQ ID NO: 27038 - DNA, 20 bp, Unknown
  RNA secondary structure sequence
atgaattagaaaaggttagg

SEQ ID NO: 27039 - DNA, 20 bp, Unknown
  RNA secondary structure sequence
gggactcgaaagcgaaagtt

SEQ ID NO: 27040 - DNA, 20 bp, Unknown
  RNA secondary structure sequence
ggagcgtggcccctggacgc

SEQ ID NO: 27041 - DNA, 20 bp, Unknown
  RNA secondary structure sequence
atccctcagaccactataga

SEQ ID NO: 27042 - DNA, 20 bp, Unknown
  RNA secondary structure sequence
atccctcagaccactctaga

SEQ ID NO: 27043 - DNA, 20 bp, Unknown
  RNA secondary structure sequence
atccctcagaccactctagg

SEQ ID NO: 27044 - DNA, 20 bp, Unknown
  RNA secondary structure sequence
acttgaaagcgaaagtagaa

SEQ ID NO: 27045 - DNA, 20 bp, Unknown
  RNA secondary structure sequence
agtcaaaagaaggttgccaa

SEQ ID NO: 27046 - DNA, 20 bp, Unknown
  RNA secondary structure sequence
agaccaaagacggttgtcaa

SEQ ID NO: 27047 - DNA, 20 bp, Unknown
  RNA secondary structure sequence
agtcaaaagaagggtgtcaa

SEQ ID NO: 27048 - DNA, 20 bp, Unknown
  RNA secondary structure sequence
aaagtaaagaaggctgtcaa

SEQ ID NO: 27049 - DNA, 20 bp, Unknown
  RNA secondary structure sequence
actcgaaagcgaaagtgcca

SEQ ID NO: 27050 - DNA, 20 bp, Unknown
  RNA secondary structure sequence
gaatctctcgacgcacggac

SEQ ID NO: 27051 - DNA, 20 bp, Unknown
  RNA secondary structure sequence
agtgtaaaatctctagcagt

SEQ ID NO: 27052 - DNA, 20 bp, Unknown
  RNA secondary structure sequence
gactcgaaagcgaaagtgtt

SEQ ID NO: 27053 - DNA, 20 bp, Unknown
  RNA secondary structure sequence
gtgtaaaaatctctagcagt

SEQ ID NO: 27054 - DNA, 20 bp, Unknown
  RNA secondary structure sequence
tgtggaaaatctctagcagt

SEQ ID NO: 27055 - DNA, 20 bp, Unknown
  RNA secondary structure sequence
ctcagacccctttagtcagt

SEQ ID NO: 27056 - DNA, 20 bp, Unknown
  RNA secondary structure sequence
ctcagacccttttagccagt

SEQ ID NO: 27057 - DNA, 20 bp, Unknown
  RNA secondary structure sequence
ctcagaacattttagtccgg

SEQ ID NO: 27058 - DNA, 20 bp, Unknown
  RNA secondary structure sequence
ctcagaacctattagtcagt

SEQ ID NO: 27059 - DNA, 20 bp, Unknown
  RNA secondary structure sequence
ctcagacacattttgtccgt

SEQ ID NO: 27060 - DNA, 20 bp, Unknown
  RNA secondary structure sequence
ctcagacacttgtagtcagt

SEQ ID NO: 27061 - DNA, 20 bp, Unknown
  RNA secondary structure sequence
ctcagacatttgtagtcagt

SEQ ID NO: 27062 - DNA, 20 bp, Unknown
  RNA secondary structure sequence
ctcagaccaactttggtagt

SEQ ID NO: 27063 - DNA, 20 bp, Unknown
  RNA secondary structure sequence
ctcagaccaatttagtcagg

SEQ ID NO: 27064 - DNA, 20 bp, Unknown
  RNA secondary structure sequence
ctcagaccaatttagtccgt

SEQ ID NO: 27065 - DNA, 20 bp, Unknown
  RNA secondary structure sequence
ctcagaccatcttagtcagt

SEQ ID NO: 27066 - DNA, 20 bp, Unknown
  RNA secondary structure sequence
ctcagaccattcgtggtagt

SEQ ID NO: 27067 - DNA, 20 bp, Unknown
  RNA secondary structure sequence
ctcagaccatttagtcagtg

SEQ ID NO: 27068 - DNA, 20 bp, Unknown
  RNA secondary structure sequence
ctcagaccattttagtcagt

SEQ ID NO: 27069 - DNA, 20 bp, Unknown
  RNA secondary structure sequence
ctcagacccttaaagtcaat

SEQ ID NO: 27070 - DNA, 20 bp, Unknown
  RNA secondary structure sequence
ctcagacccttgtagtcagt

SEQ ID NO: 27071 - DNA, 20 bp, Unknown
  RNA secondary structure sequence
ctcagacccttttagtcagt

SEQ ID NO: 27072 - DNA, 20 bp, Unknown
  RNA secondary structure sequence
ctcagacccttttagtccgt

SEQ ID NO: 27073 - DNA, 20 bp, Unknown
  RNA secondary structure sequence
ctcagaccctttttggtagt

SEQ ID NO: 27074 - DNA, 20 bp, Unknown
  RNA secondary structure sequence
ctcagacctcggtagtcagt

SEQ ID NO: 27075 - DNA, 20 bp, Unknown
  RNA secondary structure sequence
ctcagacctctttagtcagt

SEQ ID NO: 27076 - DNA, 20 bp, Unknown
  RNA secondary structure sequence
ctcagactcttttagtcagt

SEQ ID NO: 27077 - DNA, 20 bp, Unknown
  RNA secondary structure sequence
ctcagaccatcctagttagt

SEQ ID NO: 27078 - DNA, 20 bp, Unknown
  RNA secondary structure sequence
ctcagatccttttagttagc

SEQ ID NO: 27079 - DNA, 20 bp, Unknown
  RNA secondary structure sequence
ctcatacccttttagtcagt

SEQ ID NO: 27080 - DNA, 20 bp, Unknown
  RNA secondary structure sequence
ctcagaccctattagtcagt

SEQ ID NO: 27081 - DNA, 20 bp, Unknown
  RNA secondary structure sequence
ctcagacccttgttggtagt

SEQ ID NO: 27082 - DNA, 20 bp, Unknown
  RNA secondary structure sequence
ctcagacccttgttggtatt

SEQ ID NO: 27083 - DNA, 20 bp, Unknown
  RNA secondary structure sequence
ctcagacaccttttgtcagt

SEQ ID NO: 27084 - DNA, 20 bp, Unknown
  RNA secondary structure sequence
ctcagaccctttgtggtagt

SEQ ID NO: 27085 - DNA, 20 bp, Unknown
  RNA secondary structure sequence
ggacgcgaaagcgaaagttc

SEQ ID NO: 27086 - DNA, 20 bp, Unknown
  RNA secondary structure sequence
gtagagatccctcagatctc

SEQ ID NO: 27087 - DNA, 20 bp, Unknown
  RNA secondary structure sequence
gtagagatccctcagatttg

SEQ ID NO: 27088 - DNA, 20 bp, Unknown
  RNA secondary structure sequence
agtaaaaatctctagcagtg

SEQ ID NO: 27089 - DNA, 20 bp, Unknown
  RNA secondary structure sequence
cgaacagggacttgaaaacg

SEQ ID NO: 27090 - DNA, 20 bp, Unknown
  RNA secondary structure sequence
gaaagtagaaccagaggaga

SEQ ID NO: 27091 - DNA, 20 bp, Unknown
  RNA secondary structure sequence
gaaagtagaaccagagaaga

SEQ ID NO: 27092 - DNA, 20 bp, Unknown
  RNA secondary structure sequence
ctcagaactcttaaaagtag

SEQ ID NO: 27093 - DNA, 20 bp, Unknown
  RNA secondary structure sequence
tcagaccacttgggctgagt

SEQ ID NO: 27094 - DNA, 20 bp, Unknown
  RNA secondary structure sequence
aaagtaaaaccagaggagat

SEQ ID NO: 27095 - DNA, 20 bp, Unknown
  RNA secondary structure sequence
aagcgaaagtaagaccagag

SEQ ID NO: 27096 - DNA, 20 bp, Unknown
  RNA secondary structure sequence
aagcgaaagtagaaccagag

SEQ ID NO: 27097 - DNA, 20 bp, Unknown
  RNA secondary structure sequence
aagcgaaagtaagaccggag

SEQ ID NO: 27098 - DNA, 20 bp, Unknown
  RNA secondary structure sequence
aagcgaaagtgagaccagag

SEQ ID NO: 27099 - DNA, 20 bp, Unknown
  RNA secondary structure sequence
aaacgaaagtaagaccagag

SEQ ID NO: 27100 - DNA, 20 bp, Unknown
  RNA secondary structure sequence
aagcgaaagtaaaaccagag

SEQ ID NO: 27101 - DNA, 20 bp, Unknown
  RNA secondary structure sequence
aagtgaaagtagaaccagag

SEQ ID NO: 27102 - DNA, 20 bp, Unknown
  RNA secondary structure sequence
gactgtgtaaaaatctctag

SEQ ID NO: 27103 - DNA, 20 bp, Unknown
  RNA secondary structure sequence
gattgagtaaaaatctctag

SEQ ID NO: 27104 - DNA, 20 bp, Unknown
  RNA secondary structure sequence
gacggtgtaaaaatctctag

SEQ ID NO: 27105 - DNA, 20 bp, Unknown
  RNA secondary structure sequence
gcttgagtagaaatctctag

SEQ ID NO: 27106 - DNA, 20 bp, Unknown
  RNA secondary structure sequence
gtcactgtagaaaatctcta

SEQ ID NO: 27107 - DNA, 20 bp, Unknown
  RNA secondary structure sequence
gtcagtgtaaaaatctctag

SEQ ID NO: 27108 - DNA, 20 bp, Unknown
  RNA secondary structure sequence
gatcacgtagactgaggcag

SEQ ID NO: 27109 - DNA, 20 bp, Unknown
  RNA secondary structure sequence
gatcacttagactgaagcag

SEQ ID NO: 27110 - DNA, 20 bp, Unknown
  RNA secondary structure sequence
gatcacatagactgaagcag

SEQ ID NO: 27111 - DNA, 20 bp, Unknown
  RNA secondary structure sequence
tcagaccattttagtcagag

SEQ ID NO: 27112 - DNA, 20 bp, Unknown
  RNA secondary structure sequence
tcagaccattttagtcagtg

SEQ ID NO: 27113 - DNA, 20 bp, Unknown
  RNA secondary structure sequence
tcagacccttttagtcagtg

SEQ ID NO: 27114 - DNA, 20 bp, Unknown
  RNA secondary structure sequence
tcagacagctttagtccggg

SEQ ID NO: 27115 - DNA, 20 bp, Unknown
  RNA secondary structure sequence
ccctcagatcacgtagactg

SEQ ID NO: 27116 - DNA, 20 bp, Unknown
  RNA secondary structure sequence
acgcggcccctggacgcagg

SEQ ID NO: 27117 - DNA, 20 bp, Unknown
  RNA secondary structure sequence
tgtgtggaaaatctctagca

SEQ ID NO: 27118 - DNA, 20 bp, Unknown
  RNA secondary structure sequence
agacccttttagtcagtgtg

SEQ ID NO: 27119 - DNA, 20 bp, Unknown
  RNA secondary structure sequence
tgtgtgactctggtaactag

SEQ ID NO: 27120 - DNA, 20 bp, Unknown
  RNA secondary structure sequence
agagcacttcccaacgctgc

SEQ ID NO: 27121 - DNA, 20 bp, Unknown
  RNA secondary structure sequence
gcctccctgcgcacccgcag

SEQ ID NO: 27122 - DNA, 20 bp, Unknown
  RNA secondary structure sequence
cagccttcgctccaggggaa

SEQ ID NO: 27123 - DNA, 20 bp, Unknown
  RNA secondary structure sequence
cagccttcgctctaggggaa

SEQ ID NO: 27124 - DNA, 20 bp, Unknown
  RNA secondary structure sequence
aagccttcatccttctgggt

SEQ ID NO: 27125 - DNA, 20 bp, Unknown
  RNA secondary structure sequence
gcacagagtcggcgctccct

SEQ ID NO: 27126 - DNA, 20 bp, Unknown
  RNA secondary structure sequence
acacattggactcgctgggc

SEQ ID NO: 27127 - DNA, 20 bp, Unknown
  RNA secondary structure sequence
acacgttggactggctgggc

SEQ ID NO: 27128 - DNA, 20 bp, Unknown
  RNA secondary structure sequence
acacgttggattcgctgggc

SEQ ID NO: 27129 - DNA, 20 bp, Unknown
  RNA secondary structure sequence
gaagacaccagtgggcccgt

SEQ ID NO: 27130 - DNA, 20 bp, Unknown
  RNA secondary structure sequence
ccgccaggcacttctttccg

SEQ ID NO: 27131 - DNA, 20 bp, Unknown
  RNA secondary structure sequence
acttttttcacatatcaact

SEQ ID NO: 27132 - DNA, 20 bp, Unknown
  RNA secondary structure sequence
ttggggtgtttcgcgagtgt

SEQ ID NO: 27133 - DNA, 20 bp, Unknown
  RNA secondary structure sequence
gaagatagtctccacttttt

SEQ ID NO: 27134 - DNA, 20 bp, Unknown
  RNA secondary structure sequence
tcttactggtgtgaggattt

SEQ ID NO: 27135 - DNA, 20 bp, Unknown
  RNA secondary structure sequence
ggcaggatgcgctaccgggc

SEQ ID NO: 27136 - DNA, 20 bp, Unknown
  RNA secondary structure sequence
aatcaggctcaggttctgag

SEQ ID NO: 27137 - DNA, 20 bp, Unknown
  RNA secondary structure sequence
gtttccttggttttaggtgc

SEQ ID NO: 27138 - DNA, 20 bp, Unknown
  RNA secondary structure sequence
taatacattctttttagccg

SEQ ID NO: 27139 - DNA, 20 bp, Unknown
  RNA secondary structure sequence
cccagcgctttggcttctct

SEQ ID NO: 27140 - DNA, 20 bp, Unknown
  RNA secondary structure sequence
tgcctcatgacctactcggc

SEQ ID NO: 27141 - DNA, 20 bp, Unknown
  RNA secondary structure sequence
cgttacggatcggcttactc

SEQ ID NO: 27142 - DNA, 20 bp, Unknown
  RNA secondary structure sequence
cgttacgaatcggcttactc

SEQ ID NO: 27143 - DNA, 20 bp, Unknown
  RNA secondary structure sequence
cgttacggatcggtttactc

SEQ ID NO: 27144 - DNA, 20 bp, Unknown
  RNA secondary structure sequence
agtcttcagcggcgctggct

SEQ ID NO: 27145 - DNA, 20 bp, Unknown
  RNA secondary structure sequence
aggaactggccggggtccgc

SEQ ID NO: 27146 - DNA, 20 bp, Unknown
  RNA secondary structure sequence
tcctcagcttctcatccctg

SEQ ID NO: 27147 - DNA, 20 bp, Unknown
  RNA secondary structure sequence
tcctcggcttctcatccctg

SEQ ID NO: 27148 - DNA, 20 bp, Unknown
  RNA secondary structure sequence
ggcagccgccgcttcccctt

SEQ ID NO: 27149 - DNA, 20 bp, Unknown
  RNA secondary structure sequence
gacctcgcgagccttccgca

SEQ ID NO: 27150 - DNA, 20 bp, Unknown
  RNA secondary structure sequence
cattgttttatacatagcac

SEQ ID NO: 27151 - DNA, 20 bp, Unknown
  RNA secondary structure sequence
ttcacggttcccacccagga

SEQ ID NO: 27152 - DNA, 20 bp, Unknown
  RNA secondary structure sequence
ttcacggttcccatccagga

SEQ ID NO: 27153 - DNA, 20 bp, Unknown
  RNA secondary structure sequence
ttcatggttcccacccagga

SEQ ID NO: 27154 - DNA, 20 bp, Unknown
  RNA secondary structure sequence
ctcccgcaacttgcggagct

SEQ ID NO: 27155 - DNA, 20 bp, Unknown
  RNA secondary structure sequence
ccagtagaatggccaggaca

SEQ ID NO: 27156 - DNA, 20 bp, Unknown
  RNA secondary structure sequence
gggttcgcgcgccctccccc

SEQ ID NO: 27157 - DNA, 20 bp, Unknown
  RNA secondary structure sequence
cttggccctccaactccttt

SEQ ID NO: 27158 - DNA, 20 bp, Unknown
  RNA secondary structure sequence
cacaagcgacacaaatgaac

SEQ ID NO: 27159 - DNA, 20 bp, Unknown
  RNA secondary structure sequence
aagtctccgccggaccctcc

SEQ ID NO: 27160 - DNA, 20 bp, Unknown
  RNA secondary structure sequence
tgtgaattactgtctcacag

SEQ ID NO: 27161 - DNA, 20 bp, Unknown
  RNA secondary structure sequence
gcactggaacttacaacacc

SEQ ID NO: 27162 - DNA, 20 bp, Unknown
  RNA secondary structure sequence
gcaaggcgccacgcaaacag

SEQ ID NO: 27163 - DNA, 20 bp, Unknown
  RNA secondary structure sequence
gtctgtgtcttttggctccg

SEQ ID NO: 27164 - DNA, 20 bp, Unknown
  RNA secondary structure sequence
ccggagcccggggcgtccgc

SEQ ID NO: 27165 - DNA, 20 bp, Unknown
  RNA secondary structure sequence
atccctcatccttcatccct

SEQ ID NO: 27166 - DNA, 20 bp, Unknown
  RNA secondary structure sequence
agtatgttctgccacgttcc

SEQ ID NO: 27167 - DNA, 20 bp, Unknown
  RNA secondary structure sequence
ggcgtgctctcttccctgag

SEQ ID NO: 27168 - DNA, 20 bp, Unknown
  RNA secondary structure sequence
cctttgtgaaagcaaagatg

SEQ ID NO: 27169 - DNA, 20 bp, Unknown
  RNA secondary structure sequence
cctttttgaaagcaaagatg

SEQ ID NO: 27170 - DNA, 20 bp, Unknown
  RNA secondary structure sequence
cgtttttgaaagcaaagatg

SEQ ID NO: 27171 - DNA, 20 bp, Unknown
  RNA secondary structure sequence
gctttgtgaaagcaaagatg

SEQ ID NO: 27172 - DNA, 20 bp, Unknown
  RNA secondary structure sequence
gctttttgaaagcaaagatg

SEQ ID NO: 27173 - DNA, 20 bp, Unknown
  RNA secondary structure sequence
ggcgcgcgccccggggcggg

SEQ ID NO: 27174 - DNA, 20 bp, Unknown
  RNA secondary structure sequence
aacgcgcacgcgcttaagga

SEQ ID NO: 27175 - DNA, 20 bp, Unknown
  RNA secondary structure sequence
tccagcgatgccgccccagc

SEQ ID NO: 27176 - DNA, 20 bp, Unknown
  RNA secondary structure sequence
tgttgctgagttggtctctt

SEQ ID NO: 27177 - DNA, 20 bp, Unknown
  RNA secondary structure sequence
gaggttttggcagctctgga

SEQ ID NO: 27178 - DNA, 20 bp, Unknown
  RNA secondary structure sequence
cacagccccaaccgccgccg

SEQ ID NO: 27179 - DNA, 20 bp, Unknown
  RNA secondary structure sequence
aaagcgcgcgagcaagatgg

SEQ ID NO: 27180 - DNA, 20 bp, Unknown
  RNA secondary structure sequence
ggtccacggggaacccgaag

SEQ ID NO: 27181 - DNA, 20 bp, Unknown
  RNA secondary structure sequence
ggtccacggggaacctgaag

SEQ ID NO: 27182 - DNA, 20 bp, Unknown
  RNA secondary structure sequence
ctggagcctccagagggctg

SEQ ID NO: 27183 - DNA, 20 bp, Unknown
  RNA secondary structure sequence
tgagcacagaaccggaaact

SEQ ID NO: 27184 - DNA, 20 bp, Unknown
  RNA secondary structure sequence
ttaccgtggcgagttccgcg

SEQ ID NO: 27185 - DNA, 20 bp, Unknown
  RNA secondary structure sequence
tccccaggctcacgagcccc

SEQ ID NO: 27186 - DNA, 20 bp, Unknown
  RNA secondary structure sequence
caggggagcgagcccggccc

SEQ ID NO: 27187 - DNA, 20 bp, Unknown
  RNA secondary structure sequence
cgacgttgacttcgaaattg

SEQ ID NO: 27188 - DNA, 20 bp, Unknown
  RNA secondary structure sequence
tttttgaggctgcgcactcg

SEQ ID NO: 27189 - DNA, 20 bp, Unknown
  RNA secondary structure sequence
tctcttcctttctgggctcg

SEQ ID NO: 27190 - DNA, 20 bp, Unknown
  RNA secondary structure sequence
ttcttccgcttcctgtacca

SEQ ID NO: 27191 - DNA, 20 bp, Unknown
  RNA secondary structure sequence
ggctgaaggacttggggagc

SEQ ID NO: 27192 - DNA, 20 bp, Unknown
  RNA secondary structure sequence
cgggtcagagcccctttttt

SEQ ID NO: 27193 - DNA, 20 bp, Unknown
  RNA secondary structure sequence
accggccgccagcccatctg

SEQ ID NO: 27194 - DNA, 20 bp, Unknown
  RNA secondary structure sequence
accacccaggtagggggtta

SEQ ID NO: 27195 - DNA, 20 bp, Unknown
  RNA secondary structure sequence
atcacccaggtagggggtta

SEQ ID NO: 27196 - DNA, 20 bp, Unknown
  RNA secondary structure sequence
tattgtaaatattttatgaa

SEQ ID NO: 27197 - DNA, 20 bp, Unknown
  RNA secondary structure sequence
ggcagcatggcggcgggggc

SEQ ID NO: 27198 - DNA, 20 bp, Unknown
  RNA secondary structure sequence
ttgggggcctttccagaaaa

SEQ ID NO: 27199 - DNA, 20 bp, Unknown
  RNA secondary structure sequence
ttcccacatcggatcgcagg

SEQ ID NO: 27200 - DNA, 20 bp, Unknown
  RNA secondary structure sequence
cctgggaagtggccgcagag

SEQ ID NO: 27201 - DNA, 20 bp, Unknown
  RNA secondary structure sequence
ggctcaccatggaccgctgg

SEQ ID NO: 27202 - DNA, 20 bp, Unknown
  RNA secondary structure sequence
ccatcccggcagtcgtggct

SEQ ID NO: 27203 - DNA, 20 bp, Unknown
  RNA secondary structure sequence
tatgtatgtgtatgtatgtg

SEQ ID NO: 27204 - DNA, 20 bp, Unknown
  RNA secondary structure sequence
gaggcggggtttatagcccg

SEQ ID NO: 27205 - DNA, 20 bp, Unknown
  RNA secondary structure sequence
ccctgcccacccgcggaaac

SEQ ID NO: 27206 - DNA, 20 bp, Unknown
  RNA secondary structure sequence
ccaggactggtttctgtaag

SEQ ID NO: 27207 - DNA, 20 bp, Unknown
  RNA secondary structure sequence
gagatgctaagcgtcaccga

SEQ ID NO: 27208 - DNA, 20 bp, Unknown
  RNA secondary structure sequence
gaggtgccaagcgtcaccga

SEQ ID NO: 27209 - DNA, 20 bp, Unknown
  RNA secondary structure sequence
gaggtgctaagcgtcaccga

SEQ ID NO: 27210 - DNA, 20 bp, Unknown
  RNA secondary structure sequence
cctcgccgcaccacacacag

SEQ ID NO: 27211 - DNA, 20 bp, Unknown
  RNA secondary structure sequence
ttctttttctttttttccca

SEQ ID NO: 27212 - DNA, 20 bp, Unknown
  RNA secondary structure sequence
gtggggaggctattctgccc

SEQ ID NO: 27213 - DNA, 20 bp, Unknown
  RNA secondary structure sequence
gcgcttcattccttcttcca

SEQ ID NO: 27214 - DNA, 20 bp, Unknown
  RNA secondary structure sequence
cgccccgtgcaggctgtgga

SEQ ID NO: 27215 - DNA, 20 bp, Unknown
  RNA secondary structure sequence
gccacagccgcaacgccacc

SEQ ID NO: 27216 - DNA, 20 bp, Unknown
  RNA secondary structure sequence
gcgacagccgcaacgccacc

SEQ ID NO: 27217 - DNA, 20 bp, Unknown
  RNA secondary structure sequence
ctcccagcaaccggtctggc

SEQ ID NO: 27218 - DNA, 20 bp, Unknown
  RNA secondary structure sequence
ctgggcagctggacactggg

SEQ ID NO: 27219 - DNA, 20 bp, Unknown
  RNA secondary structure sequence
ctcttgagatctccggttgg

SEQ ID NO: 27220 - DNA, 20 bp, Unknown
  RNA secondary structure sequence
ctaatgcccaggaacatggc

SEQ ID NO: 27221 - DNA, 20 bp, Unknown
  RNA secondary structure sequence
gagatgattaaggccccgct

SEQ ID NO: 27222 - DNA, 20 bp, Unknown
  RNA secondary structure sequence
gtgggttgcaggaggtgctt

SEQ ID NO: 27223 - DNA, 20 bp, Unknown
  RNA secondary structure sequence
gtgggttgcaggtggtgctt

SEQ ID NO: 27224 - DNA, 20 bp, Unknown
  RNA secondary structure sequence
cgagtggcggctgcagcagc

SEQ ID NO: 27225 - DNA, 20 bp, Unknown
  RNA secondary structure sequence
aaccatgggctgctgtggct

SEQ ID NO: 27226 - DNA, 20 bp, Unknown
  RNA secondary structure sequence
ccggaggcgggagtcacagg

SEQ ID NO: 27227 - DNA, 20 bp, Unknown
  RNA secondary structure sequence
gcacaaggtgtcttttggta

SEQ ID NO: 27228 - DNA, 20 bp, Unknown
  RNA secondary structure sequence
gaaaagcggcccgacctgct

SEQ ID NO: 27229 - DNA, 20 bp, Unknown
  RNA secondary structure sequence
gcataccagatctcaccaga

SEQ ID NO: 27230 - DNA, 20 bp, Unknown
  RNA secondary structure sequence
cagcgaagtctactcccctc

SEQ ID NO: 27231 - DNA, 20 bp, Unknown
  RNA secondary structure sequence
ccatgcctgaaccggcaaaa

SEQ ID NO: 27232 - DNA, 20 bp, Unknown
  RNA secondary structure sequence
actagttttgttagatagtc

SEQ ID NO: 27233 - DNA, 20 bp, Unknown
  RNA secondary structure sequence
gctccagcgccagcgcagcc

SEQ ID NO: 27234 - DNA, 20 bp, Unknown
  RNA secondary structure sequence
ttaagccacaaaaaagccac

SEQ ID NO: 27235 - DNA, 20 bp, Unknown
  RNA secondary structure sequence
tgggatctggctacgccaga

SEQ ID NO: 27236 - DNA, 20 bp, Unknown
  RNA secondary structure sequence
gacgtcatcggggcgccgga

SEQ ID NO: 27237 - DNA, 20 bp, Unknown
  RNA secondary structure sequence
ggctaaagctgggagactga

SEQ ID NO: 27238 - DNA, 20 bp, Unknown
  RNA secondary structure sequence
cgggaccttcgcgacacacc

SEQ ID NO: 27239 - DNA, 20 bp, Unknown
  RNA secondary structure sequence
ccttgggaagaggatgatcc

SEQ ID NO: 27240 - DNA, 20 bp, Unknown
  RNA secondary structure sequence
caagtcctcggcagcctgat

SEQ ID NO: 27241 - DNA, 20 bp, Unknown
  RNA secondary structure sequence
gccccccaggctcccagacc

SEQ ID NO: 27242 - DNA, 20 bp, Unknown
  RNA secondary structure sequence
gactaccactgctttttcct

SEQ ID NO: 27243 - DNA, 20 bp, Unknown
  RNA secondary structure sequence
acttgagtgagatgagagag

SEQ ID NO: 27244 - DNA, 20 bp, Unknown
  RNA secondary structure sequence
ctccattctgggctcttgcc

SEQ ID NO: 27245 - DNA, 20 bp, Unknown
  RNA secondary structure sequence
gggacagcagagaagaaact

SEQ ID NO: 27246 - DNA, 20 bp, Unknown
  RNA secondary structure sequence
gatttgcaacatcctcaaag

SEQ ID NO: 27247 - DNA, 20 bp, Unknown
  RNA secondary structure sequence
tcctcctcccttgtcttaac

SEQ ID NO: 27248 - DNA, 20 bp, Unknown
  RNA secondary structure sequence
tctctggaagagaaaggaag

SEQ ID NO: 27249 - DNA, 20 bp, Unknown
  RNA secondary structure sequence
gtgtgttttgctctccagcc

SEQ ID NO: 27250 - DNA, 20 bp, Unknown
  RNA secondary structure sequence
aacccagaagtctcaagttt

SEQ ID NO: 27251 - DNA, 20 bp, Unknown
  RNA secondary structure sequence
ccattcaccggagcgcgcag

SEQ ID NO: 27252 - DNA, 20 bp, Unknown
  RNA secondary structure sequence
cgctgttgagaagctacccg

SEQ ID NO: 27253 - DNA, 20 bp, Unknown
  RNA secondary structure sequence
agaaaggaggagggcgctcc

SEQ ID NO: 27254 - DNA, 20 bp, Unknown
  RNA secondary structure sequence
gtgtgcccgctctccaagaa

SEQ ID NO: 27255 - DNA, 20 bp, Unknown
  RNA secondary structure sequence
ctgcttggatggtgtcttcc

SEQ ID NO: 27256 - DNA, 20 bp, Unknown
  RNA secondary structure sequence
attacgctctctacggcctg

SEQ ID NO: 27257 - DNA, 20 bp, Unknown
  RNA secondary structure sequence
acacgaagcttgcttctgcc

SEQ ID NO: 27258 - DNA, 20 bp, Unknown
  RNA secondary structure sequence
tgtggcgggatagttttcgg

SEQ ID NO: 27259 - DNA, 20 bp, Unknown
  RNA secondary structure sequence
agcgtgggctgacgcctcgc

SEQ ID NO: 27260 - DNA, 20 bp, Unknown
  RNA secondary structure sequence
tactcggagactgcgccgcg

SEQ ID NO: 27261 - DNA, 20 bp, Unknown
  RNA secondary structure sequence
tcttctcgcggatccagtgt

SEQ ID NO: 27262 - DNA, 20 bp, Unknown
  RNA secondary structure sequence
tgtgtgtccctctgagagtt

SEQ ID NO: 27263 - DNA, 20 bp, Unknown
  RNA secondary structure sequence
tagcgttcgtctggagtagc

SEQ ID NO: 27264 - DNA, 20 bp, Unknown
  RNA secondary structure sequence
gcagtactcgctgggctgag

SEQ ID NO: 27265 - DNA, 20 bp, Unknown
  RNA secondary structure sequence
tgtctcctccacctagcagt

SEQ ID NO: 27266 - DNA, 20 bp, Unknown
  RNA secondary structure sequence
gtcccttcttagctctcgcc

SEQ ID NO: 27267 - DNA, 20 bp, Unknown
  RNA secondary structure sequence
ctagctgctcgcacaggact

SEQ ID NO: 27268 - DNA, 20 bp, Unknown
  RNA secondary structure sequence
aggctgaaccacaaaaggcc

SEQ ID NO: 27269 - DNA, 20 bp, Unknown
  RNA secondary structure sequence
ggaaccaaggtgccagtgag

SEQ ID NO: 27270 - DNA, 20 bp, Unknown
  RNA secondary structure sequence
ccactccgccagaaggtcgc

SEQ ID NO: 27271 - DNA, 20 bp, Unknown
  RNA secondary structure sequence
aattcttctgtgggatcaga

SEQ ID NO: 27272 - DNA, 20 bp, Unknown
  RNA secondary structure sequence
ccagcgaccctaaagcttcc

SEQ ID NO: 27273 - DNA, 20 bp, Unknown
  RNA secondary structure sequence
tggcctaggctttgcctatt

SEQ ID NO: 27274 - DNA, 20 bp, Unknown
  RNA secondary structure sequence
atgaaagatgtacatgactt

SEQ ID NO: 27275 - DNA, 20 bp, Unknown
  RNA secondary structure sequence
cgacgcgtctttgtggtaac

SEQ ID NO: 27276 - DNA, 20 bp, Unknown
  RNA secondary structure sequence
attcctttggctcctccgaa

SEQ ID NO: 27277 - DNA, 20 bp, Unknown
  RNA secondary structure sequence
cagccattcctgaggaggac

SEQ ID NO: 27278 - DNA, 20 bp, Unknown
  RNA secondary structure sequence
taacccgctgaaagtttctc

SEQ ID NO: 27279 - DNA, 20 bp, Unknown
  RNA secondary structure sequence
tgctgctggtaacagggcct

SEQ ID NO: 27280 - DNA, 20 bp, Unknown
  RNA secondary structure sequence
tggaagcggatcgcgtggag

SEQ ID NO: 27281 - DNA, 20 bp, Unknown
  RNA secondary structure sequence
cccagatcttctcaactgga

SEQ ID NO: 27282 - DNA, 20 bp, Unknown
  RNA secondary structure sequence
gctggtaacagggccttgcc

SEQ ID NO: 27283 - DNA, 20 bp, Unknown
  RNA secondary structure sequence
ctgagacggccttggccgga

SEQ ID NO: 27284 - DNA, 20 bp, Unknown
  RNA secondary structure sequence
ggctcttctcggcgtgctgc

SEQ ID NO: 27285 - DNA, 20 bp, Unknown
  RNA secondary structure sequence
cccacgagccgaggcctcct

SEQ ID NO: 27286 - DNA, 20 bp, Unknown
  RNA secondary structure sequence
tgggctgctgcgcgccgcct

SEQ ID NO: 27287 - DNA, 20 bp, Unknown
  RNA secondary structure sequence
ccctgagccccagatctgac

SEQ ID NO: 27288 - DNA, 20 bp, Unknown
  RNA secondary structure sequence
ggcgcaacccacggctgctg

SEQ ID NO: 27289 - DNA, 20 bp, Unknown
  RNA secondary structure sequence
taggggcttcatctctctgc

SEQ ID NO: 27290 - DNA, 20 bp, Unknown
  RNA secondary structure sequence
accctagagaaatgagttgt

SEQ ID NO: 27291 - DNA, 20 bp, Unknown
  RNA secondary structure sequence
agttggaatgaatgatcaga

SEQ ID NO: 27292 - DNA, 20 bp, Unknown
  RNA secondary structure sequence
aggcggtagagcggagaaag

SEQ ID NO: 27293 - DNA, 20 bp, Unknown
  RNA secondary structure sequence
gttttaatagacctacggca

SEQ ID NO: 27294 - DNA, 20 bp, Unknown
  RNA secondary structure sequence
gctagcccgcagcgctcggc

SEQ ID NO: 27295 - DNA, 20 bp, Unknown
  RNA secondary structure sequence
ctcccgctgcgaagcagcgc

SEQ ID NO: 27296 - DNA, 20 bp, Unknown
  RNA secondary structure sequence
tcctgtgtgaaattgcttct

SEQ ID NO: 27297 - DNA, 20 bp, Unknown
  RNA secondary structure sequence
tgatgatttgtcattctagt

SEQ ID NO: 27298 - DNA, 20 bp, Unknown
  RNA secondary structure sequence
aagcgggtcctacgcacgct

SEQ ID NO: 27299 - DNA, 20 bp, Unknown
  RNA secondary structure sequence
cccacagatgctagaagctt

SEQ ID NO: 27300 - DNA, 20 bp, Unknown
  RNA secondary structure sequence
gcgttgttctggattcccgt

SEQ ID NO: 27301 - DNA, 20 bp, Unknown
  RNA secondary structure sequence
tcaccttgagccgggcgagc

SEQ ID NO: 27302 - DNA, 20 bp, Unknown
  RNA secondary structure sequence
ttggcgtcccatgactccac

SEQ ID NO: 27303 - DNA, 20 bp, Unknown
  RNA secondary structure sequence
cgcaacggatcgtttccgga

SEQ ID NO: 27304 - DNA, 20 bp, Unknown
  RNA secondary structure sequence
gcgaaatgttcttttggggc

SEQ ID NO: 27305 - DNA, 20 bp, Unknown
  RNA secondary structure sequence
gataccgagtccgcaacccc

SEQ ID NO: 27306 - DNA, 20 bp, Unknown
  RNA secondary structure sequence
actgtcaagacatttcttcg

SEQ ID NO: 27307 - DNA, 20 bp, Unknown
  RNA secondary structure sequence
ttgcatctcttcgcctctcg

SEQ ID NO: 27308 - DNA, 20 bp, Unknown
  RNA secondary structure sequence
ctaatgccagaatttgaaag

SEQ ID NO: 27309 - DNA, 20 bp, Unknown
  RNA secondary structure sequence
tcccgcgacaggaacatggc

SEQ ID NO: 27310 - DNA, 20 bp, Unknown
  RNA secondary structure sequence
ctctcagcgaaggccgaaaa

SEQ ID NO: 27311 - DNA, 20 bp, Unknown
  RNA secondary structure sequence
ttacagagaaggcagagatc

SEQ ID NO: 27312 - DNA, 20 bp, Unknown
  RNA secondary structure sequence
ttacagagggcatcacctag

SEQ ID NO: 27313 - DNA, 20 bp, Unknown
  RNA secondary structure sequence
acttgtgaaaggcagagatc

SEQ ID NO: 27314 - DNA, 20 bp, Unknown
  RNA secondary structure sequence
tgggacaagtgaaaatgtct

SEQ ID NO: 27315 - DNA, 20 bp, Unknown
  RNA secondary structure sequence
acctgcaggcattttgtgaa

SEQ ID NO: 27316 - DNA, 20 bp, Unknown
  RNA secondary structure sequence
tgtgcgggtttaataaaaaa

SEQ ID NO: 27317 - DNA, 20 bp, Unknown
  RNA secondary structure sequence
cccggcccaaccaagtttaa

SEQ ID NO: 27318 - DNA, 20 bp, Unknown
  RNA secondary structure sequence
aaacttaatgatctaagcgt

SEQ ID NO: 27319 - DNA, 20 bp, Unknown
  RNA secondary structure sequence
cattgttcccagccggatcc

SEQ ID NO: 27320 - DNA, 20 bp, Unknown
  RNA secondary structure sequence
gtaaaccgatcagatctagt

SEQ ID NO: 27321 - DNA, 20 bp, Unknown
  RNA secondary structure sequence
cgagcctcccaagatggcgg

SEQ ID NO: 27322 - DNA, 20 bp, Unknown
  RNA secondary structure sequence
ctgggtggtctaagtcctga

SEQ ID NO: 27323 - DNA, 20 bp, Unknown
  RNA secondary structure sequence
ctgggtggatctttaaaccc

SEQ ID NO: 27324 - DNA, 20 bp, Unknown
  RNA secondary structure sequence
gcataacttctaagtcctga

SEQ ID NO: 27325 - DNA, 20 bp, Unknown
  RNA secondary structure sequence
tagtggttcgcgcaacacgc

SEQ ID NO: 27326 - DNA, 20 bp, Unknown
  RNA secondary structure sequence
ggagccggctcccgggcgcg

SEQ ID NO: 27327 - DNA, 20 bp, Unknown
  RNA secondary structure sequence
tggaggttcttgtctcccct

SEQ ID NO: 27328 - DNA, 20 bp, Unknown
  RNA secondary structure sequence
accagtagcaaatgagatga

SEQ ID NO: 27329 - DNA, 20 bp, Unknown
  RNA secondary structure sequence
ttatctctccacgaatccag

SEQ ID NO: 27330 - DNA, 20 bp, Unknown
  RNA secondary structure sequence
cctcactaccacgaatccag

SEQ ID NO: 27331 - DNA, 20 bp, Unknown
  RNA secondary structure sequence
ctctcaccattgcaacagta

SEQ ID NO: 27332 - DNA, 20 bp, Unknown
  RNA secondary structure sequence
tttgtttttggcggaactac

SEQ ID NO: 27333 - DNA, 20 bp, Unknown
  RNA secondary structure sequence
aaatggggcaaataagaatt

SEQ ID NO: 27334 - DNA, 20 bp, Unknown
  RNA secondary structure sequence
ttgaacaccaaataagaatt

SEQ ID NO: 27335 - DNA, 20 bp, Unknown
  RNA secondary structure sequence
tgcagcagttcttggtattg

SEQ ID NO: 27336 - DNA, 20 bp, Unknown
  RNA secondary structure sequence
gagtaaaagggatttcaggc

SEQ ID NO: 27337 - DNA, 20 bp, Unknown
  RNA secondary structure sequence
gagtaaaatcatgcaagatg

SEQ ID NO: 27338 - DNA, 20 bp, Unknown
  RNA secondary structure sequence
cctcccactgtctcttgtat

SEQ ID NO: 27339 - DNA, 20 bp, Unknown
  RNA secondary structure sequence
agatatttccaatgcgacgg

SEQ ID NO: 27340 - DNA, 20 bp, Unknown
  RNA secondary structure sequence
agatatttgtgcctaatgca

SEQ ID NO: 27341 - DNA, 20 bp, Unknown
  RNA secondary structure sequence
tttatatcttctgtatatta

SEQ ID NO: 27342 - DNA, 20 bp, Unknown
  RNA secondary structure sequence
atgtgtgtgtatgtatatgt

SEQ ID NO: 27343 - DNA, 20 bp, Unknown
  RNA secondary structure sequence
tgaaagcgtttgtgttcatc

SEQ ID NO: 27344 - DNA, 20 bp, Unknown
  RNA secondary structure sequence
gcctctctttgaacctctcc

SEQ ID NO: 27345 - DNA, 20 bp, Unknown
  RNA secondary structure sequence
ttagtatcttgaacctctcc

SEQ ID NO: 27346 - DNA, 20 bp, Unknown
  RNA secondary structure sequence
tcccgggggggtcccgcctc

SEQ ID NO: 27347 - DNA, 20 bp, Unknown
  RNA secondary structure sequence
gtgttctccgagttcctgtc

SEQ ID NO: 27348 - DNA, 20 bp, Unknown
  RNA secondary structure sequence
aaaagggaagaaaaacaaaa

SEQ ID NO: 27349 - DNA, 20 bp, Unknown
  RNA secondary structure sequence
aaaagggactctttcagggt

SEQ ID NO: 27350 - DNA, 20 bp, Unknown
  RNA secondary structure sequence
tgtcttaacagtggatgcat

SEQ ID NO: 27351 - DNA, 20 bp, Unknown
  RNA secondary structure sequence
ctctcatccagtggatgcat

SEQ ID NO: 27352 - DNA, 20 bp, Unknown
  RNA secondary structure sequence
ctctcatcggacttgatatg

SEQ ID NO: 27353 - DNA, 20 bp, Unknown
  RNA secondary structure sequence
acggtcgggccctggaagga

SEQ ID NO: 27354 - DNA, 20 bp, Unknown
  RNA secondary structure sequence
aagcctcttttggcttctct

SEQ ID NO: 27355 - DNA, 20 bp, Unknown
  RNA secondary structure sequence
caggctgggctgcaggctct

SEQ ID NO: 27356 - DNA, 20 bp, Unknown
  RNA secondary structure sequence
ctgatgcgtgccctactctc

SEQ ID NO: 27357 - DNA, 20 bp, Unknown
  RNA secondary structure sequence
agttcactggtgcaatgagg

SEQ ID NO: 27358 - DNA, 20 bp, Unknown
  RNA secondary structure sequence
gtggggtaggtgcaatgagg

SEQ ID NO: 27359 - DNA, 20 bp, Unknown
  RNA secondary structure sequence
atgagacggacacaccttaa

SEQ ID NO: 27360 - DNA, 20 bp, Unknown
  RNA secondary structure sequence
catgccaagacacaccttaa

SEQ ID NO: 27361 - DNA, 20 bp, Unknown
  RNA secondary structure sequence
catgccaatggcataacact

SEQ ID NO: 27362 - DNA, 20 bp, Unknown
  RNA secondary structure sequence
aggaggctgcgaggagccgg

SEQ ID NO: 27363 - DNA, 20 bp, Unknown
  RNA secondary structure sequence
ggatctgcagctgggcaccg

SEQ ID NO: 27364 - DNA, 20 bp, Unknown
  RNA secondary structure sequence
ggatctgcagctgggctagc

SEQ ID NO: 27365 - DNA, 20 bp, Unknown
  RNA secondary structure sequence
atgctgatgaagataataat

SEQ ID NO: 27366 - DNA, 20 bp, Unknown
  RNA secondary structure sequence
cagcaccgctccttgggtcc

SEQ ID NO: 27367 - DNA, 20 bp, Unknown
  RNA secondary structure sequence
caggagagcgcggattggtc

SEQ ID NO: 27368 - DNA, 20 bp, Unknown
  RNA secondary structure sequence
cctctgctggtgaccagaag

SEQ ID NO: 27369 - DNA, 20 bp, Unknown
  RNA secondary structure sequence
gtctacggggtgaccagaag

SEQ ID NO: 27370 - DNA, 20 bp, Unknown
  RNA secondary structure sequence
tattctagtacacttaggat

SEQ ID NO: 27371 - DNA, 20 bp, Unknown
  RNA secondary structure sequence
cgcggctgcgcttcggtccc

SEQ ID NO: 27372 - DNA, 20 bp, Unknown
  RNA secondary structure sequence
gcgaaggccgaaaagaggct

SEQ ID NO: 27373 - DNA, 20 bp, Unknown
  RNA secondary structure sequence
gcgaaggcactgtgattctc

SEQ ID NO: 27374 - DNA, 20 bp, Unknown
  RNA secondary structure sequence
tagtgctatttttgtattta

SEQ ID NO: 27375 - DNA, 20 bp, Unknown
  RNA secondary structure sequence
ctcagaaacacagcaagcga

SEQ ID NO: 27376 - DNA, 20 bp, Unknown
  RNA secondary structure sequence
cgctggtaaacatccacacg

SEQ ID NO: 27377 - DNA, 20 bp, Unknown
  RNA secondary structure sequence
aacggaaaatcatcggccgt

SEQ ID NO: 27378 - DNA, 20 bp, Unknown
  RNA secondary structure sequence
acttttttccgtttcgtagt

SEQ ID NO: 27379 - DNA, 20 bp, Unknown
  RNA secondary structure sequence
ctcctggcgccagcgctagg

SEQ ID NO: 27380 - DNA, 20 bp, Unknown
  RNA secondary structure sequence
tttctccgggatccaagaga

SEQ ID NO: 27381 - DNA, 20 bp, Unknown
  RNA secondary structure sequence
aaaacttaggatccaagaga

SEQ ID NO: 27382 - DNA, 20 bp, Unknown
  RNA secondary structure sequence
agtgattggcctgtcgtaac

SEQ ID NO: 27383 - DNA, 20 bp, Unknown
  RNA secondary structure sequence
tagtccatgcctgtcgtaac

SEQ ID NO: 27384 - DNA, 20 bp, Unknown
  RNA secondary structure sequence
cactatctgctagacctaga

SEQ ID NO: 27385 - DNA, 20 bp, Unknown
  RNA secondary structure sequence
tgtggcctcattctgaacaa

SEQ ID NO: 27386 - DNA, 20 bp, Unknown
  RNA secondary structure sequence
tgtggccttccaggtggttg

SEQ ID NO: 27387 - DNA, 20 bp, Unknown
  RNA secondary structure sequence
aggcagggcggcgcaggatc

SEQ ID NO: 27388 - DNA, 20 bp, Unknown
  RNA secondary structure sequence
gaaagcgaaagggaaaccag

SEQ ID NO: 27389 - DNA, 20 bp, Unknown
  RNA secondary structure sequence
aggacatcagcgacagcgag

SEQ ID NO: 27390 - DNA, 20 bp, Unknown
  RNA secondary structure sequence
cgaattcttatacagtagat

SEQ ID NO: 27391 - DNA, 20 bp, Unknown
  RNA secondary structure sequence
aggttaataaattacaagta

SEQ ID NO: 27392 - DNA, 20 bp, Unknown
  RNA secondary structure sequence
aggttaatccggcgttgtct

SEQ ID NO: 27393 - DNA, 20 bp, Unknown
  RNA secondary structure sequence
aattactcagtttcaaaagg

SEQ ID NO: 27394 - DNA, 20 bp, Unknown
  RNA secondary structure sequence
ctgtctctgctgtgtggtgg

SEQ ID NO: 27395 - DNA, 20 bp, Unknown
  RNA secondary structure sequence
tcatttggccttaaatggga

SEQ ID NO: 27396 - DNA, 20 bp, Unknown
  RNA secondary structure sequence
cagggaccccttaaatggga

SEQ ID NO: 27397 - DNA, 20 bp, Unknown
  RNA secondary structure sequence
agccaaacactccattggga

SEQ ID NO: 27398 - DNA, 20 bp, Unknown
  RNA secondary structure sequence
gatcaaaagtaagaaaaact

SEQ ID NO: 27399 - DNA, 20 bp, Unknown
  RNA secondary structure sequence
ttagtttggtaagaaaaact

SEQ ID NO: 27400 - DNA, 20 bp, Unknown
  RNA secondary structure sequence
ctgctggtggggtagggatg

SEQ ID NO: 27401 - DNA, 20 bp, Unknown
  RNA secondary structure sequence
ttaggtgtcatacctaagat

SEQ ID NO: 27402 - DNA, 20 bp, Unknown
  RNA secondary structure sequence
gcgttgtccatacctaagat

SEQ ID NO: 27403 - DNA, 20 bp, Unknown
  RNA secondary structure sequence
tcctgggcctgcccatccaa

SEQ ID NO: 27404 - DNA, 20 bp, Unknown
  RNA secondary structure sequence
tcctgggctaatgggcgacg

SEQ ID NO: 27405 - DNA, 20 bp, Unknown
  RNA secondary structure sequence
actctgcagcggaaccgact

SEQ ID NO: 27406 - DNA, 20 bp, Unknown
  RNA secondary structure sequence
gttaccatatagctattgga

SEQ ID NO: 27407 - DNA, 20 bp, Unknown
  RNA secondary structure sequence
ctacaccttggtctttccgg

SEQ ID NO: 27408 - DNA, 20 bp, Unknown
  RNA secondary structure sequence
acctccatagaggagcagca

SEQ ID NO: 27409 - DNA, 20 bp, Unknown
  RNA secondary structure sequence
ggtcagggcttgggcgctag

SEQ ID NO: 27410 - DNA, 20 bp, Unknown
  RNA secondary structure sequence
tcacctctttacaaaaccac

SEQ ID NO: 27411 - DNA, 20 bp, Unknown
  RNA secondary structure sequence
agtatagtgccggccgccca

SEQ ID NO: 27412 - DNA, 20 bp, Unknown
  RNA secondary structure sequence
ccaccccggccggccgccca

SEQ ID NO: 27413 - DNA, 20 bp, Unknown
  RNA secondary structure sequence
gaacagatgatgataaacct

SEQ ID NO: 27414 - DNA, 20 bp, Unknown
  RNA secondary structure sequence
ccgtctgggatgataaacct

SEQ ID NO: 27415 - DNA, 20 bp, Unknown
  RNA secondary structure sequence
aaatagaagatttatttggg

SEQ ID NO: 27416 - DNA, 20 bp, Unknown
  RNA secondary structure sequence
agactcaaaatgtatggccc

SEQ ID NO: 27417 - DNA, 20 bp, Unknown
  RNA secondary structure sequence
ttatcataaagcgagttgga

SEQ ID NO: 27418 - DNA, 20 bp, Unknown
  RNA secondary structure sequence
aggcagaagtatgcaaagca

SEQ ID NO: 27419 - DNA, 20 bp, Unknown
  RNA secondary structure sequence
tccacccggtatgcaaagca

SEQ ID NO: 27420 - DNA, 20 bp, Unknown
  RNA secondary structure sequence
tgctcactcagcacaggatc

SEQ ID NO: 27421 - DNA, 20 bp, Unknown
  RNA secondary structure sequence
tgctcactggtggggctcct

SEQ ID NO: 27422 - DNA, 20 bp, Unknown
  RNA secondary structure sequence
cgggtggaacgagagggaac

SEQ ID NO: 27423 - DNA, 20 bp, Unknown
  RNA secondary structure sequence
cgggtggacgagccccacta

SEQ ID NO: 27424 - DNA, 20 bp, Unknown
  RNA secondary structure sequence
taccgaacacgagagggaac

SEQ ID NO: 27425 - DNA, 20 bp, Unknown
  RNA secondary structure sequence
tagggactgttctcttcaca

SEQ ID NO: 27426 - DNA, 20 bp, Unknown
  RNA secondary structure sequence
accttcaggttctcttcaca

SEQ ID NO: 27427 - DNA, 20 bp, Unknown
  RNA secondary structure sequence
gaagcgccggcctcggggct

SEQ ID NO: 27428 - DNA, 20 bp, Unknown
  RNA secondary structure sequence
atgtgtgatccagatatgct

SEQ ID NO: 27429 - DNA, 20 bp, Unknown
  RNA secondary structure sequence
ccgccccttcagccccggct

SEQ ID NO: 27430 - DNA, 20 bp, Unknown
  RNA secondary structure sequence
ggaaagacaggtccttaggt

SEQ ID NO: 27431 - DNA, 20 bp, Unknown
  RNA secondary structure sequence
ggaaagaccatcgggctcaa

SEQ ID NO: 27432 - DNA, 20 bp, Unknown
  RNA secondary structure sequence
agccggggcggaaaggctgc

SEQ ID NO: 27433 - DNA, 20 bp, Unknown
  RNA secondary structure sequence
caagcctacggaaaggctgc

SEQ ID NO: 27434 - DNA, 20 bp, Unknown
  RNA secondary structure sequence
agcaactaatcgaatcaaca

SEQ ID NO: 27435 - DNA, 20 bp, Unknown
  RNA secondary structure sequence
acctactggaaataacataa

SEQ ID NO: 27436 - DNA, 20 bp, Unknown
  RNA secondary structure sequence
acacgcttccctggattggc

SEQ ID NO: 27437 - DNA, 20 bp, Unknown
  RNA secondary structure sequence
ttcggagaggcagcgcggtt

SEQ ID NO: 27438 - DNA, 20 bp, Unknown
  RNA secondary structure sequence
ggaaattggccgcccgagcg

SEQ ID NO: 27439 - DNA, 20 bp, Unknown
  RNA secondary structure sequence
gttgacaatcccagtggggg

SEQ ID NO: 27440 - DNA, 20 bp, Unknown
  RNA secondary structure sequence
tcttctagactaggtgcgag

SEQ ID NO: 27441 - DNA, 20 bp, Unknown
  RNA secondary structure sequence
tcttctagttcgtcccatgt

SEQ ID NO: 27442 - DNA, 20 bp, Unknown
  RNA secondary structure sequence
cttcttgtgttttgttgtct

SEQ ID NO: 27443 - DNA, 20 bp, Unknown
  RNA secondary structure sequence
atgccaattttctcgagaaa

SEQ ID NO: 27444 - DNA, 20 bp, Unknown
  RNA secondary structure sequence
agagcataaggaatctactt

SEQ ID NO: 27445 - DNA, 20 bp, Unknown
  RNA secondary structure sequence
acttgaccaggagactgaag

SEQ ID NO: 27446 - DNA, 20 bp, Unknown
  RNA secondary structure sequence
cggactgaaggagactgaag

SEQ ID NO: 27447 - DNA, 20 bp, Unknown
  RNA secondary structure sequence
attgggcgggctgccacggc

SEQ ID NO: 27448 - DNA, 20 bp, Unknown
  RNA secondary structure sequence
gagaatctagttattagaca

SEQ ID NO: 27449 - DNA, 20 bp, Unknown
  RNA secondary structure sequence
gagaatctcccatgatttgc

SEQ ID NO: 27450 - DNA, 20 bp, Unknown
  RNA secondary structure sequence
ctagccacagctaactgccc

SEQ ID NO: 27451 - DNA, 20 bp, Unknown
  RNA secondary structure sequence
gataaataagctaactgccc

SEQ ID NO: 27452 - DNA, 20 bp, Unknown
  RNA secondary structure sequence
ctcacagtaaaatagcacag

SEQ ID NO: 27453 - DNA, 20 bp, Unknown
  RNA secondary structure sequence
tgttgctattagaggttctt

SEQ ID NO: 27454 - DNA, 20 bp, Unknown
  RNA secondary structure sequence
cagaatgcttagaggttctt

SEQ ID NO: 27455 - DNA, 20 bp, Unknown
  RNA secondary structure sequence
gacattctttgaagtgaagc

SEQ ID NO: 27456 - DNA, 20 bp, Unknown
  RNA secondary structure sequence
cctgggagtctcggaggggg

SEQ ID NO: 27457 - DNA, 20 bp, Unknown
  RNA secondary structure sequence
cctgggagtctcggagggga

SEQ ID NO: 27458 - DNA, 20 bp, Unknown
  RNA secondary structure sequence
agaccatatctcggagggga

SEQ ID NO: 27459 - DNA, 20 bp, Unknown
  RNA secondary structure sequence
gcggcgccgccagagtctga

SEQ ID NO: 27460 - DNA, 20 bp, Unknown
  RNA secondary structure sequence
tcgaatcatgcacacctgtt

SEQ ID NO: 27461 - DNA, 20 bp, Unknown
  RNA secondary structure sequence
aattcatttgcacacctgtt

SEQ ID NO: 27462 - DNA, 20 bp, Unknown
  RNA secondary structure sequence
ttcgtcgatgttggagtgtc

SEQ ID NO: 27463 - DNA, 20 bp, Unknown
  RNA secondary structure sequence
ctctacctcaccgtccaggg

SEQ ID NO: 27464 - DNA, 20 bp, Unknown
  RNA secondary structure sequence
tctagagccaccgtccaggg

SEQ ID NO: 27465 - DNA, 20 bp, Unknown
  RNA secondary structure sequence
tcacccttgacttggggagc

SEQ ID NO: 27466 - DNA, 20 bp, Unknown
  RNA secondary structure sequence
tatccgcctacgtatttccg

SEQ ID NO: 27467 - DNA, 20 bp, Unknown
  RNA secondary structure sequence
gcgaaaattacgtatttccg

SEQ ID NO: 27468 - DNA, 20 bp, Unknown
  RNA secondary structure sequence
ccttcccattcaccctagtc

SEQ ID NO: 27469 - DNA, 20 bp, Unknown
  RNA secondary structure sequence
caccgacccggggccggggc

SEQ ID NO: 27470 - DNA, 20 bp, Unknown
  RNA secondary structure sequence
ggggagggacatatacttct

SEQ ID NO: 27471 - DNA, 20 bp, Unknown
  RNA secondary structure sequence
ggggagggcggggccggggc

SEQ ID NO: 27472 - DNA, 20 bp, Unknown
  RNA secondary structure sequence
actggaaccccgcggggttc

SEQ ID NO: 27473 - DNA, 20 bp, Unknown
  RNA secondary structure sequence
actggaacttacaacacccg

SEQ ID NO: 27474 - DNA, 20 bp, Unknown
  RNA secondary structure sequence
cagtgcggagctcctgagac

SEQ ID NO: 27475 - DNA, 20 bp, Unknown
  RNA secondary structure sequence
cagatgaggagactgtcctt

SEQ ID NO: 27476 - DNA, 20 bp, Unknown
  RNA secondary structure sequence
agcactgagtttagtaatag

SEQ ID NO: 27477 - DNA, 20 bp, Unknown
  RNA secondary structure sequence
aacggaaaccaggtggaacc

SEQ ID NO: 27478 - DNA, 20 bp, Unknown
  RNA secondary structure sequence
ggccttaaatgggattctgt

SEQ ID NO: 27479 - DNA, 20 bp, Unknown
  RNA secondary structure sequence
ggagcctgggaggctgggtg

SEQ ID NO: 27480 - DNA, 20 bp, Unknown
  RNA secondary structure sequence
ccctcccaatcgatatgggc

SEQ ID NO: 27481 - DNA, 20 bp, Unknown
  RNA secondary structure sequence
ccctcccagcactatgccct

SEQ ID NO: 27482 - DNA, 20 bp, Unknown
  RNA secondary structure sequence
agaggtaggcactatgccct

SEQ ID NO: 27483 - DNA, 20 bp, Unknown
  RNA secondary structure sequence
gccaggtgtcctggggactc

SEQ ID NO: 27484 - DNA, 20 bp, Unknown
  RNA secondary structure sequence
aaggcagctcctggggactc

SEQ ID NO: 27485 - DNA, 20 bp, Unknown
  RNA secondary structure sequence
atcctcctctaaacgcgtgt

SEQ ID NO: 27486 - DNA, 20 bp, Unknown
  RNA secondary structure sequence
gcggatgcctaaacgcgtgt

SEQ ID NO: 27487 - DNA, 20 bp, Unknown
  RNA secondary structure sequence
agaactactgagaaaaacca

SEQ ID NO: 27488 - DNA, 20 bp, Unknown
  RNA secondary structure sequence
gtcactggttaacttaggat

SEQ ID NO: 27489 - DNA, 20 bp, Unknown
  RNA secondary structure sequence
ggatctgctctccggcaaag

SEQ ID NO: 27490 - DNA, 20 bp, Unknown
  RNA secondary structure sequence
aacatatttctccggcaaag

SEQ ID NO: 27491 - DNA, 20 bp, Unknown
  RNA secondary structure sequence
tgtttgggctaagacctggt

SEQ ID NO: 27492 - DNA, 20 bp, Unknown
  RNA secondary structure sequence
tgtttgggtatcagggaaaa

SEQ ID NO: 27493 - DNA, 20 bp, Unknown
  RNA secondary structure sequence
caatatggccggagctggcc

SEQ ID NO: 27494 - DNA, 20 bp, Unknown
  RNA secondary structure sequence
aactatggggtccgtgcgga

SEQ ID NO: 27495 - DNA, 20 bp, Unknown
  RNA secondary structure sequence
gcaggcagggtccgtgcgga

SEQ ID NO: 27496 - DNA, 20 bp, Unknown
  RNA secondary structure sequence
gtcccaaggcttcccagagc

SEQ ID NO: 27497 - DNA, 20 bp, Unknown
  RNA secondary structure sequence
ttagctctgtattaataata

SEQ ID NO: 27498 - DNA, 20 bp, Unknown
  RNA secondary structure sequence
attttttaccgaaaggcctg

SEQ ID NO: 27499 - DNA, 20 bp, Unknown
  RNA secondary structure sequence
gatgcttccaggagaatcaa

SEQ ID NO: 27500 - DNA, 20 bp, Unknown
  RNA secondary structure sequence
ttggagaagaagcactatct

SEQ ID NO: 27501 - DNA, 20 bp, Unknown
  RNA secondary structure sequence
gccccggggacttctctctg

SEQ ID NO: 27502 - DNA, 20 bp, Unknown
  RNA secondary structure sequence
gcccggggcgcggggtcgcc

SEQ ID NO: 27503 - DNA, 20 bp, Unknown
  RNA secondary structure sequence
tcaacctcgaaccgactact

SEQ ID NO: 27504 - DNA, 20 bp, Unknown
  RNA secondary structure sequence
cgccgcgggagcggttcgag

SEQ ID NO: 27505 - DNA, 20 bp, Unknown
  RNA secondary structure sequence
cgccgcggtgtgaaagtcga

SEQ ID NO: 27506 - DNA, 20 bp, Unknown
  RNA secondary structure sequence
ataaatttgagcggttcgag

SEQ ID NO: 27507 - DNA, 20 bp, Unknown
  RNA secondary structure sequence
caaggaggtgtacagccctg

SEQ ID NO: 27508 - DNA, 20 bp, Unknown
  RNA secondary structure sequence
ttgtactactaactcattaa

SEQ ID NO: 27509 - DNA, 20 bp, Unknown
  RNA secondary structure sequence
tgtgcggcgaggccgcccac

SEQ ID NO: 27510 - DNA, 20 bp, Unknown
  RNA secondary structure sequence
tgtgcggctccaggtgggct

SEQ ID NO: 27511 - DNA, 20 bp, Unknown
  RNA secondary structure sequence
aacatcagacaaagggccgc

SEQ ID NO: 27512 - DNA, 20 bp, Unknown
  RNA secondary structure sequence
ggaggacactcgcctaggat

SEQ ID NO: 27513 - DNA, 20 bp, Unknown
  RNA secondary structure sequence
aagtgagtctggtctgtggg

SEQ ID NO: 27514 - DNA, 20 bp, Unknown
  RNA secondary structure sequence
aagtgagtgcttctgccatc

SEQ ID NO: 27515 - DNA, 20 bp, Unknown
  RNA secondary structure sequence
gcaatcacgcttctgccatc

SEQ ID NO: 27516 - DNA, 20 bp, Unknown
  RNA secondary structure sequence
atgataggccaagatggcgg

SEQ ID NO: 27517 - DNA, 20 bp, Unknown
  RNA secondary structure sequence
cgcaagtccgtggcggaacc

SEQ ID NO: 27518 - DNA, 20 bp, Unknown
  RNA secondary structure sequence
tcggacagcacatgttagtc

SEQ ID NO: 27519 - DNA, 20 bp, Unknown
  RNA secondary structure sequence
aagaaggtccgggggctgga

SEQ ID NO: 27520 - DNA, 20 bp, Unknown
  RNA secondary structure sequence
cttgtgtgtagatctttggt

SEQ ID NO: 27521 - DNA, 20 bp, Unknown
  RNA secondary structure sequence
cttgtgtgcgatgggagatg

SEQ ID NO: 27522 - DNA, 20 bp, Unknown
  RNA secondary structure sequence
gcccgcaatagatctttggt

SEQ ID NO: 27523 - DNA, 20 bp, Unknown
  RNA secondary structure sequence
ccgctcaagatacttgttca

SEQ ID NO: 27524 - DNA, 20 bp, Unknown
  RNA secondary structure sequence
ccgctcaatgcctggagatt

SEQ ID NO: 27525 - DNA, 20 bp, Unknown
  RNA secondary structure sequence
agggagctaagctcaacgta

SEQ ID NO: 27526 - DNA, 20 bp, Unknown
  RNA secondary structure sequence
gttggcggtagttccaaccc

SEQ ID NO: 27527 - DNA, 20 bp, Unknown
  RNA secondary structure sequence
ccctaaaacagcaacgacac

SEQ ID NO: 27528 - DNA, 20 bp, Unknown
  RNA secondary structure sequence
aaccagtaagggaaccgccg

SEQ ID NO: 27529 - DNA, 20 bp, Unknown
  RNA secondary structure sequence
cgaacggcttgttggaatca

SEQ ID NO: 27530 - DNA, 20 bp, Unknown
  RNA secondary structure sequence
tagtgctattgttggaatca

SEQ ID NO: 27531 - DNA, 20 bp, Unknown
  RNA secondary structure sequence
ttcctccggactcctgcacg

SEQ ID NO: 27532 - DNA, 20 bp, Unknown
  RNA secondary structure sequence
aggacacccccgcccccccg

SEQ ID NO: 27533 - DNA, 20 bp, Unknown
  RNA secondary structure sequence
aggacaccgttaaaaaagac

SEQ ID NO: 27534 - DNA, 20 bp, Unknown
  RNA secondary structure sequence
catttttgcccgcccccccg

SEQ ID NO: 27535 - DNA, 20 bp, Unknown
  RNA secondary structure sequence
tgctgtagggccactgtctg

SEQ ID NO: 27536 - DNA, 20 bp, Unknown
  RNA secondary structure sequence
ctgcaggaggccactgtctg

SEQ ID NO: 27537 - DNA, 20 bp, Unknown
  RNA secondary structure sequence
gcgactgtgtccacggatgg

SEQ ID NO: 27538 - DNA, 20 bp, Unknown
  RNA secondary structure sequence
gtatttttaaaacttaggaa

SEQ ID NO: 27539 - DNA, 20 bp, Unknown
  RNA secondary structure sequence
acagccttcgctccagggga

SEQ ID NO: 27540 - DNA, 20 bp, Unknown
  RNA secondary structure sequence
acagccttgataatcactcg

SEQ ID NO: 27541 - DNA, 20 bp, Unknown
  RNA secondary structure sequence
ccgggtaggggagcgcagcg

SEQ ID NO: 27542 - DNA, 20 bp, Unknown
  RNA secondary structure sequence
gcgtcggatgttcagagcag

SEQ ID NO: 27543 - DNA, 20 bp, Unknown
  RNA secondary structure sequence
caactaattgttcagagcag

SEQ ID NO: 27544 - DNA, 20 bp, Unknown
  RNA secondary structure sequence
cggccgtccctgcggtcccg

SEQ ID NO: 27545 - DNA, 20 bp, Unknown
  RNA secondary structure sequence
ccaccaaggcggcgcagcgc

SEQ ID NO: 27546 - DNA, 20 bp, Unknown
  RNA secondary structure sequence
gagtagctaacgacctgatg

SEQ ID NO: 27547 - DNA, 20 bp, Unknown
  RNA secondary structure sequence
gagtagctgggattacaggc

SEQ ID NO: 27548 - DNA, 20 bp, Unknown
  RNA secondary structure sequence
cccaaagcacatcttaacct

SEQ ID NO: 27549 - DNA, 20 bp, Unknown
  RNA secondary structure sequence
gtatcgtgacatcttaacct

SEQ ID NO: 27550 - DNA, 20 bp, Unknown
  RNA secondary structure sequence
cccaaagccatagaggtagc

SEQ ID NO: 27551 - DNA, 20 bp, Unknown
  RNA secondary structure sequence
cccaaagcttcatggctgta

SEQ ID NO: 27552 - DNA, 20 bp, Unknown
  RNA secondary structure sequence
tactgctacatttttaagac

SEQ ID NO: 27553 - DNA, 20 bp, Unknown
  RNA secondary structure sequence
aagaagcgctaagagaggcc

SEQ ID NO: 27554 - DNA, 20 bp, Unknown
  RNA secondary structure sequence
tgctggggtcatgatggctc

SEQ ID NO: 27555 - DNA, 20 bp, Unknown
  RNA secondary structure sequence
ggctgaagtgtactacgctg

SEQ ID NO: 27556 - DNA, 20 bp, Unknown
  RNA secondary structure sequence
tatgcggcgccgactgtgat

SEQ ID NO: 27557 - DNA, 20 bp, Unknown
  RNA secondary structure sequence
tcctcggcccgcatattgac

SEQ ID NO: 27558 - DNA, 20 bp, Unknown
  RNA secondary structure sequence
tctcctccgggtgatgcttt

SEQ ID NO: 27559 - DNA, 20 bp, Unknown
  RNA secondary structure sequence
tctcctcctaaacgccggaa

SEQ ID NO: 27560 - DNA, 20 bp, Unknown
  RNA secondary structure sequence
cattcgccgagtttctaaac

SEQ ID NO: 27561 - DNA, 20 bp, Unknown
  RNA secondary structure sequence
ggctcagcgagagtgttctt

SEQ ID NO: 27562 - DNA, 20 bp, Unknown
  RNA secondary structure sequence
gagaactaggctgcagcagc

SEQ ID NO: 27563 - DNA, 20 bp, Unknown
  RNA secondary structure sequence
ctgctgctatagctggattt

SEQ ID NO: 27564 - DNA, 20 bp, Unknown
  RNA secondary structure sequence
gtggctaattgataggcagg

SEQ ID NO: 27565 - DNA, 20 bp, Unknown
  RNA secondary structure sequence
tcctgtaggaggagaaaacc

SEQ ID NO: 27566 - DNA, 20 bp, Unknown
  RNA secondary structure sequence
cttccctgtgctgtgagtgt

SEQ ID NO: 27567 - DNA, 20 bp, Unknown
  RNA secondary structure sequence
cttccctgccacagataaag

SEQ ID NO: 27568 - DNA, 20 bp, Unknown
  RNA secondary structure sequence
aacaggacgcgcgtgagctc

SEQ ID NO: 27569 - DNA, 20 bp, Unknown
  RNA secondary structure sequence
tccagcacaccaggcaaagc

SEQ ID NO: 27570 - DNA, 20 bp, Unknown
  RNA secondary structure sequence
tccagcacctgcaaatccag

SEQ ID NO: 27571 - DNA, 20 bp, Unknown
  RNA secondary structure sequence
gattgtaaaaaatttctaga

SEQ ID NO: 27572 - DNA, 20 bp, Unknown
  RNA secondary structure sequence
gattgtaagggccaagcttg

SEQ ID NO: 27573 - DNA, 20 bp, Unknown
  RNA secondary structure sequence
cgcctgcggggccaagcttg

SEQ ID NO: 27574 - DNA, 20 bp, Unknown
  RNA secondary structure sequence
aacagctggtttactggtca

SEQ ID NO: 27575 - DNA, 20 bp, Unknown
  RNA secondary structure sequence
aacagctgtagcgaccacac

SEQ ID NO: 27576 - DNA, 20 bp, Unknown
  RNA secondary structure sequence
ctacatgagagtcctccggc

SEQ ID NO: 27577 - DNA, 20 bp, Unknown
  RNA secondary structure sequence
ggctccccgagtcctccggc

SEQ ID NO: 27578 - DNA, 20 bp, Unknown
  RNA secondary structure sequence
cgtaatattcttgatcgggc

SEQ ID NO: 27579 - DNA, 20 bp, Unknown
  RNA secondary structure sequence
atacagcacgtaacaactgt

SEQ ID NO: 27580 - DNA, 20 bp, Unknown
  RNA secondary structure sequence
gctagttgcgtaacaactgt

SEQ ID NO: 27581 - DNA, 20 bp, Unknown
  RNA secondary structure sequence
agcaacaatctgagacacat

SEQ ID NO: 27582 - DNA, 20 bp, Unknown
  RNA secondary structure sequence
ggggtctgggggtgacattg

SEQ ID NO: 27583 - DNA, 20 bp, Unknown
  RNA secondary structure sequence
aaagtactactgaacaaagt

SEQ ID NO: 27584 - DNA, 20 bp, Unknown
  RNA secondary structure sequence
ctggtagtcctccggcccct

SEQ ID NO: 27585 - DNA, 20 bp, Unknown
  RNA secondary structure sequence
tagtgctatcttaataatta

SEQ ID NO: 27586 - DNA, 20 bp, Unknown
  RNA secondary structure sequence
taagactggaggaggaggag

SEQ ID NO: 27587 - DNA, 20 bp, Unknown
  RNA secondary structure sequence
ttgagaataggtaagtttct

SEQ ID NO: 27588 - DNA, 20 bp, Unknown
  RNA secondary structure sequence
gctgaagaaggctctgtgca

SEQ ID NO: 27589 - DNA, 20 bp, Unknown
  RNA secondary structure sequence
cagccaggaatataagctat

SEQ ID NO: 27590 - DNA, 20 bp, Unknown
  RNA secondary structure sequence
aagaactgtcgcgcaacttc

SEQ ID NO: 27591 - DNA, 20 bp, Unknown
  RNA secondary structure sequence
gtttttatattcgaagtagg

SEQ ID NO: 27592 - DNA, 20 bp, Unknown
  RNA secondary structure sequence
ctgcgcccaggtcctcccct

SEQ ID NO: 27593 - DNA, 20 bp, Unknown
  RNA secondary structure sequence
taataaatttaagagcagac

SEQ ID NO: 27594 - DNA, 20 bp, Unknown
  RNA secondary structure sequence
ctttctttcgattatcatca

SEQ ID NO: 27595 - DNA, 20 bp, Unknown
  RNA secondary structure sequence
tacaacagcgattatcatca

SEQ ID NO: 27596 - DNA, 20 bp, Unknown
  RNA secondary structure sequence
acgcggtctttctctagacg

SEQ ID NO: 27597 - DNA, 20 bp, Unknown
  RNA secondary structure sequence
gccagacctttgtaacaccc

SEQ ID NO: 27598 - DNA, 20 bp, Unknown
  RNA secondary structure sequence
aaagcgaattcatggggtct

SEQ ID NO: 27599 - DNA, 20 bp, Unknown
  RNA secondary structure sequence
gcgccgcggctcagggagga

SEQ ID NO: 27600 - DNA, 20 bp, Unknown
  RNA secondary structure sequence
actagtcactatacaataat

SEQ ID NO: 27601 - DNA, 20 bp, Unknown
  RNA secondary structure sequence
ctcttggaacaagataagac

SEQ ID NO: 27602 - DNA, 20 bp, Unknown
  RNA secondary structure sequence
actggtcccaggaccggcag

SEQ ID NO: 27603 - DNA, 20 bp, Unknown
  RNA secondary structure sequence
cttcgagatagccgccagga

SEQ ID NO: 27604 - DNA, 20 bp, Unknown
  RNA secondary structure sequence
gccaccttcctaatgtgttc

SEQ ID NO: 27605 - DNA, 20 bp, Unknown
  RNA secondary structure sequence
cagcgattccagaacaacat

SEQ ID NO: 27606 - DNA, 20 bp, Unknown
  RNA secondary structure sequence
acttggatttgatcttaatc

SEQ ID NO: 27607 - DNA, 20 bp, Unknown
  RNA secondary structure sequence
ttcacggtcgaacgagtatc

SEQ ID NO: 27608 - DNA, 20 bp, Unknown
  RNA secondary structure sequence
ttagcgcctaactgagcgtc

SEQ ID NO: 27609 - DNA, 20 bp, Unknown
  RNA secondary structure sequence
gaataacaactatgaacagg

SEQ ID NO: 27610 - DNA, 20 bp, Unknown
  RNA secondary structure sequence
gaataacagtctcttgacta

SEQ ID NO: 27611 - DNA, 20 bp, Unknown
  RNA secondary structure sequence
ccccgggtcaattcttggtt

SEQ ID NO: 27612 - DNA, 20 bp, Unknown
  RNA secondary structure sequence
tatgaaaacaattcttggtt

SEQ ID NO: 27613 - DNA, 20 bp, Unknown
  RNA secondary structure sequence
tctgggatataagaggcagc

SEQ ID NO: 27614 - DNA, 20 bp, Unknown
  RNA secondary structure sequence
gatggcggacgaagaggccg

SEQ ID NO: 27615 - DNA, 20 bp, Unknown
  RNA secondary structure sequence
gggcctcgctcaccggcggt

SEQ ID NO: 27616 - DNA, 20 bp, Unknown
  RNA secondary structure sequence
acgacgccgactaacgcccc

SEQ ID NO: 27617 - DNA, 20 bp, Unknown
  RNA secondary structure sequence
ttgttcgtcacttgtcgaca

SEQ ID NO: 27618 - DNA, 20 bp, Unknown
  RNA secondary structure sequence
gcgccctctcaccgcccggc

SEQ ID NO: 27619 - DNA, 20 bp, Unknown
  RNA secondary structure sequence
tgcgtgtttgtgattaacta

SEQ ID NO: 27620 - DNA, 20 bp, Unknown
  RNA secondary structure sequence
ttgctcgcgccccaaaaaca

SEQ ID NO: 27621 - DNA, 20 bp, Unknown
  RNA secondary structure sequence
atgttggatggcagccttga

SEQ ID NO: 27622 - DNA, 20 bp, Unknown
  RNA secondary structure sequence
gctgctccattgcaatgctc

SEQ ID NO: 27623 - DNA, 20 bp, Unknown
  RNA secondary structure sequence
gctgctcctggcagccttga

SEQ ID NO: 27624 - DNA, 20 bp, Unknown
  RNA secondary structure sequence
tctgtgacttcgggtccgta

SEQ ID NO: 27625 - DNA, 20 bp, Unknown
  RNA secondary structure sequence
ggcgcgctggagcgttttcc

SEQ ID NO: 27626 - DNA, 20 bp, Unknown
  RNA secondary structure sequence
cgtaacccaatgtgtatcta

SEQ ID NO: 27627 - DNA, 20 bp, Unknown
  RNA secondary structure sequence
gacacatgtctccgcccctg

SEQ ID NO: 27628 - DNA, 20 bp, Unknown
  RNA secondary structure sequence
cagcaccgaatgtcaagatt

SEQ ID NO: 27629 - DNA, 20 bp, Unknown
  RNA secondary structure sequence
attttgactggaatttcgga

SEQ ID NO: 27630 - DNA, 20 bp, Unknown
  RNA secondary structure sequence
ccggggcgaagggtatgtgg

SEQ ID NO: 27631 - DNA, 20 bp, Unknown
  RNA secondary structure sequence
ctttgtttcacttgccatat

SEQ ID NO: 27632 - DNA, 20 bp, Unknown
  RNA secondary structure sequence
attattaaacatccaatttg

SEQ ID NO: 27633 - DNA, 20 bp, Unknown
  RNA secondary structure sequence
ttgctcgctcagcacaggat

SEQ ID NO: 27634 - DNA, 20 bp, Unknown
  RNA secondary structure sequence
ccgctgcaggcccgcgcccg

SEQ ID NO: 27635 - DNA, 20 bp, Unknown
  RNA secondary structure sequence
tcaacaccgacttaggttca

SEQ ID NO: 27636 - DNA, 20 bp, Unknown
  RNA secondary structure sequence
agtgtcctatttaaaatggg

SEQ ID NO: 27637 - DNA, 20 bp, Unknown
  RNA secondary structure sequence
catacccaataaaagattat

SEQ ID NO: 27638 - DNA, 20 bp, Unknown
  RNA secondary structure sequence
catacccatccgtctcaggg

SEQ ID NO: 27639 - DNA, 20 bp, Unknown
  RNA secondary structure sequence
gagcatcttcattataatca

SEQ ID NO: 27640 - DNA, 20 bp, Unknown
  RNA secondary structure sequence
ccgcagaaggttgtcctgta

SEQ ID NO: 27641 - DNA, 20 bp, Unknown
  RNA secondary structure sequence
agtatccgcagcagatgtgc

SEQ ID NO: 27642 - DNA, 20 bp, Unknown
  RNA secondary structure sequence
agtatccgggttgtcctgta

SEQ ID NO: 27643 - DNA, 20 bp, Unknown
  RNA secondary structure sequence
cggcgcgaagcctgcgattc

SEQ ID NO: 27644 - DNA, 20 bp, Unknown
  RNA secondary structure sequence
gtgctgtgtgtcctagtcta

SEQ ID NO: 27645 - DNA, 20 bp, Unknown
  RNA secondary structure sequence
acaacagctgtcctagtcta

SEQ ID NO: 27646 - DNA, 20 bp, Unknown
  RNA secondary structure sequence
ctcccggtgcttaatgcatt

SEQ ID NO: 27647 - DNA, 20 bp, Unknown
  RNA secondary structure sequence
tccgccactccggtaggatt

SEQ ID NO: 27648 - DNA, 20 bp, Unknown
  RNA secondary structure sequence
gagcgttttcccagtcggcc

SEQ ID NO: 27649 - DNA, 20 bp, Unknown
  RNA secondary structure sequence
gggccgaggtaccaaaggcg

SEQ ID NO: 27650 - DNA, 20 bp, Unknown
  RNA secondary structure sequence
attatttagtaccaaaggcg

SEQ ID NO: 27651 - DNA, 20 bp, Unknown
  RNA secondary structure sequence
tctccaagtcccccggtctc

SEQ ID NO: 27652 - DNA, 20 bp, Unknown
  RNA secondary structure sequence
gaaagtgctcccccggtctc

SEQ ID NO: 27653 - DNA, 20 bp, Unknown
  RNA secondary structure sequence
tcgtggaagatagtctccac

SEQ ID NO: 27654 - DNA, 20 bp, Unknown
  RNA secondary structure sequence
tcgtggaaacatacaagaca

SEQ ID NO: 27655 - DNA, 20 bp, Unknown
  RNA secondary structure sequence
ctgcctatgggcgaagtcaa

SEQ ID NO: 27656 - DNA, 20 bp, Unknown
  RNA secondary structure sequence
aactaagggggcgaagtcaa

SEQ ID NO: 27657 - DNA, 20 bp, Unknown
  RNA secondary structure sequence
caaactccgctattctgccc

SEQ ID NO: 27658 - DNA, 20 bp, Unknown
  RNA secondary structure sequence
tgacgctcgcgtgatgacaa

SEQ ID NO: 27659 - DNA, 20 bp, Unknown
  RNA secondary structure sequence
atggcagagcaaaaatgtaa

SEQ ID NO: 27660 - DNA, 20 bp, Unknown
  RNA secondary structure sequence
ctcaacagagccaacatttc

SEQ ID NO: 27661 - DNA, 20 bp, Unknown
  RNA secondary structure sequence
gaatctgcagccaacatttc

SEQ ID NO: 27662 - DNA, 20 bp, Unknown
  RNA secondary structure sequence
acaggagacgtcgaacttcg

SEQ ID NO: 27663 - DNA, 20 bp, Unknown
  RNA secondary structure sequence
acaggagagcgtactgcggt

SEQ ID NO: 27664 - DNA, 20 bp, Unknown
  RNA secondary structure sequence
ggcacgccgcgtactgcggt

SEQ ID NO: 27665 - DNA, 20 bp, Unknown
  RNA secondary structure sequence
cctttgggggctacctggct

SEQ ID NO: 27666 - DNA, 20 bp, Unknown
  RNA secondary structure sequence
cctttgggttgccatcagcg

SEQ ID NO: 27667 - DNA, 20 bp, Unknown
  RNA secondary structure sequence
cctgtgagactgcagccctg

SEQ ID NO: 27668 - DNA, 20 bp, Unknown
  RNA secondary structure sequence
cagatgacaacaccgtccac

SEQ ID NO: 27669 - DNA, 20 bp, Unknown
  RNA secondary structure sequence
atgattccctactgcgagaa

SEQ ID NO: 27670 - DNA, 20 bp, Unknown
  RNA secondary structure sequence
tgagtgccacaagaccaaag

SEQ ID NO: 27671 - DNA, 20 bp, Unknown
  RNA secondary structure sequence
aacaactaacaagaccaaag

SEQ ID NO: 27672 - DNA, 20 bp, Unknown
  RNA secondary structure sequence
taatttaggcattggaggag

SEQ ID NO: 27673 - DNA, 20 bp, Unknown
  RNA secondary structure sequence
cctaaactgcattggaggag

SEQ ID NO: 27674 - DNA, 20 bp, Unknown
  RNA secondary structure sequence
gcttcccactgcctagttca

SEQ ID NO: 27675 - DNA, 20 bp, Unknown
  RNA secondary structure sequence
ccacccccctttggatcttg

SEQ ID NO: 27676 - DNA, 20 bp, Unknown
  RNA secondary structure sequence
gtgcgcgagacgccgccgag

SEQ ID NO: 27677 - DNA, 20 bp, Unknown
  RNA secondary structure sequence
aaggagagacagtagctgat

SEQ ID NO: 27678 - DNA, 20 bp, Unknown
  RNA secondary structure sequence
aaggagagcattagaaaatg

SEQ ID NO: 27679 - DNA, 20 bp, Unknown
  RNA secondary structure sequence
acacgaaaccaaccttcaca

SEQ ID NO: 27680 - DNA, 20 bp, Unknown
  RNA secondary structure sequence
caatgcaataattaatcctt

SEQ ID NO: 27681 - DNA, 20 bp, Unknown
  RNA secondary structure sequence
ggagccaccggagccccggc

SEQ ID NO: 27682 - DNA, 20 bp, Unknown
  RNA secondary structure sequence
ctggccaccggagccccggc

SEQ ID NO: 27683 - DNA, 20 bp, Unknown
  RNA secondary structure sequence
aacccttgacaagaggacca

SEQ ID NO: 27684 - DNA, 20 bp, Unknown
  RNA secondary structure sequence
atactggataccaggagtta

SEQ ID NO: 27685 - DNA, 20 bp, Unknown
  RNA secondary structure sequence
ccgcgcgcgcgcgcgggctt

SEQ ID NO: 27686 - DNA, 20 bp, Unknown
  RNA secondary structure sequence
accccgaggtaacacgcgac

SEQ ID NO: 27687 - DNA, 20 bp, Unknown
  RNA secondary structure sequence
gaggttttgtaacacgcgac

SEQ ID NO: 27688 - DNA, 20 bp, Unknown
  RNA secondary structure sequence
agcgaatgtctctcctggga

SEQ ID NO: 27689 - DNA, 20 bp, Unknown
  RNA secondary structure sequence
agacaaatcaaactagactc

SEQ ID NO: 27690 - DNA, 20 bp, Unknown
  RNA secondary structure sequence
agacaaatttcgggctcgga

SEQ ID NO: 27691 - DNA, 20 bp, Unknown
  RNA secondary structure sequence
tgcaaatgtgccgtttccct

SEQ ID NO: 27692 - DNA, 20 bp, Unknown
  RNA secondary structure sequence
agatggcgccggtttactgg

SEQ ID NO: 27693 - DNA, 20 bp, Unknown
  RNA secondary structure sequence
agatggcggacaacatgacc

SEQ ID NO: 27694 - DNA, 20 bp, Unknown
  RNA secondary structure sequence
cgatcacatcattttcccaa

SEQ ID NO: 27695 - DNA, 20 bp, Unknown
  RNA secondary structure sequence
tgggaggcaacccagacaca

SEQ ID NO: 27696 - DNA, 20 bp, Unknown
  RNA secondary structure sequence
tgggaggccgtgggctggac

SEQ ID NO: 27697 - DNA, 20 bp, Unknown
  RNA secondary structure sequence
ggcaggcgcgggagcagcac

SEQ ID NO: 27698 - DNA, 20 bp, Unknown
  RNA secondary structure sequence
ccaggactggtctgagaggg

SEQ ID NO: 27699 - DNA, 20 bp, Unknown
  RNA secondary structure sequence
cagactgtcagataaatcgg

SEQ ID NO: 27700 - DNA, 20 bp, Unknown
  RNA secondary structure sequence
tgccctaccgttgcgtgagg

SEQ ID NO: 27701 - DNA, 20 bp, Unknown
  RNA secondary structure sequence
gtagtgggcgttgcgtgagg

SEQ ID NO: 27702 - DNA, 20 bp, Unknown
  RNA secondary structure sequence
gtagtggggagacaaactca

SEQ ID NO: 27703 - DNA, 20 bp, Unknown
  RNA secondary structure sequence
gtaggggaccaacacgtagg

SEQ ID NO: 27704 - DNA, 20 bp, Unknown
  RNA secondary structure sequence
tctaccccccaacacgtagg

SEQ ID NO: 27705 - DNA, 20 bp, Unknown
  RNA secondary structure sequence
gcctccacgcccaccacctc

SEQ ID NO: 27706 - DNA, 20 bp, Unknown
  RNA secondary structure sequence
taagccctgagtacagggta

SEQ ID NO: 27707 - DNA, 20 bp, Unknown
  RNA secondary structure sequence
gctgaagccgctgcccctgc

SEQ ID NO: 27708 - DNA, 20 bp, Unknown
  RNA secondary structure sequence
ccggagagcgccagggcctg

SEQ ID NO: 27709 - DNA, 20 bp, Unknown
  RNA secondary structure sequence
atgtggagttcgacattagg

SEQ ID NO: 27710 - DNA, 20 bp, Unknown
  RNA secondary structure sequence
atgtggagttcgacggtagg

SEQ ID NO: 27711 - DNA, 20 bp, Unknown
  RNA secondary structure sequence
atgtggagtttcctcccagg

SEQ ID NO: 27712 - DNA, 20 bp, Unknown
  RNA secondary structure sequence
tgtctttctttcctcccagg

SEQ ID NO: 27713 - DNA, 20 bp, Unknown
  RNA secondary structure sequence
gcaaggcagtggcggcggcc

SEQ ID NO: 27714 - DNA, 20 bp, Unknown
  RNA secondary structure sequence
caggctgggtggcggcggcc

SEQ ID NO: 27715 - DNA, 20 bp, Unknown
  RNA secondary structure sequence
gcaaggcatctctccattta

SEQ ID NO: 27716 - DNA, 20 bp, Unknown
  RNA secondary structure sequence
gcatgggcacctgaaggtct

SEQ ID NO: 27717 - DNA, 20 bp, Unknown
  RNA secondary structure sequence
gcatgggccaggaggccatg

SEQ ID NO: 27718 - DNA, 20 bp, Unknown
  RNA secondary structure sequence
tagctattcaggaggccatg

SEQ ID NO: 27719 - DNA, 20 bp, Unknown
  RNA secondary structure sequence
ggtaaaataagggtatgtgg

SEQ ID NO: 27720 - DNA, 20 bp, Unknown
  RNA secondary structure sequence
ggatgaagaagaaaacccgg

SEQ ID NO: 27721 - DNA, 20 bp, Unknown
  RNA secondary structure sequence
aagaactacggaacctgatg

SEQ ID NO: 27722 - DNA, 20 bp, Unknown
  RNA secondary structure sequence
aagaactagcccgatctgct

SEQ ID NO: 27723 - DNA, 20 bp, Unknown
  RNA secondary structure sequence
cagtctctcgtcatttggtg

SEQ ID NO: 27724 - DNA, 20 bp, Unknown
  RNA secondary structure sequence
gggaagcggagccaacatgc

SEQ ID NO: 27725 - DNA, 20 bp, Unknown
  RNA secondary structure sequence
attgaatcccgcttcccctt

SEQ ID NO: 27726 - DNA, 20 bp, Unknown
  RNA secondary structure sequence
gcagagaagcagaggaccaa

SEQ ID NO: 27727 - DNA, 20 bp, Unknown
  RNA secondary structure sequence
gcggaggcttccggcggaaa

SEQ ID NO: 27728 - DNA, 20 bp, Unknown
  RNA secondary structure sequence
aattctctttccggcggaaa

SEQ ID NO: 27729 - DNA, 20 bp, Unknown
  RNA secondary structure sequence
tgaatcatttcttcacatca

SEQ ID NO: 27730 - DNA, 20 bp, Unknown
  RNA secondary structure sequence
taaaaatcacctggaccaat

SEQ ID NO: 27731 - DNA, 20 bp, Unknown
  RNA secondary structure sequence
ctgaatttctaaatacaaga

SEQ ID NO: 27732 - DNA, 20 bp, Unknown
  RNA secondary structure sequence
gaacgttttcccctcctgga

SEQ ID NO: 27733 - DNA, 20 bp, Unknown
  RNA secondary structure sequence
ccccaatcttaaattagggc

SEQ ID NO: 27734 - DNA, 20 bp, Unknown
  RNA secondary structure sequence
gggtttctttaaattagggc

SEQ ID NO: 27735 - DNA, 20 bp, Unknown
  RNA secondary structure sequence
cactaatacagtgtgtggag

SEQ ID NO: 27736 - DNA, 20 bp, Unknown
  RNA secondary structure sequence
cggctgcctctccgcccctg

SEQ ID NO: 27737 - DNA, 20 bp, Unknown
  RNA secondary structure sequence
caaggtcatacatgaaatca

SEQ ID NO: 27738 - DNA, 20 bp, Unknown
  RNA secondary structure sequence
ttcccgtaggggccgtcggc

SEQ ID NO: 27739 - DNA, 20 bp, Unknown
  RNA secondary structure sequence
ttcggctgagacacgtccca

SEQ ID NO: 27740 - DNA, 20 bp, Unknown
  RNA secondary structure sequence
gtagcagcggggaggccggg

SEQ ID NO: 27741 - DNA, 20 bp, Unknown
  RNA secondary structure sequence
gtagcagctactgataaccc

SEQ ID NO: 27742 - DNA, 20 bp, Unknown
  RNA secondary structure sequence
tggcccactcctagtcccta

SEQ ID NO: 27743 - DNA, 20 bp, Unknown
  RNA secondary structure sequence
tgttaggattccagaacctt

SEQ ID NO: 27744 - DNA, 20 bp, Unknown
  RNA secondary structure sequence
tgttaggaaagggcgtgtgg

SEQ ID NO: 27745 - DNA, 20 bp, Unknown
  RNA secondary structure sequence
tcctgaccagagggtcttct

SEQ ID NO: 27746 - DNA, 20 bp, Unknown
  RNA secondary structure sequence
agcaggaaactcagttcttc

SEQ ID NO: 27747 - DNA, 20 bp, Unknown
  RNA secondary structure sequence
gtggtttcactcagttcttc

SEQ ID NO: 27748 - DNA, 20 bp, Unknown
  RNA secondary structure sequence
gtggctcttgccctttagac

SEQ ID NO: 27749 - DNA, 20 bp, Unknown
  RNA secondary structure sequence
catatgtctgccctttagac

SEQ ID NO: 27750 - DNA, 20 bp, Unknown
  RNA secondary structure sequence
ccagcctctccgcatcttga

SEQ ID NO: 27751 - DNA, 20 bp, Unknown
  RNA secondary structure sequence
ggacaaggtgccctatttag

SEQ ID NO: 27752 - DNA, 20 bp, Unknown
  RNA secondary structure sequence
ggtcgaggtgccctatttag

SEQ ID NO: 27753 - DNA, 20 bp, Unknown
  RNA secondary structure sequence
tcctcccctgccctatttag

SEQ ID NO: 27754 - DNA, 20 bp, Unknown
  RNA secondary structure sequence
ggtctaggtgccctatttag

SEQ ID NO: 27755 - DNA, 20 bp, Unknown
  RNA secondary structure sequence
ctgtggcacagtagactgta

SEQ ID NO: 27756 - DNA, 20 bp, Unknown
  RNA secondary structure sequence
cgcactcgatccacgctggc

SEQ ID NO: 27757 - DNA, 20 bp, Unknown
  RNA secondary structure sequence
acggcgacagattgtgaggt

SEQ ID NO: 27758 - DNA, 20 bp, Unknown
  RNA secondary structure sequence
acggcgactttactgcgaaa

SEQ ID NO: 27759 - DNA, 20 bp, Unknown
  RNA secondary structure sequence
cgatgttgtttactgcgaaa

SEQ ID NO: 27760 - DNA, 20 bp, Unknown
  RNA secondary structure sequence
ccgtgaccgacctatcaggt

SEQ ID NO: 27761 - DNA, 20 bp, Unknown
  RNA secondary structure sequence
ccgtgacctggggcaaccca

SEQ ID NO: 27762 - DNA, 20 bp, Unknown
  RNA secondary structure sequence
caagattcagaccagtgttt

SEQ ID NO: 27763 - DNA, 20 bp, Unknown
  RNA secondary structure sequence
atatttgtttaatgaatgtg

SEQ ID NO: 27764 - DNA, 20 bp, Unknown
  RNA secondary structure sequence
tctattggttggcgtttgtt

SEQ ID NO: 27765 - DNA, 20 bp, Unknown
  RNA secondary structure sequence
ccccctcgcttcgagcctgt

SEQ ID NO: 27766 - DNA, 20 bp, Unknown
  RNA secondary structure sequence
agttagactccaagaatgca

SEQ ID NO: 27767 - DNA, 20 bp, Unknown
  RNA secondary structure sequence
ttccagcagccgaagacacc

SEQ ID NO: 27768 - DNA, 20 bp, Unknown
  RNA secondary structure sequence
ccagcatggccgaagacacc

SEQ ID NO: 27769 - DNA, 20 bp, Unknown
  RNA secondary structure sequence
ttctctaagcctggaagtgc

SEQ ID NO: 27770 - DNA, 20 bp, Unknown
  RNA secondary structure sequence
cctatggggcctggaagtgc

SEQ ID NO: 27771 - DNA, 20 bp, Unknown
  RNA secondary structure sequence
ctcccagagcgcccggggcc

SEQ ID NO: 27772 - DNA, 20 bp, Unknown
  RNA secondary structure sequence
gatggcggctcccagactat

SEQ ID NO: 27773 - DNA, 20 bp, Unknown
  RNA secondary structure sequence
ggcagatgatttctggcctc

SEQ ID NO: 27774 - DNA, 20 bp, Unknown
  RNA secondary structure sequence
ctcttgctttacggcaggtg

SEQ ID NO: 27775 - DNA, 20 bp, Unknown
  RNA secondary structure sequence
tttcactgggtcgccatctt

SEQ ID NO: 27776 - DNA, 20 bp, Unknown
  RNA secondary structure sequence
gcagcagcccaacaatctcc

SEQ ID NO: 27777 - DNA, 20 bp, Unknown
  RNA secondary structure sequence
gcagcagcggtcgccatctt

SEQ ID NO: 27778 - DNA, 20 bp, Unknown
  RNA secondary structure sequence
tcctccggaagaccaggggc

SEQ ID NO: 27779 - DNA, 20 bp, Unknown
  RNA secondary structure sequence
cataagttaagaccaggggc

SEQ ID NO: 27780 - DNA, 20 bp, Unknown
  RNA secondary structure sequence
tcctccgggttcggttcctg

SEQ ID NO: 27781 - DNA, 20 bp, Unknown
  RNA secondary structure sequence
ctcgccgtaatagtccgacc

SEQ ID NO: 27782 - DNA, 20 bp, Unknown
  RNA secondary structure sequence
acgcaaacccattaaatttc

SEQ ID NO: 27783 - DNA, 20 bp, Unknown
  RNA secondary structure sequence
aggcccctgaacgtgtatgt

SEQ ID NO: 27784 - DNA, 20 bp, Unknown
  RNA secondary structure sequence
caacaaagggaagaccgacg

SEQ ID NO: 27785 - DNA, 20 bp, Unknown
  RNA secondary structure sequence
tgtggcttatgtccttcggt

SEQ ID NO: 27786 - DNA, 20 bp, Unknown
  RNA secondary structure sequence
tgtggcttggaagaccgacg

SEQ ID NO: 27787 - DNA, 20 bp, Unknown
  RNA secondary structure sequence
tagacgcgcctgggatgggc

SEQ ID NO: 27788 - DNA, 20 bp, Unknown
  RNA secondary structure sequence
gcttataaaagccctactag

SEQ ID NO: 27789 - DNA, 20 bp, Unknown
  RNA secondary structure sequence
ctctcacatccaggacgacc

SEQ ID NO: 27790 - DNA, 20 bp, Unknown
  RNA secondary structure sequence
taaccgagtgtcgccccccg

SEQ ID NO: 27791 - DNA, 20 bp, Unknown
  RNA secondary structure sequence
atggggggccccggccttac

SEQ ID NO: 27792 - DNA, 20 bp, Unknown
  RNA secondary structure sequence
tataaactccccggccttac

SEQ ID NO: 27793 - DNA, 20 bp, Unknown
  RNA secondary structure sequence
ccgcaggtaacaagagacac

SEQ ID NO: 27794 - DNA, 20 bp, Unknown
  RNA secondary structure sequence
cacagcatccgagccctcta

SEQ ID NO: 27795 - DNA, 20 bp, Unknown
  RNA secondary structure sequence
tctgcatcgaaaactctccg

SEQ ID NO: 27796 - DNA, 20 bp, Unknown
  RNA secondary structure sequence
cctaggaggaggggaggcgg

SEQ ID NO: 27797 - DNA, 20 bp, Unknown
  RNA secondary structure sequence
cgaccttgacggggtgctgg

SEQ ID NO: 27798 - DNA, 20 bp, Unknown
  RNA secondary structure sequence
cgaccttgcaaattaaaata

SEQ ID NO: 27799 - DNA, 20 bp, Unknown
  RNA secondary structure sequence
atttgactacggggtgctgg

SEQ ID NO: 27800 - DNA, 20 bp, Unknown
  RNA secondary structure sequence
tccgccaccagccctacgag

SEQ ID NO: 27801 - DNA, 20 bp, Unknown
  RNA secondary structure sequence
cattgatgtccggtaggatt

SEQ ID NO: 27802 - DNA, 20 bp, Unknown
  RNA secondary structure sequence
tctgaacttgaagcctggag

SEQ ID NO: 27803 - DNA, 20 bp, Unknown
  RNA secondary structure sequence
ctgggcgcctgggacccgcc

SEQ ID NO: 27804 - DNA, 20 bp, Unknown
  RNA secondary structure sequence
ctgggcgcggttcgtatagg

SEQ ID NO: 27805 - DNA, 20 bp, Unknown
  RNA secondary structure sequence
agggctagggcttcctgaac

SEQ ID NO: 27806 - DNA, 20 bp, Unknown
  RNA secondary structure sequence
aaaacttaggatccaagacc

SEQ ID NO: 27807 - DNA, 20 bp, Unknown
  RNA secondary structure sequence
taaacaagttaggcaacgcg

SEQ ID NO: 27808 - DNA, 20 bp, Unknown
  RNA secondary structure sequence
atccatcagggcatccaaat

SEQ ID NO: 27809 - DNA, 20 bp, Unknown
  RNA secondary structure sequence
ttcacggccagtttccattg

SEQ ID NO: 27810 - DNA, 20 bp, Unknown
  RNA secondary structure sequence
aagcgatgcagtttccattg

SEQ ID NO: 27811 - DNA, 20 bp, Unknown
  RNA secondary structure sequence
aagcgatgtgccacgggcga

SEQ ID NO: 27812 - DNA, 20 bp, Unknown
  RNA secondary structure sequence
cgttgggcgcatctcctgga

SEQ ID NO: 27813 - DNA, 20 bp, Unknown
  RNA secondary structure sequence
gaggacacgaccccagggca

SEQ ID NO: 27814 - DNA, 20 bp, Unknown
  RNA secondary structure sequence
gtgagtatgttgctattatg

SEQ ID NO: 27815 - DNA, 20 bp, Unknown
  RNA secondary structure sequence
gttcagcatgtgggctcaaa

SEQ ID NO: 27816 - DNA, 20 bp, Unknown
  RNA secondary structure sequence
ctggcagatgaggctagaaa

SEQ ID NO: 27817 - DNA, 20 bp, Unknown
  RNA secondary structure sequence
gataggcggagcatctagtt

SEQ ID NO: 27818 - DNA, 20 bp, Unknown
  RNA secondary structure sequence
acttttcagccgcggcccgg

SEQ ID NO: 27819 - DNA, 20 bp, Unknown
  RNA secondary structure sequence
tgaaacacgccgcggcccgg

SEQ ID NO: 27820 - DNA, 20 bp, Unknown
  RNA secondary structure sequence
gcagacgcccccggagtcgc

SEQ ID NO: 27821 - DNA, 20 bp, Unknown
  RNA secondary structure sequence
cgcgaagattccccctctgc

SEQ ID NO: 27822 - DNA, 20 bp, Unknown
  RNA secondary structure sequence
gccggtcacgtggggggcga

SEQ ID NO: 27823 - DNA, 20 bp, Unknown
  RNA secondary structure sequence
tcggttccagaagggagagg

SEQ ID NO: 27824 - DNA, 20 bp, Unknown
  RNA secondary structure sequence
tcggttcctccctcttagtt

SEQ ID NO: 27825 - DNA, 20 bp, Unknown
  RNA secondary structure sequence
gtaaagttagaagggagagg

SEQ ID NO: 27826 - DNA, 20 bp, Unknown
  RNA secondary structure sequence
tgtttttggcgcgtgagctc

SEQ ID NO: 27827 - DNA, 20 bp, Unknown
  RNA secondary structure sequence
cgcggctgtaaagtatagag

SEQ ID NO: 27828 - DNA, 20 bp, Unknown
  RNA secondary structure sequence
agcaagagtgggaggcgcgc

SEQ ID NO: 27829 - DNA, 20 bp, Unknown
  RNA secondary structure sequence
ccctgcagccctcgcctggg

SEQ ID NO: 27830 - DNA, 20 bp, Unknown
  RNA secondary structure sequence
tagatcaagtcgggccagct

SEQ ID NO: 27831 - DNA, 20 bp, Unknown
  RNA secondary structure sequence
ggcggggcgtcgggccagct

SEQ ID NO: 27832 - DNA, 20 bp, Unknown
  RNA secondary structure sequence
cctggtggggacagcagcca

SEQ ID NO: 27833 - DNA, 20 bp, Unknown
  RNA secondary structure sequence
atgcgctgactgagaagaaa

SEQ ID NO: 27834 - DNA, 20 bp, Unknown
  RNA secondary structure sequence
atgcgctgactgagtcctcc

SEQ ID NO: 27835 - DNA, 20 bp, Unknown
  RNA secondary structure sequence
gggaagggagatccggagcg

SEQ ID NO: 27836 - DNA, 20 bp, Unknown
  RNA secondary structure sequence
ggcgcctcgtcaaaggggct

SEQ ID NO: 27837 - DNA, 20 bp, Unknown
  RNA secondary structure sequence
tcaaagaagtcaaaggggct

SEQ ID NO: 27838 - DNA, 20 bp, Unknown
  RNA secondary structure sequence
tcaaagaatgtgtctcaaga

SEQ ID NO: 27839 - DNA, 20 bp, Unknown
  RNA secondary structure sequence
cggaagcttgcttaacacag

SEQ ID NO: 27840 - DNA, 20 bp, Unknown
  RNA secondary structure sequence
ctgcagcggaaccgactact

SEQ ID NO: 27841 - DNA, 20 bp, Unknown
  RNA secondary structure sequence
ggagccgggcggaattgaga

SEQ ID NO: 27842 - DNA, 20 bp, Unknown
  RNA secondary structure sequence
gaggagctgttatcgggact

SEQ ID NO: 27843 - DNA, 20 bp, Unknown
  RNA secondary structure sequence
cctcggtgggagagcagggg

SEQ ID NO: 27844 - DNA, 20 bp, Unknown
  RNA secondary structure sequence
aaggccgtggagagcagggg

SEQ ID NO: 27845 - DNA, 20 bp, Unknown
  RNA secondary structure sequence
cctcggtgcccataacatta

SEQ ID NO: 27846 - DNA, 20 bp, Unknown
  RNA secondary structure sequence
aatggacaaggtgtgaagag

SEQ ID NO: 27847 - DNA, 20 bp, Unknown
  RNA secondary structure sequence
cataaagagcagctggggta

SEQ ID NO: 27848 - DNA, 20 bp, Unknown
  RNA secondary structure sequence
ggccccagctgcgccatcgt

SEQ ID NO: 27849 - DNA, 20 bp, Unknown
  RNA secondary structure sequence
ggccccaggcagctggggta

SEQ ID NO: 27850 - DNA, 20 bp, Unknown
  RNA secondary structure sequence
ttttttggaggcctaggctt

SEQ ID NO: 27851 - DNA, 20 bp, Unknown
  RNA secondary structure sequence
taccccttcctctcggaagg

SEQ ID NO: 27852 - DNA, 20 bp, Unknown
  RNA secondary structure sequence
taccccttgtatatcatgaa

SEQ ID NO: 27853 - DNA, 20 bp, Unknown
  RNA secondary structure sequence
cctcagctcgtcctccccgc

SEQ ID NO: 27854 - DNA, 20 bp, Unknown
  RNA secondary structure sequence
cctcagcttagatcttgtag

SEQ ID NO: 27855 - DNA, 20 bp, Unknown
  RNA secondary structure sequence
gcaatgcagatccagtggtt

SEQ ID NO: 27856 - DNA, 20 bp, Unknown
  RNA secondary structure sequence
acggtcggattagtttgcct

SEQ ID NO: 27857 - DNA, 20 bp, Unknown
  RNA secondary structure sequence
gtttgaatgccctggaagga

SEQ ID NO: 27858 - DNA, 20 bp, Unknown
  RNA secondary structure sequence
tacgacgatctcggcaaaca

SEQ ID NO: 27859 - DNA, 20 bp, Unknown
  RNA secondary structure sequence
cctccgtcgagatcggcgtg

SEQ ID NO: 27860 - DNA, 20 bp, Unknown
  RNA secondary structure sequence
cctccgtctctcggcaaaca

SEQ ID NO: 27861 - DNA, 20 bp, Unknown
  RNA secondary structure sequence
cctccgttgggactaccgca

SEQ ID NO: 27862 - DNA, 20 bp, Unknown
  RNA secondary structure sequence
acaaacagataggttggagc

SEQ ID NO: 27863 - DNA, 20 bp, Unknown
  RNA secondary structure sequence
acaaacagcagatggacgct

SEQ ID NO: 27864 - DNA, 20 bp, Unknown
  RNA secondary structure sequence
ctagccgagtagtgttgggt

SEQ ID NO: 27865 - DNA, 20 bp, Unknown
  RNA secondary structure sequence
gtgtggtccgacacgatggg

SEQ ID NO: 27866 - DNA, 20 bp, Unknown
  RNA secondary structure sequence
gtgtggtcgacacattcacc

SEQ ID NO: 27867 - DNA, 20 bp, Unknown
  RNA secondary structure sequence
cgtctagccatggcgttagt

SEQ ID NO: 27868 - DNA, 20 bp, Unknown
  RNA secondary structure sequence
gtcgggtgcatggcgttagt

SEQ ID NO: 27869 - DNA, 20 bp, Unknown
  RNA secondary structure sequence
tctggctcgcctgcctgcag

SEQ ID NO: 27870 - DNA, 20 bp, Unknown
  RNA secondary structure sequence
ggatcctgttctaaatatcc

SEQ ID NO: 27871 - DNA, 20 bp, Unknown
  RNA secondary structure sequence
gaagtgctctcggcggaagt

SEQ ID NO: 27872 - DNA, 20 bp, Unknown
  RNA secondary structure sequence
tgcatgtggcaggagcggtg

SEQ ID NO: 27873 - DNA, 20 bp, Unknown
  RNA secondary structure sequence
tgcatgtgaggaataattct

SEQ ID NO: 27874 - DNA, 20 bp, Unknown
  RNA secondary structure sequence
aaatacacgcaggagcggtg

SEQ ID NO: 27875 - DNA, 20 bp, Unknown
  RNA secondary structure sequence
gccacagcattcctagactg

SEQ ID NO: 27876 - DNA, 20 bp, Unknown
  RNA secondary structure sequence
gcccatgtcaagattccctg

SEQ ID NO: 27877 - DNA, 20 bp, Unknown
  RNA secondary structure sequence
tttttaaacaagattccctg

SEQ ID NO: 27878 - DNA, 20 bp, Unknown
  RNA secondary structure sequence
accccgctcgcgcgccctcc

SEQ ID NO: 27879 - DNA, 20 bp, Unknown
  RNA secondary structure sequence
cagatcccgcccgcgtcaga

SEQ ID NO: 27880 - DNA, 20 bp, Unknown
  RNA secondary structure sequence
cccttctcgcccgcgtcaga

SEQ ID NO: 27881 - DNA, 20 bp, Unknown
  RNA secondary structure sequence
agagcggtaagatttctgcc

SEQ ID NO: 27882 - DNA, 20 bp, Unknown
  RNA secondary structure sequence
agagcggtaatgaatatccg

SEQ ID NO: 27883 - DNA, 20 bp, Unknown
  RNA secondary structure sequence
cggccggcgttgccggggta

SEQ ID NO: 27884 - DNA, 20 bp, Unknown
  RNA secondary structure sequence
accaaatggttgccggggta

SEQ ID NO: 27885 - DNA, 20 bp, Unknown
  RNA secondary structure sequence
gtatccaaagaagggggtga

SEQ ID NO: 27886 - DNA, 20 bp, Unknown
  RNA secondary structure sequence
tactccgaaccccagaatcc

SEQ ID NO: 27887 - DNA, 20 bp, Unknown
  RNA secondary structure sequence
aggggtagaccccagaatcc

SEQ ID NO: 27888 - DNA, 20 bp, Unknown
  RNA secondary structure sequence
gcctccctctgggcgtccac

SEQ ID NO: 27889 - DNA, 20 bp, Unknown
  RNA secondary structure sequence
ctgccccgccaggcgaagcg

SEQ ID NO: 27890 - DNA, 20 bp, Unknown
  RNA secondary structure sequence
taaatttcccaggcgaagcg

SEQ ID NO: 27891 - DNA, 20 bp, Unknown
  RNA secondary structure sequence
cctcgggactcggcgggtcc

SEQ ID NO: 27892 - DNA, 20 bp, Unknown
  RNA secondary structure sequence
gtgttcatctcggcgggtcc

SEQ ID NO: 27893 - DNA, 20 bp, Unknown
  RNA secondary structure sequence
tgctgctgaggaccttccag

SEQ ID NO: 27894 - DNA, 20 bp, Unknown
  RNA secondary structure sequence
ccgggtgcctaagcaggccc

SEQ ID NO: 27895 - DNA, 20 bp, Unknown
  RNA secondary structure sequence
ggcaccgcctaagcaggccc

SEQ ID NO: 27896 - DNA, 20 bp, Unknown
  RNA secondary structure sequence
accgccagcaggcagcggcc

SEQ ID NO: 27897 - DNA, 20 bp, Unknown
  RNA secondary structure sequence
ctcttggcaaaaatggcaaa

SEQ ID NO: 27898 - DNA, 20 bp, Unknown
  RNA secondary structure sequence
ttgacgaaacaaattttcgt

SEQ ID NO: 27899 - DNA, 20 bp, Unknown
  RNA secondary structure sequence
cgagacggcggcgcgtgcag

SEQ ID NO: 27900 - DNA, 20 bp, Unknown
  RNA secondary structure sequence
gttttgatcggcgcgtgcag

SEQ ID NO: 27901 - DNA, 20 bp, Unknown
  RNA secondary structure sequence
agtccaggggtggccgtgat

SEQ ID NO: 27902 - DNA, 20 bp, Unknown
  RNA secondary structure sequence
tccctcaagcgcagtgccca

SEQ ID NO: 27903 - DNA, 20 bp, Unknown
  RNA secondary structure sequence
ccgtcccagcgctaccgggc

SEQ ID NO: 27904 - DNA, 20 bp, Unknown
  RNA secondary structure sequence
gctggctcccggaatatgga

SEQ ID NO: 27905 - DNA, 20 bp, Unknown
  RNA secondary structure sequence
ttgtcaagccggaatatgga

SEQ ID NO: 27906 - DNA, 20 bp, Unknown
  RNA secondary structure sequence
ccgcacccttacgtatctct

SEQ ID NO: 27907 - DNA, 20 bp, Unknown
  RNA secondary structure sequence
tgatgtttggttcagctcgc

SEQ ID NO: 27908 - DNA, 20 bp, Unknown
  RNA secondary structure sequence
gtggtatctgattgttgttg

SEQ ID NO: 27909 - DNA, 20 bp, Unknown
  RNA secondary structure sequence
gtggtatcaaggaagctgct

SEQ ID NO: 27910 - DNA, 20 bp, Unknown
  RNA secondary structure sequence
tcttacaagctgcaggctct

SEQ ID NO: 27911 - DNA, 20 bp, Unknown
  RNA secondary structure sequence
caggctggtgactttatgaa

SEQ ID NO: 27912 - DNA, 20 bp, Unknown
  RNA secondary structure sequence
tggccaaccttttggctccg

SEQ ID NO: 27913 - DNA, 20 bp, Unknown
  RNA secondary structure sequence
gaggaggagggaaaaggcga

SEQ ID NO: 27914 - DNA, 20 bp, Unknown
  RNA secondary structure sequence
gaggaggacaacggctttcg

SEQ ID NO: 27915 - DNA, 20 bp, Unknown
  RNA secondary structure sequence
ccccgtatgggaaaaggcga

SEQ ID NO: 27916 - DNA, 20 bp, Unknown
  RNA secondary structure sequence
aagagtcgcgcccccgggga

SEQ ID NO: 27917 - DNA, 20 bp, Unknown
  RNA secondary structure sequence
tagattccagccagcccccg

SEQ ID NO: 27918 - DNA, 20 bp, Unknown
  RNA secondary structure sequence
gcccgcagagccagcccccg

SEQ ID NO: 27919 - DNA, 20 bp, Unknown
  RNA secondary structure sequence
gcccgcagcatgtcaattaa

SEQ ID NO: 27920 - DNA, 20 bp, Unknown
  RNA secondary structure sequence
cctggaggcgcagccccacc

SEQ ID NO: 27921 - DNA, 20 bp, Unknown
  RNA secondary structure sequence
gcggcaccggggcggctgcg

SEQ ID NO: 27922 - DNA, 20 bp, Unknown
  RNA secondary structure sequence
gccagggctgcggaggaccg

SEQ ID NO: 27923 - DNA, 20 bp, Unknown
  RNA secondary structure sequence
cccggggaggcgggaaatgc

SEQ ID NO: 27924 - DNA, 20 bp, Unknown
  RNA secondary structure sequence
cacccaacggctgccacggc

SEQ ID NO: 27925 - DNA, 20 bp, Unknown
  RNA secondary structure sequence
attgggcgcaactagtgtaa

SEQ ID NO: 27926 - DNA, 20 bp, Unknown
  RNA secondary structure sequence
ctaatcattttctctagacg

SEQ ID NO: 27927 - DNA, 20 bp, Unknown
  RNA secondary structure sequence
ggaggcggcgcaggcgctga

SEQ ID NO: 27928 - DNA, 20 bp, Unknown
  RNA secondary structure sequence
agcggccgcatgctgacatt

SEQ ID NO: 27929 - DNA, 20 bp, Unknown
  RNA secondary structure sequence
agcggccggggcagccttgc

SEQ ID NO: 27930 - DNA, 20 bp, Unknown
  RNA secondary structure sequence
tgattctaggctggtcacta

SEQ ID NO: 27931 - DNA, 20 bp, Unknown
  RNA secondary structure sequence
catgcttcctgctgtggctg

SEQ ID NO: 27932 - DNA, 20 bp, Unknown
  RNA secondary structure sequence
aggtaccccattgtatggga

SEQ ID NO: 27933 - DNA, 20 bp, Unknown
  RNA secondary structure sequence
cctagcgagcgagttccgcg

SEQ ID NO: 27934 - DNA, 20 bp, Unknown
  RNA secondary structure sequence
aagtctgaacccagcatagt

SEQ ID NO: 27935 - DNA, 20 bp, Unknown
  RNA secondary structure sequence
gcaaaaagcacttgtcgaca

SEQ ID NO: 27936 - DNA, 20 bp, Unknown
  RNA secondary structure sequence
aacaactgtgggacaacatg

SEQ ID NO: 27937 - DNA, 20 bp, Unknown
  RNA secondary structure sequence
gcggcccaggctgaagctca

SEQ ID NO: 27938 - DNA, 20 bp, Unknown
  RNA secondary structure sequence
gcggcccatctgtcgcggag

SEQ ID NO: 27939 - DNA, 20 bp, Unknown
  RNA secondary structure sequence
agtaagtgggctgaagctca

SEQ ID NO: 27940 - DNA, 20 bp, Unknown
  RNA secondary structure sequence
ctctgtgttaaaccaatcag

SEQ ID NO: 27941 - DNA, 20 bp, Unknown
  RNA secondary structure sequence
ttcggtaatggcctcagccc

SEQ ID NO: 27942 - DNA, 20 bp, Unknown
  RNA secondary structure sequence
aaccttcagagagtgcggat

SEQ ID NO: 27943 - DNA, 20 bp, Unknown
  RNA secondary structure sequence
ctggagcccgagagaacgaa

SEQ ID NO: 27944 - DNA, 20 bp, Unknown
  RNA secondary structure sequence
tccccaaatccagagggctg

SEQ ID NO: 27945 - DNA, 20 bp, Unknown
  RNA secondary structure sequence
atagcccaaaggacaagaaa

SEQ ID NO: 27946 - DNA, 20 bp, Unknown
  RNA secondary structure sequence
tgtaactgttttctgtttgg

SEQ ID NO: 27947 - DNA, 20 bp, Unknown
  RNA secondary structure sequence
actgcctctaagtgagcacg

SEQ ID NO: 27948 - DNA, 20 bp, Unknown
  RNA secondary structure sequence
gcatgtacacctgattagtt

SEQ ID NO: 27949 - DNA, 20 bp, Unknown
  RNA secondary structure sequence
acgtacggtccacgtcgccc

SEQ ID NO: 27950 - DNA, 20 bp, Unknown
  RNA secondary structure sequence
gactgttgttgtgcaattaa

SEQ ID NO: 27951 - DNA, 20 bp, Unknown
  RNA secondary structure sequence
atatatcgggaggaatttaa

SEQ ID NO: 27952 - DNA, 20 bp, Unknown
  RNA secondary structure sequence
cagggataggaggaatttaa

SEQ ID NO: 27953 - DNA, 20 bp, Unknown
  RNA secondary structure sequence
agtattgctgcttagttaac

SEQ ID NO: 27954 - DNA, 20 bp, Unknown
  RNA secondary structure sequence
atgaatcctgccgccccagc

SEQ ID NO: 27955 - DNA, 20 bp, Unknown
  RNA secondary structure sequence
ggggacagctttatagggga

SEQ ID NO: 27956 - DNA, 20 bp, Unknown
  RNA secondary structure sequence
cgtgtagcgccgcatttaaa

SEQ ID NO: 27957 - DNA, 20 bp, Unknown
  RNA secondary structure sequence
gagaacaagccgcatttaaa

SEQ ID NO: 27958 - DNA, 20 bp, Unknown
  RNA secondary structure sequence
aggtgaccacccctcgacgc

SEQ ID NO: 27959 - DNA, 20 bp, Unknown
  RNA secondary structure sequence
tgctcggccccgccgtcagg

SEQ ID NO: 27960 - DNA, 20 bp, Unknown
  RNA secondary structure sequence
tgctcggcgtgattaggttc

SEQ ID NO: 27961 - DNA, 20 bp, Unknown
  RNA secondary structure sequence
gccgccgctatccaggtaga

SEQ ID NO: 27962 - DNA, 20 bp, Unknown
  RNA secondary structure sequence
tttgctcggtcatctgctgc

SEQ ID NO: 27963 - DNA, 20 bp, Unknown
  RNA secondary structure sequence
ccctgactggagaaggagga

SEQ ID NO: 27964 - DNA, 20 bp, Unknown
  RNA secondary structure sequence
gaggaggaaagagcacctcc

SEQ ID NO: 27965 - DNA, 20 bp, Unknown
  RNA secondary structure sequence
gaggaggaggagaaggagga

SEQ ID NO: 27966 - DNA, 20 bp, Unknown
  RNA secondary structure sequence
gaattggcctgccacagaca

SEQ ID NO: 27967 - DNA, 20 bp, Unknown
  RNA secondary structure sequence
gaattggcgaaatgggctat

SEQ ID NO: 27968 - DNA, 20 bp, Unknown
  RNA secondary structure sequence
acgacaagctgccacagaca

SEQ ID NO: 27969 - DNA, 20 bp, Unknown
  RNA secondary structure sequence
acggtactcctgcccggcgg

SEQ ID NO: 27970 - DNA, 20 bp, Unknown
  RNA secondary structure sequence
gtagcccgcgcgcccctggc

SEQ ID NO: 27971 - DNA, 20 bp, Unknown
  RNA secondary structure sequence
tgagggacgattggcatgct

SEQ ID NO: 27972 - DNA, 20 bp, Unknown
  RNA secondary structure sequence
cataacctcgggtcgtaagc

SEQ ID NO: 27973 - DNA, 20 bp, Unknown
  RNA secondary structure sequence
cataacctgattggcatgct

SEQ ID NO: 27974 - DNA, 20 bp, Unknown
  RNA secondary structure sequence
tggccggagaccagggccca

SEQ ID NO: 27975 - DNA, 20 bp, Unknown
  RNA secondary structure sequence
ttcaaatcagttgcatatca

SEQ ID NO: 27976 - DNA, 20 bp, Unknown
  RNA secondary structure sequence
ttcccacaagtctcctcttc

SEQ ID NO: 27977 - DNA, 20 bp, Unknown
  RNA secondary structure sequence
acctttgtgtgcggtgcaac

SEQ ID NO: 27978 - DNA, 20 bp, Unknown
  RNA secondary structure sequence
cttgtttatttgtagtttcc

SEQ ID NO: 27979 - DNA, 20 bp, Unknown
  RNA secondary structure sequence
tttgaaagagcacttcccaa

SEQ ID NO: 27980 - DNA, 20 bp, Unknown
  RNA secondary structure sequence
agcacgtaacccaatgtgta

SEQ ID NO: 27981 - DNA, 20 bp, Unknown
  RNA secondary structure sequence
tgggctttagcaccagctcc

SEQ ID NO: 27982 - DNA, 20 bp, Unknown
  RNA secondary structure sequence
gcacacagctgtggtttatt

SEQ ID NO: 27983 - DNA, 20 bp, Unknown
  RNA secondary structure sequence
aaagcaggatggagctggag

SEQ ID NO: 27984 - DNA, 20 bp, Unknown
  RNA secondary structure sequence
gtgtatgatccgctaccagt

SEQ ID NO: 27985 - DNA, 20 bp, Unknown
  RNA secondary structure sequence
gcagctcggcgccacctccg

SEQ ID NO: 27986 - DNA, 20 bp, Unknown
  RNA secondary structure sequence
atggagaaactcctagatga

SEQ ID NO: 27987 - DNA, 20 bp, Unknown
  RNA secondary structure sequence
gagaaaggaaaagattagac

SEQ ID NO: 27988 - DNA, 20 bp, Unknown
  RNA secondary structure sequence
gagaaaggcccgcggatatg

SEQ ID NO: 27989 - DNA, 20 bp, Unknown
  RNA secondary structure sequence
cgcttccgaagatccgaggt

SEQ ID NO: 27990 - DNA, 20 bp, Unknown
  RNA secondary structure sequence
gcgcagttcccgctgtcctg

SEQ ID NO: 27991 - DNA, 20 bp, Unknown
  RNA secondary structure sequence
atatagctcaactgccatag

SEQ ID NO: 27992 - DNA, 20 bp, Unknown
  RNA secondary structure sequence
atatagctattggattggcc

SEQ ID NO: 27993 - DNA, 20 bp, Unknown
  RNA secondary structure sequence
ctccaggtatggtgcgcgct

SEQ ID NO: 27994 - DNA, 20 bp, Unknown
  RNA secondary structure sequence
attaacagtgccgccgcgcc

SEQ ID NO: 27995 - DNA, 20 bp, Unknown
  RNA secondary structure sequence
ggccttgtgcgctgtacttc

SEQ ID NO: 27996 - DNA, 20 bp, Unknown
  RNA secondary structure sequence
ttgagtatcacgcctccgga

SEQ ID NO: 27997 - DNA, 20 bp, Unknown
  RNA secondary structure sequence
ttgaatcaactgccagaccg

SEQ ID NO: 27998 - DNA, 20 bp, Unknown
  RNA secondary structure sequence
aactacatgttgtaaggctt

SEQ ID NO: 27999 - DNA, 20 bp, Unknown
  RNA secondary structure sequence
gtcataagtgacaagctagc

SEQ ID NO: 28000 - DNA, 20 bp, Unknown
  RNA secondary structure sequence
ccaggcctcactgctgagcg

SEQ ID NO: 28001 - DNA, 20 bp, Unknown
  RNA secondary structure sequence
ccaggccttgacaagctagc

SEQ ID NO: 28002 - DNA, 20 bp, Unknown
  RNA secondary structure sequence
ctggggcagggactacgaga

SEQ ID NO: 28003 - DNA, 20 bp, Unknown
  RNA secondary structure sequence
gaccacgtgggactacgaga

SEQ ID NO: 28004 - DNA, 20 bp, Unknown
  RNA secondary structure sequence
acaggctctagcttggtaga

SEQ ID NO: 28005 - DNA, 20 bp, Unknown
  RNA secondary structure sequence
ttctttatgtaaagacaccg

SEQ ID NO: 28006 - DNA, 20 bp, Unknown
  RNA secondary structure sequence
ttctttattagcttggtaga

SEQ ID NO: 28007 - DNA, 20 bp, Unknown
  RNA secondary structure sequence
cgcggagtcgcctcccggcc

SEQ ID NO: 28008 - DNA, 20 bp, Unknown
  RNA secondary structure sequence
cgcggagtgaatggagtcgg

SEQ ID NO: 28009 - DNA, 20 bp, Unknown
  RNA secondary structure sequence
cctcccagatttcttttaca

SEQ ID NO: 28010 - DNA, 20 bp, Unknown
  RNA secondary structure sequence
gagcagccgtgtggtatgat

SEQ ID NO: 28011 - DNA, 20 bp, Unknown
  RNA secondary structure sequence
catgtctctttgtgttcatc

SEQ ID NO: 28012 - DNA, 20 bp, Unknown
  RNA secondary structure sequence
tgaaagcgcgcactacacga

SEQ ID NO: 28013 - DNA, 20 bp, Unknown
  RNA secondary structure sequence
gtgacctcctcctcctcttt

SEQ ID NO: 28014 - DNA, 20 bp, Unknown
  RNA secondary structure sequence
gatccgaaaggaattggaat

SEQ ID NO: 28015 - DNA, 20 bp, Unknown
  RNA secondary structure sequence
ctcgtaccaggaattggaat

SEQ ID NO: 28016 - DNA, 20 bp, Unknown
  RNA secondary structure sequence
tatattcacaaaactgctgg

SEQ ID NO: 28017 - DNA, 20 bp, Unknown
  RNA secondary structure sequence
gtagtgtcgatgatctcatt

SEQ ID NO: 28018 - DNA, 20 bp, Unknown
  RNA secondary structure sequence
atttgtcgacaacatcttac

SEQ ID NO: 28019 - DNA, 20 bp, Unknown
  RNA secondary structure sequence
gggcgcccagaaggagcagg

SEQ ID NO: 28020 - DNA, 20 bp, Unknown
  RNA secondary structure sequence
acagctatagaaggagcagg

SEQ ID NO: 28021 - DNA, 20 bp, Unknown
  RNA secondary structure sequence
ctactggacagaccggaatg

SEQ ID NO: 28022 - DNA, 20 bp, Unknown
  RNA secondary structure sequence
ggggtgtagaggaaggaagg

SEQ ID NO: 28023 - DNA, 20 bp, Unknown
  RNA secondary structure sequence
tcaggtagattgttatctat

SEQ ID NO: 28024 - DNA, 20 bp, Unknown
  RNA secondary structure sequence
gaagcctggacccacacgcg

SEQ ID NO: 28025 - DNA, 20 bp, Unknown
  RNA secondary structure sequence
ctcattgccgttaaacatca

SEQ ID NO: 28026 - DNA, 20 bp, Unknown
  RNA secondary structure sequence
tgttaatgaaacaagccaga

SEQ ID NO: 28027 - DNA, 20 bp, Unknown
  RNA secondary structure sequence
cgaagcacccagataagagc

SEQ ID NO: 28028 - DNA, 20 bp, Unknown
  RNA secondary structure sequence
cgaagcacgactgctcccag

SEQ ID NO: 28029 - DNA, 20 bp, Unknown
  RNA secondary structure sequence
gcgggctgctcgcgccggct

SEQ ID NO: 28030 - DNA, 20 bp, Unknown
  RNA secondary structure sequence
ctttgtggtttttgtaattt

SEQ ID NO: 28031 - DNA, 20 bp, Unknown
  RNA secondary structure sequence
tttccgcacgcctcgaggcg

SEQ ID NO: 28032 - DNA, 20 bp, Unknown
  RNA secondary structure sequence
agtgtaagaaacagtaagcc

SEQ ID NO: 28033 - DNA, 20 bp, Unknown
  RNA secondary structure sequence
ccctcgagattacataggtc

SEQ ID NO: 28034 - DNA, 20 bp, Unknown
  RNA secondary structure sequence
agtagcaggccagagtctga

SEQ ID NO: 28035 - DNA, 20 bp, Unknown
  RNA secondary structure sequence
ccaggtgacagcggcatgga

SEQ ID NO: 28036 - DNA, 20 bp, Unknown
  RNA secondary structure sequence
ccaggtgatcagcagcgcac

SEQ ID NO: 28037 - DNA, 20 bp, Unknown
  RNA secondary structure sequence
ggccagaccagcggcatgga

SEQ ID NO: 28038 - DNA, 20 bp, Unknown
  RNA secondary structure sequence
caatataacaaaaaaacatg

SEQ ID NO: 28039 - DNA, 20 bp, Unknown
  RNA secondary structure sequence
aggcagcggaaccccccacc

SEQ ID NO: 28040 - DNA, 20 bp, Unknown
  RNA secondary structure sequence
ccaaccacgaaccccccacc

SEQ ID NO: 28041 - DNA, 20 bp, Unknown
  RNA secondary structure sequence
ttttcaacattaatactatt

SEQ ID NO: 28042 - DNA, 20 bp, Unknown
  RNA secondary structure sequence
acacggctattaatactatt

SEQ ID NO: 28043 - DNA, 20 bp, Unknown
  RNA secondary structure sequence
tgctgccgaggtaactctct

SEQ ID NO: 28044 - DNA, 20 bp, Unknown
  RNA secondary structure sequence
cacaggagttgtaaggcagc

SEQ ID NO: 28045 - DNA, 20 bp, Unknown
  RNA secondary structure sequence
cagtggatcaaatcctcatg

SEQ ID NO: 28046 - DNA, 20 bp, Unknown
  RNA secondary structure sequence
gttgtttcacctcagcatcc

SEQ ID NO: 28047 - DNA, 20 bp, Unknown
  RNA secondary structure sequence
cttacagagactggaaaaga

SEQ ID NO: 28048 - DNA, 20 bp, Unknown
  RNA secondary structure sequence
gtagtcctccggcccctgaa

SEQ ID NO: 28049 - DNA, 20 bp, Unknown
  RNA secondary structure sequence
gtagtcctggattgaagatc

SEQ ID NO: 28050 - DNA, 20 bp, Unknown
  RNA secondary structure sequence
cccagcctgaggaaggaagg

SEQ ID NO: 28051 - DNA, 20 bp, Unknown
  RNA secondary structure sequence
ttgagtatggatatcatatt

SEQ ID NO: 28052 - DNA, 20 bp, Unknown
  RNA secondary structure sequence
gcctactgcacgcctccgga

SEQ ID NO: 28053 - DNA, 20 bp, Unknown
  RNA secondary structure sequence
tcaagctcaaatgcactgga

SEQ ID NO: 28054 - DNA, 20 bp, Unknown
  RNA secondary structure sequence
tgagcgatttgtgcaattaa

SEQ ID NO: 28055 - DNA, 20 bp, Unknown
  RNA secondary structure sequence
ctgtaggaaagttaaaacca

SEQ ID NO: 28056 - DNA, 20 bp, Unknown
  RNA secondary structure sequence
aatagtgtctggagccggtc

SEQ ID NO: 28057 - DNA, 20 bp, Unknown
  RNA secondary structure sequence
agtcgaaagtattgctatag

SEQ ID NO: 28058 - DNA, 20 bp, Unknown
  RNA secondary structure sequence
ctctcgccgccgcccgagcg

SEQ ID NO: 28059 - DNA, 20 bp, Unknown
  RNA secondary structure sequence
aaaggcagaagccttcaggt

SEQ ID NO: 28060 - DNA, 20 bp, Unknown
  RNA secondary structure sequence
gcgactgtcaaacgttggac

SEQ ID NO: 28061 - DNA, 20 bp, Unknown
  RNA secondary structure sequence
atgaattagaaagaatcagg

SEQ ID NO: 28062 - DNA, 20 bp, Unknown
  RNA secondary structure sequence
tcacgcacgaaagaatcagg

SEQ ID NO: 28063 - DNA, 20 bp, Unknown
  RNA secondary structure sequence
gcaaaaagattacgtaggtc

SEQ ID NO: 28064 - DNA, 20 bp, Unknown
  RNA secondary structure sequence
ttgccgctattacgtaggtc

SEQ ID NO: 28065 - DNA, 20 bp, Unknown
  RNA secondary structure sequence
ggccccgcggagccaggttg

SEQ ID NO: 28066 - DNA, 20 bp, Unknown
  RNA secondary structure sequence
ccagaaggcagtgaaattcc

SEQ ID NO: 28067 - DNA, 20 bp, Unknown
  RNA secondary structure sequence
aaaaagacgagtatttactt

SEQ ID NO: 28068 - DNA, 20 bp, Unknown
  RNA secondary structure sequence
gttatgcatccacgtcgccc

SEQ ID NO: 28069 - DNA, 20 bp, Unknown
  RNA secondary structure sequence
tcctgttgatccgcatggtg

SEQ ID NO: 28070 - DNA, 20 bp, Unknown
  RNA secondary structure sequence
tcctgttgccgtttccctcc

SEQ ID NO: 28071 - DNA, 20 bp, Unknown
  RNA secondary structure sequence
cgagcagcttccagtcgtgt

SEQ ID NO: 28072 - DNA, 20 bp, Unknown
  RNA secondary structure sequence
tggccggattaacttcaaag

SEQ ID NO: 28073 - DNA, 20 bp, Unknown
  RNA secondary structure sequence
aaaacgcgatccaacgccga

SEQ ID NO: 28074 - DNA, 20 bp, Unknown
  RNA secondary structure sequence
ccacggaggcccaaggcgaa

SEQ ID NO: 28075 - DNA, 20 bp, Unknown
  RNA secondary structure sequence
gctgccgcccgagcccgggt

SEQ ID NO: 28076 - DNA, 20 bp, Unknown
  RNA secondary structure sequence
agactgttccgagcccgggt

SEQ ID NO: 28077 - DNA, 20 bp, Unknown
  RNA secondary structure sequence
ggctgggagagaccacccgc

SEQ ID NO: 28078 - DNA, 20 bp, Unknown
  RNA secondary structure sequence
ggctgggattttattgtgct

SEQ ID NO: 28079 - DNA, 20 bp, Unknown
  RNA secondary structure sequence
aatacatagggcgggagctg

SEQ ID NO: 28080 - DNA, 20 bp, Unknown
  RNA secondary structure sequence
cctagtccctgcactaggtt

SEQ ID NO: 28081 - DNA, 20 bp, Unknown
  RNA secondary structure sequence
ccggtgagttgcactaggtt

SEQ ID NO: 28082 - DNA, 20 bp, Unknown
  RNA secondary structure sequence
cctagtcctgcgtacgatac

SEQ ID NO: 28083 - DNA, 20 bp, Unknown
  RNA secondary structure sequence
aagctgtgctgcactaggtt

SEQ ID NO: 28084 - DNA, 20 bp, Unknown
  RNA secondary structure sequence
atggcttaagccctgagtac

SEQ ID NO: 28085 - DNA, 20 bp, Unknown
  RNA secondary structure sequence
agaacctgggttcgcgacgc

SEQ ID NO: 28086 - DNA, 20 bp, Unknown
  RNA secondary structure sequence
cctcggctggttcgcgacgc

SEQ ID NO: 28087 - DNA, 20 bp, Unknown
  RNA secondary structure sequence
aggcgcacaacgtttttcga

SEQ ID NO: 28088 - DNA, 20 bp, Unknown
  RNA secondary structure sequence
aaatccagtaaagaaagtgt

SEQ ID NO: 28089 - DNA, 20 bp, Unknown
  RNA secondary structure sequence
tgccaggtgtgaagtggagt

SEQ ID NO: 28090 - DNA, 20 bp, Unknown
  RNA secondary structure sequence
aatgtacagtgaagtggagt

SEQ ID NO: 28091 - DNA, 20 bp, Unknown
  RNA secondary structure sequence
cggcgccgagtaaataagat

SEQ ID NO: 28092 - DNA, 20 bp, Unknown
  RNA secondary structure sequence
cggcgccggcccccgccttc

SEQ ID NO: 28093 - DNA, 20 bp, Unknown
  RNA secondary structure sequence
acgacgccactatggttgat

SEQ ID NO: 28094 - DNA, 20 bp, Unknown
  RNA secondary structure sequence
caagtttctggtctttaaaa

SEQ ID NO: 28095 - DNA, 20 bp, Unknown
  RNA secondary structure sequence
tcgccgaatggtctttaaaa

SEQ ID NO: 28096 - DNA, 20 bp, Unknown
  RNA secondary structure sequence
cactgcccggcggactgaat

SEQ ID NO: 28097 - DNA, 20 bp, Unknown
  RNA secondary structure sequence
aattgattagttagatggaa

SEQ ID NO: 28098 - DNA, 20 bp, Unknown
  RNA secondary structure sequence
aggagacccatcgtggtata

SEQ ID NO: 28099 - DNA, 20 bp, Unknown
  RNA secondary structure sequence
tctgatgaagcagaaaagaa

SEQ ID NO: 28100 - DNA, 20 bp, Unknown
  RNA secondary structure sequence
ccgtccccgactccttcctc

SEQ ID NO: 28101 - DNA, 20 bp, Unknown
  RNA secondary structure sequence
aaacggtggactccttcctc

SEQ ID NO: 28102 - DNA, 20 bp, Unknown
  RNA secondary structure sequence
tttctttcgcagtcgtggct

SEQ ID NO: 28103 - DNA, 20 bp, Unknown
  RNA secondary structure sequence
ccatcagattcatcatcaac

SEQ ID NO: 28104 - DNA, 20 bp, Unknown
  RNA secondary structure sequence
ccatcagacgacgacgatga

SEQ ID NO: 28105 - DNA, 20 bp, Unknown
  RNA secondary structure sequence
tgtggcagaactcaaatgga

SEQ ID NO: 28106 - DNA, 20 bp, Unknown
  RNA secondary structure sequence
ataaagacctcaccggcggt

SEQ ID NO: 28107 - DNA, 20 bp, Unknown
  RNA secondary structure sequence
gggcctcgctcaattctaac

SEQ ID NO: 28108 - DNA, 20 bp, Unknown
  RNA secondary structure sequence
aatcatacaacatccacacg

SEQ ID NO: 28109 - DNA, 20 bp, Unknown
  RNA secondary structure sequence
gtgtaccataataaaataca

SEQ ID NO: 28110 - DNA, 20 bp, Unknown
  RNA secondary structure sequence
cccgtttttaataaaataca

SEQ ID NO: 28111 - DNA, 20 bp, Unknown
  RNA secondary structure sequence
tggagacaacatgtgggaac

SEQ ID NO: 28112 - DNA, 20 bp, Unknown
  RNA secondary structure sequence
actctcgtacatgtggttct

SEQ ID NO: 28113 - DNA, 20 bp, Unknown
  RNA secondary structure sequence
tggagacaacatgtggcaaa

SEQ ID NO: 28114 - DNA, 20 bp, Unknown
  RNA secondary structure sequence
tggagacacggctccccggg

SEQ ID NO: 28115 - DNA, 20 bp, Unknown
  RNA secondary structure sequence
tggagacatgtccacaaggc

SEQ ID NO: 28116 - DNA, 20 bp, Unknown
  RNA secondary structure sequence
aactatggacatgtggttct

SEQ ID NO: 28117 - DNA, 20 bp, Unknown
  RNA secondary structure sequence
tctaaggacgtggtttttca

SEQ ID NO: 28118 - DNA, 20 bp, Unknown
  RNA secondary structure sequence
tctaaggagccctccaaagt

SEQ ID NO: 28119 - DNA, 20 bp, Unknown
  RNA secondary structure sequence
acgaggcgagccttcttcgc

SEQ ID NO: 28120 - DNA, 20 bp, Unknown
  RNA secondary structure sequence
acgaggcggctgacggggcg

SEQ ID NO: 28121 - DNA, 20 bp, Unknown
  RNA secondary structure sequence
tacctaatgctgacggggcg

SEQ ID NO: 28122 - DNA, 20 bp, Unknown
  RNA secondary structure sequence
gtcaggcgtgcctggagatt

SEQ ID NO: 28123 - DNA, 20 bp, Unknown
  RNA secondary structure sequence
ctctcttgaccaataggcgt

SEQ ID NO: 28124 - DNA, 20 bp, Unknown
  RNA secondary structure sequence
aacgcccatgctcccagggg

SEQ ID NO: 28125 - DNA, 20 bp, Unknown
  RNA secondary structure sequence
ctgttgacgagagggttttc

SEQ ID NO: 28126 - DNA, 20 bp, Unknown
  RNA secondary structure sequence
ctgttgactgctcccagggg

SEQ ID NO: 28127 - DNA, 20 bp, Unknown
  RNA secondary structure sequence
ccagccccgaggctcagaag

SEQ ID NO: 28128 - DNA, 20 bp, Unknown
  RNA secondary structure sequence
cagcatgtcggtgcatggtg

SEQ ID NO: 28129 - DNA, 20 bp, Unknown
  RNA secondary structure sequence
tttacccgcggtgcatggtg

SEQ ID NO: 28130 - DNA, 20 bp, Unknown
  RNA secondary structure sequence
tcgacgcaactttctcgtcg

SEQ ID NO: 28131 - DNA, 20 bp, Unknown
  RNA secondary structure sequence
ggctgcggactttctcgtcg

SEQ ID NO: 28132 - DNA, 20 bp, Unknown
  RNA secondary structure sequence
ggctgcggcgaccgctaggc

SEQ ID NO: 28133 - DNA, 20 bp, Unknown
  RNA secondary structure sequence
ggcggcggggctcgcgcggg

SEQ ID NO: 28134 - DNA, 20 bp, Unknown
  RNA secondary structure sequence
aaacctttggctcgcgcggg

SEQ ID NO: 28135 - DNA, 20 bp, Unknown
  RNA secondary structure sequence
cgcccgcctgccctgccgct

SEQ ID NO: 28136 - DNA, 20 bp, Unknown
  RNA secondary structure sequence
tcgtgtggtgccctgccgct

SEQ ID NO: 28137 - DNA, 20 bp, Unknown
  RNA secondary structure sequence
tgagtcagtctgaggaaatg

SEQ ID NO: 28138 - DNA, 20 bp, Unknown
  RNA secondary structure sequence
gccaccgcggggcccgggtg

SEQ ID NO: 28139 - DNA, 20 bp, Unknown
  RNA secondary structure sequence
cgctcccgacatgccccgcc

SEQ ID NO: 28140 - DNA, 20 bp, Unknown
  RNA secondary structure sequence
cgctcccgacatgccccgcg

SEQ ID NO: 28141 - DNA, 20 bp, Unknown
  RNA secondary structure sequence
aagatttcacatgccccgcc

SEQ ID NO: 28142 - DNA, 20 bp, Unknown
  RNA secondary structure sequence
gtagatgccgcgcgccctcc

SEQ ID NO: 28143 - DNA, 20 bp, Unknown
  RNA secondary structure sequence
accccgctaatctattactg

SEQ ID NO: 28144 - DNA, 20 bp, Unknown
  RNA secondary structure sequence
aaagcaggtacttatgcact

SEQ ID NO: 28145 - DNA, 20 bp, Unknown
  RNA secondary structure sequence
tttattatatggagctggag

SEQ ID NO: 28146 - DNA, 20 bp, Unknown
  RNA secondary structure sequence
ccctcgccgcggtcccatgg

SEQ ID NO: 28147 - DNA, 20 bp, Unknown
  RNA secondary structure sequence
ttggggtgagcgaatgacaa

SEQ ID NO: 28148 - DNA, 20 bp, Unknown
  RNA secondary structure sequence
cgggcgcgaatgtagactta

SEQ ID NO: 28149 - DNA, 20 bp, Unknown
  RNA secondary structure sequence
cgggcgcgggccggcgggcg

SEQ ID NO: 28150 - DNA, 20 bp, Unknown
  RNA secondary structure sequence
taggcaattgcccggccatt

SEQ ID NO: 28151 - DNA, 20 bp, Unknown
  RNA secondary structure sequence
ccgctcaatgcccggaaatt

SEQ ID NO: 28152 - DNA, 20 bp, Unknown
  RNA secondary structure sequence
ccgctcaaactgaatgcccc

SEQ ID NO: 28153 - DNA, 20 bp, Unknown
  RNA secondary structure sequence
ccgctcaatgcccggagatt

SEQ ID NO: 28154 - DNA, 20 bp, Unknown
  RNA secondary structure sequence
ataggggttgcccggaaatt

SEQ ID NO: 28155 - DNA, 20 bp, Unknown
  RNA secondary structure sequence
cgaggcttcgtcctgcgccg

SEQ ID NO: 28156 - DNA, 20 bp, Unknown
  RNA secondary structure sequence
ctcactcgcacaagtggacc

SEQ ID NO: 28157 - DNA, 20 bp, Unknown
  RNA secondary structure sequence
aattagatcacaagtggacc

SEQ ID NO: 28158 - DNA, 20 bp, Unknown
  RNA secondary structure sequence
agggacacgcagtgacgagc

SEQ ID NO: 28159 - DNA, 20 bp, Unknown
  RNA secondary structure sequence
tgacaggacgtctggacccg

SEQ ID NO: 28160 - DNA, 20 bp, Unknown
  RNA secondary structure sequence
cgaataattgccgccccagc

SEQ ID NO: 28161 - DNA, 20 bp, Unknown
  RNA secondary structure sequence
ctctcgcagctgccacccga

SEQ ID NO: 28162 - DNA, 20 bp, Unknown
  RNA secondary structure sequence
ctctcgcacgacaattgtcc

SEQ ID NO: 28163 - DNA, 20 bp, Unknown
  RNA secondary structure sequence
gagtcatcgacccaaaaggt

SEQ ID NO: 28164 - DNA, 20 bp, Unknown
  RNA secondary structure sequence
cgacgttggtcgaagttcgt

SEQ ID NO: 28165 - DNA, 20 bp, Unknown
  RNA secondary structure sequence
gcagaggcctgagcgcctga

SEQ ID NO: 28166 - DNA, 20 bp, Unknown
  RNA secondary structure sequence
tcgcgaggcaaatcatcctg

SEQ ID NO: 28167 - DNA, 20 bp, Unknown
  RNA secondary structure sequence
tcgcgagggtttgggaggat

SEQ ID NO: 28168 - DNA, 20 bp, Unknown
  RNA secondary structure sequence
actgcgcggaggcacagagg

SEQ ID NO: 28169 - DNA, 20 bp, Unknown
  RNA secondary structure sequence
gcgccgcgcgaagtcccaat

SEQ ID NO: 28170 - DNA, 20 bp, Unknown
  RNA secondary structure sequence
attggtttgctcagggagga

SEQ ID NO: 28171 - DNA, 20 bp, Unknown
  RNA secondary structure sequence
agtcccagtggcggaggcta

SEQ ID NO: 28172 - DNA, 20 bp, Unknown
  RNA secondary structure sequence
gaaatctcctggagggccgg

SEQ ID NO: 28173 - DNA, 20 bp, Unknown
  RNA secondary structure sequence
tgtcagagacctgtaatgct

SEQ ID NO: 28174 - DNA, 20 bp, Unknown
  RNA secondary structure sequence
tgtcagagctggagggccgg

SEQ ID NO: 28175 - DNA, 20 bp, Unknown
  RNA secondary structure sequence
agcagcagcaaccactagcc

SEQ ID NO: 28176 - DNA, 20 bp, Unknown
  RNA secondary structure sequence
gaagggggcggagaggaagg

SEQ ID NO: 28177 - DNA, 20 bp, Unknown
  RNA secondary structure sequence
cagtaatagacgccgaggcg

SEQ ID NO: 28178 - DNA, 20 bp, Unknown
  RNA secondary structure sequence
agcatgatcggcgcccgagg

SEQ ID NO: 28179 - DNA, 20 bp, Unknown
  RNA secondary structure sequence
ggcagagagcacggagccgg

SEQ ID NO: 28180 - DNA, 20 bp, Unknown
  RNA secondary structure sequence
agacgccgcgctcagcttcc

SEQ ID NO: 28181 - DNA, 20 bp, Unknown
  RNA secondary structure sequence
gcgctctgtgtggccgaggc

SEQ ID NO: 28182 - DNA, 20 bp, Unknown
  RNA secondary structure sequence
ggcggcggcgggtgagctca

SEQ ID NO: 28183 - DNA, 20 bp, Unknown
  RNA secondary structure sequence
aaggtaccaggaaccgaatt

SEQ ID NO: 28184 - DNA, 20 bp, Unknown
  RNA secondary structure sequence
tctcagcaaagagcctggaa

SEQ ID NO: 28185 - DNA, 20 bp, Unknown
  RNA secondary structure sequence
tggtgggattctcagattgg

SEQ ID NO: 28186 - DNA, 20 bp, Unknown
  RNA secondary structure sequence
atggagaaggcgtggacgac

SEQ ID NO: 28187 - DNA, 20 bp, Unknown
  RNA secondary structure sequence
gcctccttactcctagatga

SEQ ID NO: 28188 - DNA, 20 bp, Unknown
  RNA secondary structure sequence
caaggagggacgtgttggct

SEQ ID NO: 28189 - DNA, 20 bp, Unknown
  RNA secondary structure sequence
agtcatcatgtacagccctg

SEQ ID NO: 28190 - DNA, 20 bp, Unknown
  RNA secondary structure sequence
cgaccgggagcggctgggtt

SEQ ID NO: 28191 - DNA, 20 bp, Unknown
  RNA secondary structure sequence
gtagccggtccttggcaaga

SEQ ID NO: 28192 - DNA, 20 bp, Unknown
  RNA secondary structure sequence
tccaagtcggacaccaggaa

SEQ ID NO: 28193 - DNA, 20 bp, Unknown
  RNA secondary structure sequence
gccctctcgctttccctctc

SEQ ID NO: 28194 - DNA, 20 bp, Unknown
  RNA secondary structure sequence
ggctgcagggccgctaggcc

SEQ ID NO: 28195 - DNA, 20 bp, Unknown
  RNA secondary structure sequence
gaaaagagtaagagtactga

SEQ ID NO: 28196 - DNA, 20 bp, Unknown
  RNA secondary structure sequence
ccgcttacccggcagggcgt

SEQ ID NO: 28197 - DNA, 20 bp, Unknown
  RNA secondary structure sequence
gcagtgggccgcctcgatcc

SEQ ID NO: 28198 - DNA, 20 bp, Unknown
  RNA secondary structure sequence
gcagtggggactaaacggtt

SEQ ID NO: 28199 - DNA, 20 bp, Unknown
  RNA secondary structure sequence
ccgctcaatacccagaaatt

SEQ ID NO: 28200 - DNA, 20 bp, Unknown
  RNA secondary structure sequence
gtcagtgttacccagaaatt

SEQ ID NO: 28201 - DNA, 20 bp, Unknown
  RNA secondary structure sequence
cagacgcggcgtggctgtga

SEQ ID NO: 28202 - DNA, 20 bp, Unknown
  RNA secondary structure sequence
tccatgctggaggctgggtg

SEQ ID NO: 28203 - DNA, 20 bp, Unknown
  RNA secondary structure sequence
accaaggaaggcagcggcag

SEQ ID NO: 28204 - DNA, 20 bp, Unknown
  RNA secondary structure sequence
gctggacacaccgcctccga

SEQ ID NO: 28205 - DNA, 20 bp, Unknown
  RNA secondary structure sequence
tggccgtgcaccgcctccga

SEQ ID NO: 28206 - DNA, 20 bp, Unknown
  RNA secondary structure sequence
tccttggcctgacccagaat

SEQ ID NO: 28207 - DNA, 20 bp, Unknown
  RNA secondary structure sequence
agtcaaaacgctccgtaacc

SEQ ID NO: 28208 - DNA, 20 bp, Unknown
  RNA secondary structure sequence
agtcaaaagagggttgtcaa

SEQ ID NO: 28209 - DNA, 20 bp, Unknown
  RNA secondary structure sequence
tgcgttggcggcctacctat

SEQ ID NO: 28210 - DNA, 20 bp, Unknown
  RNA secondary structure sequence
cagccctcgcctccctgccc

SEQ ID NO: 28211 - DNA, 20 bp, Unknown
  RNA secondary structure sequence
gcaccatgctaacttcgaac

SEQ ID NO: 28212 - DNA, 20 bp, Unknown
  RNA secondary structure sequence
agtttcaatcttacagttgt

SEQ ID NO: 28213 - DNA, 20 bp, Unknown
  RNA secondary structure sequence
aaagcggcttttggttcggc

SEQ ID NO: 28214 - DNA, 20 bp, Unknown
  RNA secondary structure sequence
gtgcacatttttggttcggc

SEQ ID NO: 28215 - DNA, 20 bp, Unknown
  RNA secondary structure sequence
cgtatgttcagatcaaaagt

SEQ ID NO: 28216 - DNA, 20 bp, Unknown
  RNA secondary structure sequence
atagaagccagatcaaaagt

SEQ ID NO: 28217 - DNA, 20 bp, Unknown
  RNA secondary structure sequence
gtgagccctgtttttgccac

SEQ ID NO: 28218 - DNA, 20 bp, Unknown
  RNA secondary structure sequence
gtgagcccgcaaaggattgg

SEQ ID NO: 28219 - DNA, 20 bp, Unknown
  RNA secondary structure sequence
cagcaagtcttttccacaat

SEQ ID NO: 28220 - DNA, 20 bp, Unknown
  RNA secondary structure sequence
tttacgaccttttccacaat

SEQ ID NO: 28221 - DNA, 20 bp, Unknown
  RNA secondary structure sequence
ctaaaatcgcgctgtacttc

SEQ ID NO: 28222 - DNA, 20 bp, Unknown
  RNA secondary structure sequence
attatgggctattctagatc

SEQ ID NO: 28223 - DNA, 20 bp, Unknown
  RNA secondary structure sequence
tgtctttataacgtcgcatc

SEQ ID NO: 28224 - DNA, 20 bp, Unknown
  RNA secondary structure sequence
tgtggtgaaggcgtgtaaaa

SEQ ID NO: 28225 - DNA, 20 bp, Unknown
  RNA secondary structure sequence
aagtctttgttttgaaagat

SEQ ID NO: 28226 - DNA, 20 bp, Unknown
  RNA secondary structure sequence
tgtcatttcctacctgttcg

SEQ ID NO: 28227 - DNA, 20 bp, Unknown
  RNA secondary structure sequence
tatgaaacttatggggatac

SEQ ID NO: 28228 - DNA, 20 bp, Unknown
  RNA secondary structure sequence
tagccataagagagtgggga

SEQ ID NO: 28229 - DNA, 20 bp, Unknown
  RNA secondary structure sequence
tggtttaaggacctcacgga

SEQ ID NO: 28230 - DNA, 20 bp, Unknown
  RNA secondary structure sequence
agataaataatccagtccct

SEQ ID NO: 28231 - DNA, 20 bp, Unknown
  RNA secondary structure sequence
tctggggaaatccagtccct

SEQ ID NO: 28232 - DNA, 20 bp, Unknown
  RNA secondary structure sequence
gggggcgccgcaggcgcgag

SEQ ID NO: 28233 - DNA, 20 bp, Unknown
  RNA secondary structure sequence
gtcacgtgccgaaaatccct

SEQ ID NO: 28234 - DNA, 20 bp, Unknown
  RNA secondary structure sequence
tgttgggaatcttcagccag

SEQ ID NO: 28235 - DNA, 20 bp, Unknown
  RNA secondary structure sequence
ctcgaagcaatgtatggccc

SEQ ID NO: 28236 - DNA, 20 bp, Unknown
  RNA secondary structure sequence
agactcaagggtctgtcgga

SEQ ID NO: 28237 - DNA, 20 bp, Unknown
  RNA secondary structure sequence
ggcaggcgtcatctacttct

SEQ ID NO: 28238 - DNA, 20 bp, Unknown
  RNA secondary structure sequence
attgcatacgggagcagcac

SEQ ID NO: 28239 - DNA, 20 bp, Unknown
  RNA secondary structure sequence
ctactgcttccctcgttcga

SEQ ID NO: 28240 - DNA, 20 bp, Unknown
  RNA secondary structure sequence
tcttcctcggggtagggatg

SEQ ID NO: 28241 - DNA, 20 bp, Unknown
  RNA secondary structure sequence
gatcgtcactaaattcagcc

SEQ ID NO: 28242 - DNA, 20 bp, Unknown
  RNA secondary structure sequence
gatcgtcttagtatgagaat

SEQ ID NO: 28243 - DNA, 20 bp, Unknown
  RNA secondary structure sequence
ttcgcggagctccctcagcc

SEQ ID NO: 28244 - DNA, 20 bp, Unknown
  RNA secondary structure sequence
gcgtctcgcctgcgcgggct

SEQ ID NO: 28245 - DNA, 20 bp, Unknown
  RNA secondary structure sequence
ctattgagctaggagggcca

SEQ ID NO: 28246 - DNA, 20 bp, Unknown
  RNA secondary structure sequence
gctgctccctaggagggcca

SEQ ID NO: 28247 - DNA, 20 bp, Unknown
  RNA secondary structure sequence
cgcggggagccaggcctcgg

SEQ ID NO: 28248 - DNA, 20 bp, Unknown
  RNA secondary structure sequence
aattataggccaggcctcgg

SEQ ID NO: 28249 - DNA, 20 bp, Unknown
  RNA secondary structure sequence
cgcggggacgggtcgtagat

SEQ ID NO: 28250 - DNA, 20 bp, Unknown
  RNA secondary structure sequence
ttgttaccatatagctattg

SEQ ID NO: 28251 - DNA, 20 bp, Unknown
  RNA secondary structure sequence
gcgccgtcggtgagtcagtc

SEQ ID NO: 28252 - DNA, 20 bp, Unknown
  RNA secondary structure sequence
aatccttacgcggcgcattt

SEQ ID NO: 28253 - DNA, 20 bp, Unknown
  RNA secondary structure sequence
cgccagcttgggaaaaggcc

SEQ ID NO: 28254 - DNA, 20 bp, Unknown
  RNA secondary structure sequence
tgccagcttgggaaaaggcc

SEQ ID NO: 28255 - DNA, 20 bp, Unknown
  RNA secondary structure sequence
tgcccactaacttaacttat

SEQ ID NO: 28256 - DNA, 20 bp, Unknown
  RNA secondary structure sequence
tgcccactgctcagtggagc

SEQ ID NO: 28257 - DNA, 20 bp, Unknown
  RNA secondary structure sequence
gggactgcaattattaacat

SEQ ID NO: 28258 - DNA, 20 bp, Unknown
  RNA secondary structure sequence
gggactgctcggccgcctcc

SEQ ID NO: 28259 - DNA, 20 bp, Unknown
  RNA secondary structure sequence
ggcactcgaggtgtgagcgg

SEQ ID NO: 28260 - DNA, 20 bp, Unknown
  RNA secondary structure sequence
cagctagcccaaacagcgac

SEQ ID NO: 28261 - DNA, 20 bp, Unknown
  RNA secondary structure sequence
caggacgctcaacccaccgt

SEQ ID NO: 28262 - DNA, 20 bp, Unknown
  RNA secondary structure sequence
ggttcccggggagggggcgt

SEQ ID NO: 28263 - DNA, 20 bp, Unknown
  RNA secondary structure sequence
ggttcccgttcgttcaatag

SEQ ID NO: 28264 - DNA, 20 bp, Unknown
  RNA secondary structure sequence
ccgaggacgggagggggcgt

SEQ ID NO: 28265 - DNA, 20 bp, Unknown
  RNA secondary structure sequence
catcctgaaagaaaacagat

SEQ ID NO: 28266 - DNA, 20 bp, Unknown
  RNA secondary structure sequence
catcctgacgcctcctcccc

SEQ ID NO: 28267 - DNA, 20 bp, Unknown
  RNA secondary structure sequence
tgcgtcagcgcctcctcccc

SEQ ID NO: 28268 - DNA, 20 bp, Unknown
  RNA secondary structure sequence
tgttttttctttaacctttc

SEQ ID NO: 28269 - DNA, 20 bp, Unknown
  RNA secondary structure sequence
gtacaccggaattgccagga

SEQ ID NO: 28270 - DNA, 20 bp, Unknown
  RNA secondary structure sequence
gtacaccgcgtcgagtttag

SEQ ID NO: 28271 - DNA, 20 bp, Unknown
  RNA secondary structure sequence
agtgtcctcaccttccaatt

SEQ ID NO: 28272 - DNA, 20 bp, Unknown
  RNA secondary structure sequence
tctttgattgcgtcaatcat

SEQ ID NO: 28273 - DNA, 20 bp, Unknown
  RNA secondary structure sequence
tcaggccccctccgcctcca

SEQ ID NO: 28274 - DNA, 20 bp, Unknown
  RNA secondary structure sequence
ccggtgtatcggttaggttt

SEQ ID NO: 28275 - DNA, 20 bp, Unknown
  RNA secondary structure sequence
taacacctcttcagtttccg

SEQ ID NO: 28276 - DNA, 20 bp, Unknown
  RNA secondary structure sequence
gctccggtagcagcaagttc

SEQ ID NO: 28277 - DNA, 20 bp, Unknown
  RNA secondary structure sequence
taaggcaaagcagcaagttc

SEQ ID NO: 28278 - DNA, 20 bp, Unknown
  RNA secondary structure sequence
tgttggggacctgacgctat

SEQ ID NO: 28279 - DNA, 20 bp, Unknown
  RNA secondary structure sequence
tgaaaattgagagtgcggat

SEQ ID NO: 28280 - DNA, 20 bp, Unknown
  RNA secondary structure sequence
aaccttcaattgtgagctcg

SEQ ID NO: 28281 - DNA, 20 bp, Unknown
  RNA secondary structure sequence
agaaagcgagacaggcaggt

SEQ ID NO: 28282 - DNA, 20 bp, Unknown
  RNA secondary structure sequence
tacgttaaagacaggcaggt

SEQ ID NO: 28283 - DNA, 20 bp, Unknown
  RNA secondary structure sequence
actcgaacctgccgctgtcg

SEQ ID NO: 28284 - DNA, 20 bp, Unknown
  RNA secondary structure sequence
tgcaagagggcaggctggat

SEQ ID NO: 28285 - DNA, 20 bp, Unknown
  RNA secondary structure sequence
ggtgtgagagcggaagtggc

SEQ ID NO: 28286 - DNA, 20 bp, Unknown
  RNA secondary structure sequence
cgccgccgcccggacccgcg

SEQ ID NO: 28287 - DNA, 20 bp, Unknown
  RNA secondary structure sequence
ctcttccgcttgcgctgccg

SEQ ID NO: 28288 - DNA, 20 bp, Unknown
  RNA secondary structure sequence
tggcctatcttgcgctgccg

SEQ ID NO: 28289 - DNA, 20 bp, Unknown
  RNA secondary structure sequence
tctagtgattccccgggata

SEQ ID NO: 28290 - DNA, 20 bp, Unknown
  RNA secondary structure sequence
aagtcgaggctgaaaactgt

SEQ ID NO: 28291 - DNA, 20 bp, Unknown
  RNA secondary structure sequence
aagtcgagttccccgggata

SEQ ID NO: 28292 - DNA, 20 bp, Unknown
  RNA secondary structure sequence
catgcgcagcggggccgtgg

SEQ ID NO: 28293 - DNA, 20 bp, Unknown
  RNA secondary structure sequence
ctcttacatcttttcctata

SEQ ID NO: 28294 - DNA, 20 bp, Unknown
  RNA secondary structure sequence
tggcatttcggacaaggggt

SEQ ID NO: 28295 - DNA, 20 bp, Unknown
  RNA secondary structure sequence
tggcattttcttttcctata

SEQ ID NO: 28296 - DNA, 20 bp, Unknown
  RNA secondary structure sequence
gtccccgccgccccgacgct

SEQ ID NO: 28297 - DNA, 20 bp, Unknown
  RNA secondary structure sequence
aggagtcacgccccgacgct

SEQ ID NO: 28298 - DNA, 20 bp, Unknown
  RNA secondary structure sequence
gccccgccggcggggcggtc

SEQ ID NO: 28299 - DNA, 20 bp, Unknown
  RNA secondary structure sequence
gggtccggcgagcatcacgc

SEQ ID NO: 28300 - DNA, 20 bp, Unknown
  RNA secondary structure sequence
tctgtgtcgagggcaatatt

SEQ ID NO: 28301 - DNA, 20 bp, Unknown
  RNA secondary structure sequence
ctgctttctgctggacgtaa

SEQ ID NO: 28302 - DNA, 20 bp, Unknown
  RNA secondary structure sequence
taaatccaaacattatgata

SEQ ID NO: 28303 - DNA, 20 bp, Unknown
  RNA secondary structure sequence
taaatccatcggccggagac

SEQ ID NO: 28304 - DNA, 20 bp, Unknown
  RNA secondary structure sequence
taagccctccagcggttagg

SEQ ID NO: 28305 - DNA, 20 bp, Unknown
  RNA secondary structure sequence
gtttaagagagtacagggta

SEQ ID NO: 28306 - DNA, 20 bp, Unknown
  RNA secondary structure sequence
caggtccttccccgggccct

SEQ ID NO: 28307 - DNA, 20 bp, Unknown
  RNA secondary structure sequence
ttttagataagttagatgtt

SEQ ID NO: 28308 - DNA, 20 bp, Unknown
  RNA secondary structure sequence
gtaaccgagtgattgcacat

SEQ ID NO: 28309 - DNA, 20 bp, Unknown
  RNA secondary structure sequence
ttcggagatctttactctac

SEQ ID NO: 28310 - DNA, 20 bp, Unknown
  RNA secondary structure sequence
gattctgtctgacgggcagt

SEQ ID NO: 28311 - DNA, 20 bp, Unknown
  RNA secondary structure sequence
ttgaaaagctgacgggcagt

SEQ ID NO: 28312 - DNA, 20 bp, Unknown
  RNA secondary structure sequence
atacaggccaatatcttgtt

SEQ ID NO: 28313 - DNA, 20 bp, Unknown
  RNA secondary structure sequence
atacaggctccctggggaag

SEQ ID NO: 28314 - DNA, 20 bp, Unknown
  RNA secondary structure sequence
tctggcccccaccttcttgg

SEQ ID NO: 28315 - DNA, 20 bp, Unknown
  RNA secondary structure sequence
acagtaccgtgcacatcagc

SEQ ID NO: 28316 - DNA, 20 bp, Unknown
  RNA secondary structure sequence
actcagtattaaggcttgtt

SEQ ID NO: 28317 - DNA, 20 bp, Unknown
  RNA secondary structure sequence
actctggtcctgatacatct

SEQ ID NO: 28318 - DNA, 20 bp, Unknown
  RNA secondary structure sequence
caaagcaagtaaggcttaga

SEQ ID NO: 28319 - DNA, 20 bp, Unknown
  RNA secondary structure sequence
taaaagaagctttgtccgat

SEQ ID NO: 28320 - DNA, 20 bp, Unknown
  RNA secondary structure sequence
cagcggcggcttttgctgca

SEQ ID NO: 28321 - DNA, 20 bp, Unknown
  RNA secondary structure sequence
gttttagagcttttgctgca

SEQ ID NO: 28322 - DNA, 20 bp, Unknown
  RNA secondary structure sequence
acggccgtgggaactcctcc

SEQ ID NO: 28323 - DNA, 20 bp, Unknown
  RNA secondary structure sequence
acggccgtatctcaaggcgt

SEQ ID NO: 28324 - DNA, 20 bp, Unknown
  RNA secondary structure sequence
cgccaaaagggaactcctcc

SEQ ID NO: 28325 - DNA, 20 bp, Unknown
  RNA secondary structure sequence
acacgcccagaggaaccttg

SEQ ID NO: 28326 - DNA, 20 bp, Unknown
  RNA secondary structure sequence
cataccccaaacaatccaaa

SEQ ID NO: 28327 - DNA, 20 bp, Unknown
  RNA secondary structure sequence
gtagagaagaaaattagtgg

SEQ ID NO: 28328 - DNA, 20 bp, Unknown
  RNA secondary structure sequence
gcagtaaagtatgtatatgt

SEQ ID NO: 28329 - DNA, 20 bp, Unknown
  RNA secondary structure sequence
ctctcgtagagggataggtg

SEQ ID NO: 28330 - DNA, 20 bp, Unknown
  RNA secondary structure sequence
ctctcgtatgtttcgcctcc

SEQ ID NO: 28331 - DNA, 20 bp, Unknown
  RNA secondary structure sequence
gaccgcgagccttgtgtgag

SEQ ID NO: 28332 - DNA, 20 bp, Unknown
  RNA secondary structure sequence
ttgtaaacgccttgtgtgag

SEQ ID NO: 28333 - DNA, 20 bp, Unknown
  RNA secondary structure sequence
cggagagcggtgcccgcgtc

SEQ ID NO: 28334 - DNA, 20 bp, Unknown
  RNA secondary structure sequence
gcaccttcccaggtctagca

SEQ ID NO: 28335 - DNA, 20 bp, Unknown
  RNA secondary structure sequence
ccctgtccagctgactgcaa

SEQ ID NO: 28336 - DNA, 20 bp, Unknown
  RNA secondary structure sequence
gggcagttagctgactgcaa

SEQ ID NO: 28337 - DNA, 20 bp, Unknown
  RNA secondary structure sequence
gtctccacctccgcctttgc

SEQ ID NO: 28338 - DNA, 20 bp, Unknown
  RNA secondary structure sequence
cgccgccgccgccgccgccg

SEQ ID NO: 28339 - DNA, 20 bp, Unknown
  RNA secondary structure sequence
tattcgtcccgccgccgccg

SEQ ID NO: 28340 - DNA, 20 bp, Unknown
  RNA secondary structure sequence
agggagctcccgatccgtgc

SEQ ID NO: 28341 - DNA, 20 bp, Unknown
  RNA secondary structure sequence
tacttaaatgcttaacgtag

SEQ ID NO: 28342 - DNA, 20 bp, Unknown
  RNA secondary structure sequence
aatttaaatgcttaacgtag

SEQ ID NO: 28343 - DNA, 20 bp, Unknown
  RNA secondary structure sequence
ttgagattttcacaacttga

SEQ ID NO: 28344 - DNA, 20 bp, Unknown
  RNA secondary structure sequence
gggtcaaacccgcagtaata

SEQ ID NO: 28345 - DNA, 20 bp, Unknown
  RNA secondary structure sequence
aagaagcgaggttcttttta

SEQ ID NO: 28346 - DNA, 20 bp, Unknown
  RNA secondary structure sequence
tacctcaatgcttaacacag

SEQ ID NO: 28347 - DNA, 20 bp, Unknown
  RNA secondary structure sequence
aagaatgcgggctgtatggc

SEQ ID NO: 28348 - DNA, 20 bp, Unknown
  RNA secondary structure sequence
cccctgttcctggaggcaag

SEQ ID NO: 28349 - DNA, 20 bp, Unknown
  RNA secondary structure sequence
ctcagaccgaccccacggag

SEQ ID NO: 28350 - DNA, 20 bp, Unknown
  RNA secondary structure sequence
cagtgagcgttcccaaaggg

SEQ ID NO: 28351 - DNA, 20 bp, Unknown
  RNA secondary structure sequence
tataatatcgacgcgttata

SEQ ID NO: 28352 - DNA, 20 bp, Unknown
  RNA secondary structure sequence
tataatatttttaatactgc

SEQ ID NO: 28353 - DNA, 20 bp, Unknown
  RNA secondary structure sequence
gcattaggttttaatactgc

SEQ ID NO: 28354 - DNA, 20 bp, Unknown
  RNA secondary structure sequence
ccgtacctaaggaagtagtg

SEQ ID NO: 28355 - DNA, 20 bp, Unknown
  RNA secondary structure sequence
ttaataagaaggaagtagtg

SEQ ID NO: 28356 - DNA, 20 bp, Unknown
  RNA secondary structure sequence
gtataaaatctgcaagtagt

SEQ ID NO: 28357 - DNA, 20 bp, Unknown
  RNA secondary structure sequence
gagcctccttctttcctgcc

SEQ ID NO: 28358 - DNA, 20 bp, Unknown
  RNA secondary structure sequence
acttattgtgttggagtgtc

SEQ ID NO: 28359 - DNA, 20 bp, Unknown
  RNA secondary structure sequence
caccacagttctggaggctg

SEQ ID NO: 28360 - DNA, 20 bp, Unknown
  RNA secondary structure sequence
tgtggagtttctggaggctg

SEQ ID NO: 28361 - DNA, 20 bp, Unknown
  RNA secondary structure sequence
gggaggagaaggcggcagcg

SEQ ID NO: 28362 - DNA, 20 bp, Unknown
  RNA secondary structure sequence
gggaggaggccatacgccat

SEQ ID NO: 28363 - DNA, 20 bp, Unknown
  RNA secondary structure sequence
gagggaggccacccatcaag

SEQ ID NO: 28364 - DNA, 20 bp, Unknown
  RNA secondary structure sequence
ggaagatggaaccaatcgca

SEQ ID NO: 28365 - DNA, 20 bp, Unknown
  RNA secondary structure sequence
gggccagccttgaactcgct

SEQ ID NO: 28366 - DNA, 20 bp, Unknown
  RNA secondary structure sequence
tggagagcctcttaaccgga

SEQ ID NO: 28367 - DNA, 20 bp, Unknown
  RNA secondary structure sequence
cccctctgctcttaaccgga

SEQ ID NO: 28368 - DNA, 20 bp, Unknown
  RNA secondary structure sequence
cgaggggtcccttcgcctgg

SEQ ID NO: 28369 - DNA, 20 bp, Unknown
  RNA secondary structure sequence
aacgttgcgtattgctacaa

SEQ ID NO: 28370 - DNA, 20 bp, Unknown
  RNA secondary structure sequence
aaattcttaattccattctt

SEQ ID NO: 28371 - DNA, 20 bp, Unknown
  RNA secondary structure sequence
tctccggtcatctactttgg

SEQ ID NO: 28372 - DNA, 20 bp, Unknown
  RNA secondary structure sequence
cggtgaacagctcctacccc

SEQ ID NO: 28373 - DNA, 20 bp, Unknown
  RNA secondary structure sequence
gaagaagagctgaggtttgc

SEQ ID NO: 28374 - DNA, 20 bp, Unknown
  RNA secondary structure sequence
cgccattcgagcatctagtt

SEQ ID NO: 28375 - DNA, 20 bp, Unknown
  RNA secondary structure sequence
gataggcgtctttatatagg

SEQ ID NO: 28376 - DNA, 20 bp, Unknown
  RNA secondary structure sequence
aattcctgagtgaacgaaca

SEQ ID NO: 28377 - DNA, 20 bp, Unknown
  RNA secondary structure sequence
catgctacaggctgttgctg

SEQ ID NO: 28378 - DNA, 20 bp, Unknown
  RNA secondary structure sequence
agcaattcgccagttgttgc

SEQ ID NO: 28379 - DNA, 20 bp, Unknown
  RNA secondary structure sequence
agttacatccatgccctaca

SEQ ID NO: 28380 - DNA, 20 bp, Unknown
  RNA secondary structure sequence
cgcttcactgtccctggact

SEQ ID NO: 28381 - DNA, 20 bp, Unknown
  RNA secondary structure sequence
ggcaggctggctgggtaccg

SEQ ID NO: 28382 - DNA, 20 bp, Unknown
  RNA secondary structure sequence
ggcaggctggctgggtgggt

SEQ ID NO: 28383 - DNA, 20 bp, Unknown
  RNA secondary structure sequence
ccagctaaggctgggtaccg

SEQ ID NO: 28384 - DNA, 20 bp, Unknown
  RNA secondary structure sequence
tttatatttgtatgtcttat

SEQ ID NO: 28385 - DNA, 20 bp, Unknown
  RNA secondary structure sequence
aaatgctagattttacttta

SEQ ID NO: 28386 - DNA, 20 bp, Unknown
  RNA secondary structure sequence
gctatccactgcatcatctc

SEQ ID NO: 28387 - DNA, 20 bp, Unknown
  RNA secondary structure sequence
ttaccattctgcatcatctc

SEQ ID NO: 28388 - DNA, 20 bp, Unknown
  RNA secondary structure sequence
gagtgattacctggggcgct

SEQ ID NO: 28389 - DNA, 20 bp, Unknown
  RNA secondary structure sequence
gagtgatttttaaaacttac

SEQ ID NO: 28390 - DNA, 20 bp, Unknown
  RNA secondary structure sequence
agaatccatttaaaacttac

SEQ ID NO: 28391 - DNA, 20 bp, Unknown
  RNA secondary structure sequence
tcgcaaccgtttgtttcata

SEQ ID NO: 28392 - DNA, 20 bp, Unknown
  RNA secondary structure sequence
attgccaagtttgtttcata

SEQ ID NO: 28393 - DNA, 20 bp, Unknown
  RNA secondary structure sequence
ggccttgttctgaatgcaca

SEQ ID NO: 28394 - DNA, 20 bp, Unknown
  RNA secondary structure sequence
gtgcttcaatccaatgattg

SEQ ID NO: 28395 - DNA, 20 bp, Unknown
  RNA secondary structure sequence
taatacggaactccatttcc

SEQ ID NO: 28396 - DNA, 20 bp, Unknown
  RNA secondary structure sequence
taatacggggggtgcaacga

SEQ ID NO: 28397 - DNA, 20 bp, Unknown
  RNA secondary structure sequence
agcactaaaactccatttcc

SEQ ID NO: 28398 - DNA, 20 bp, Unknown
  RNA secondary structure sequence
gagctatcaaggacaagaaa

SEQ ID NO: 28399 - DNA, 20 bp, Unknown
  RNA secondary structure sequence
gacctaagctaactcattaa

SEQ ID NO: 28400 - DNA, 20 bp, Unknown
  RNA secondary structure sequence
gagctggtcgctgtcggcta

SEQ ID NO: 28401 - DNA, 20 bp, Unknown
  RNA secondary structure sequence
cttgcaaccgctgtcggcta

SEQ ID NO: 28402 - DNA, 20 bp, Unknown
  RNA secondary structure sequence
gaagcctgcgataggtgagt

SEQ ID NO: 28403 - DNA, 20 bp, Unknown
  RNA secondary structure sequence
tggattccgacccacacgcg

SEQ ID NO: 28404 - DNA, 20 bp, Unknown
  RNA secondary structure sequence
attttattatattttattca

SEQ ID NO: 28405 - DNA, 20 bp, Unknown
  RNA secondary structure sequence
ttctatgaagagatgccttg

SEQ ID NO: 28406 - DNA, 20 bp, Unknown
  RNA secondary structure sequence
ttaatgcatttagtaattta

SEQ ID NO: 28407 - DNA, 20 bp, Unknown
  RNA secondary structure sequence
cagtgccacgttgtgagttg

SEQ ID NO: 28408 - DNA, 20 bp, Unknown
  RNA secondary structure sequence
cagtgccagacatcacaggt

SEQ ID NO: 28409 - DNA, 20 bp, Unknown
  RNA secondary structure sequence
ttgttacccctcgaactcct

SEQ ID NO: 28410 - DNA, 20 bp, Unknown
  RNA secondary structure sequence
cgacatcgaggatggcgcgt

SEQ ID NO: 28411 - DNA, 20 bp, Unknown
  RNA secondary structure sequence
tacttctcaggatggcgcgt

SEQ ID NO: 28412 - DNA, 20 bp, Unknown
  RNA secondary structure sequence
gtgatgtcaattggtcttta

SEQ ID NO: 28413 - DNA, 20 bp, Unknown
  RNA secondary structure sequence
caaggactttacatataagt

SEQ ID NO: 28414 - DNA, 20 bp, Unknown
  RNA secondary structure sequence
ggaaactccccaagggaatc

SEQ ID NO: 28415 - DNA, 20 bp, Unknown
  RNA secondary structure sequence
attgttatcccaagggaatc

SEQ ID NO: 28416 - DNA, 20 bp, Unknown
  RNA secondary structure sequence
atatacacatattggttttt

SEQ ID NO: 28417 - DNA, 20 bp, Unknown
  RNA secondary structure sequence
tagccacgatattggttttt

SEQ ID NO: 28418 - DNA, 20 bp, Unknown
  RNA secondary structure sequence
tcttccaccagaagggcctc

SEQ ID NO: 28419 - DNA, 20 bp, Unknown
  RNA secondary structure sequence
aaggtaggcagaagggcctc

SEQ ID NO: 28420 - DNA, 20 bp, Unknown
  RNA secondary structure sequence
tcttccacgcttctaaagat

SEQ ID NO: 28421 - DNA, 20 bp, Unknown
  RNA secondary structure sequence
ccttctaacagccaggtcat

SEQ ID NO: 28422 - DNA, 20 bp, Unknown
  RNA secondary structure sequence
aaggagcccagccaggtcat

SEQ ID NO: 28423 - DNA, 20 bp, Unknown
  RNA secondary structure sequence
attctttggttttatagcca

SEQ ID NO: 28424 - DNA, 20 bp, Unknown
  RNA secondary structure sequence
gttaccatcctagagacatg

SEQ ID NO: 28425 - DNA, 20 bp, Unknown
  RNA secondary structure sequence
cggcaacaatagctattgga

SEQ ID NO: 28426 - DNA, 20 bp, Unknown
  RNA secondary structure sequence
tagaggactagcaaccgtta

SEQ ID NO: 28427 - DNA, 20 bp, Unknown
  RNA secondary structure sequence
ctgaaggtaccccgcgcgcg

SEQ ID NO: 28428 - DNA, 20 bp, Unknown
  RNA secondary structure sequence
gccaacacggtacacattgt

SEQ ID NO: 28429 - DNA, 20 bp, Unknown
  RNA secondary structure sequence
ccggggtcggctgggacaga

SEQ ID NO: 28430 - DNA, 20 bp, Unknown
  RNA secondary structure sequence
cctacgacggctggtcacta

SEQ ID NO: 28431 - DNA, 20 bp, Unknown
  RNA secondary structure sequence
agataagactgctgtggctg

SEQ ID NO: 28432 - DNA, 20 bp, Unknown
  RNA secondary structure sequence
catgcttctcatgcaacacc

SEQ ID NO: 28433 - DNA, 20 bp, Unknown
  RNA secondary structure sequence
cactctatgattgctcctac

SEQ ID NO: 28434 - DNA, 20 bp, Unknown
  RNA secondary structure sequence
cactctattgcattctactt

SEQ ID NO: 28435 - DNA, 20 bp, Unknown
  RNA secondary structure sequence
gccccgcctctaacctaaca

SEQ ID NO: 28436 - DNA, 20 bp, Unknown
  RNA secondary structure sequence
tcaggcccgagtttgaatac

SEQ ID NO: 28437 - DNA, 20 bp, Unknown
  RNA secondary structure sequence
gtgactatcctccgcctcca

SEQ ID NO: 28438 - DNA, 20 bp, Unknown
  RNA secondary structure sequence
ggcgggctaataatcgaggg

SEQ ID NO: 28439 - DNA, 20 bp, Unknown
  RNA secondary structure sequence
cgaaggcggcccaccacctc

SEQ ID NO: 28440 - DNA, 20 bp, Unknown
  RNA secondary structure sequence
ctgctgctccctaatccgac

SEQ ID NO: 28441 - DNA, 20 bp, Unknown
  RNA secondary structure sequence
caggtcctggagtcccgtaa

SEQ ID NO: 28442 - DNA, 20 bp, Unknown
  RNA secondary structure sequence
ctctgtgtagccgtcccatc

SEQ ID NO: 28443 - DNA, 20 bp, Unknown
  RNA secondary structure sequence
cgcaccacgattggagaata

SEQ ID NO: 28444 - DNA, 20 bp, Unknown
  RNA secondary structure sequence
ttagtagtagatacatctaa

SEQ ID NO: 28445 - DNA, 20 bp, Unknown
  RNA secondary structure sequence
tgtttgctgtcttccattgg

SEQ ID NO: 28446 - DNA, 20 bp, Unknown
  RNA secondary structure sequence
tacaacatccgagtacctat

SEQ ID NO: 28447 - DNA, 20 bp, Unknown
  RNA secondary structure sequence
ccggtattcgcctcgaggcg

SEQ ID NO: 28448 - DNA, 20 bp, Unknown
  RNA secondary structure sequence
tttccgcatcaaggtctcga

SEQ ID NO: 28449 - DNA, 20 bp, Unknown
  RNA secondary structure sequence
ctctgagcttctggcaagta

SEQ ID NO: 28450 - DNA, 20 bp, Unknown
  RNA secondary structure sequence
ctcctggcatgccgtggttc

SEQ ID NO: 28451 - DNA, 20 bp, Unknown
  RNA secondary structure sequence
actgcatggccagcgctagg

SEQ ID NO: 28452 - DNA, 20 bp, Unknown
  RNA secondary structure sequence
cagcggccgcggtggctgag

SEQ ID NO: 28453 - DNA, 20 bp, Unknown
  RNA secondary structure sequence
aaggtcctactgctcacgca

SEQ ID NO: 28454 - DNA, 20 bp, Unknown
  RNA secondary structure sequence
aagtccagataacagccaag

SEQ ID NO: 28455 - DNA, 20 bp, Unknown
  RNA secondary structure sequence
tcttcgtcctgctcgcgctg

SEQ ID NO: 28456 - DNA, 20 bp, Unknown
  RNA secondary structure sequence
tcttcgtcgccgctctctct

SEQ ID NO: 28457 - DNA, 20 bp, Unknown
  RNA secondary structure sequence
ccccggccgtcgcggagcct

SEQ ID NO: 28458 - DNA, 20 bp, Unknown
  RNA secondary structure sequence
tctcttccggctgttcaaga

SEQ ID NO: 28459 - DNA, 20 bp, Unknown
  RNA secondary structure sequence
ctcgcctatttctgggctcg

SEQ ID NO: 28460 - DNA, 20 bp, Unknown
  RNA secondary structure sequence
gcacctgctatagctcttcc

SEQ ID NO: 28461 - DNA, 20 bp, Unknown
  RNA secondary structure sequence
ccgcttctgctaatcaaaac

SEQ ID NO: 28462 - DNA, 20 bp, Unknown
  RNA secondary structure sequence
acaacagagttttcttgaag

SEQ ID NO: 28463 - DNA, 20 bp, Unknown
  RNA secondary structure sequence
acaacagatcacaggattca

SEQ ID NO: 28464 - DNA, 20 bp, Unknown
  RNA secondary structure sequence
gaggttatgttttcttgaag

SEQ ID NO: 28465 - DNA, 20 bp, Unknown
  RNA secondary structure sequence
aacaatacgagcgggtcccc

SEQ ID NO: 28466 - DNA, 20 bp, Unknown
  RNA secondary structure sequence
aggaactccagaccttccta

SEQ ID NO: 28467 - DNA, 20 bp, Unknown
  RNA secondary structure sequence
aggaactcgcttttagagcc

SEQ ID NO: 28468 - DNA, 20 bp, Unknown
  RNA secondary structure sequence
cacggactcagaccttccta

SEQ ID NO: 28469 - DNA, 20 bp, Unknown
  RNA secondary structure sequence
gagggaggaagggatagcca

SEQ ID NO: 28470 - DNA, 20 bp, Unknown
  RNA secondary structure sequence
cagcgcgggaataagcctta

SEQ ID NO: 28471 - DNA, 20 bp, Unknown
  RNA secondary structure sequence
aagctctggaaagcaacgcc

SEQ ID NO: 28472 - DNA, 20 bp, Unknown
  RNA secondary structure sequence
tcatccgcagtgcaatttga

SEQ ID NO: 28473 - DNA, 20 bp, Unknown
  RNA secondary structure sequence
ctccttggggtcggcgtctg

SEQ ID NO: 28474 - DNA, 20 bp, Unknown
  RNA secondary structure sequence
gtacgtgtcgaaactttgcc

SEQ ID NO: 28475 - DNA, 20 bp, Unknown
  RNA secondary structure sequence
cgcatccacgaaactttgcc

SEQ ID NO: 28476 - DNA, 20 bp, Unknown
  RNA secondary structure sequence
tgattctaggctggtcacac

SEQ ID NO: 28477 - DNA, 20 bp, Unknown
  RNA secondary structure sequence
gcgggctgacgcataaacac

SEQ ID NO: 28478 - DNA, 20 bp, Unknown
  RNA secondary structure sequence
atctagtgctcgcgccggct

SEQ ID NO: 28479 - DNA, 20 bp, Unknown
  RNA secondary structure sequence
ctgttgaaggcctaacaacc

SEQ ID NO: 28480 - DNA, 20 bp, Unknown
  RNA secondary structure sequence
gctcgcttggcctaacaacc

SEQ ID NO: 28481 - DNA, 20 bp, Unknown
  RNA secondary structure sequence
ctgttgaacagaatcaggga

SEQ ID NO: 28482 - DNA, 20 bp, Unknown
  RNA secondary structure sequence
ctcggcgctacccaacctac

SEQ ID NO: 28483 - DNA, 20 bp, Unknown
  RNA secondary structure sequence
gcaatgtgagaggcctgcgg

SEQ ID NO: 28484 - DNA, 20 bp, Unknown
  RNA secondary structure sequence
ctcggcgcagaggcctgcgg

SEQ ID NO: 28485 - DNA, 20 bp, Unknown
  RNA secondary structure sequence
gcattgccaacaaggagaag

SEQ ID NO: 28486 - DNA, 20 bp, Unknown
  RNA secondary structure sequence
attggctaaacaaggagaag

SEQ ID NO: 28487 - DNA, 20 bp, Unknown
  RNA secondary structure sequence
atacttacaccttgtcctac

SEQ ID NO: 28488 - DNA, 20 bp, Unknown
  RNA secondary structure sequence
ttcgagagcctctgtcggat

SEQ ID NO: 28489 - DNA, 20 bp, Unknown
  RNA secondary structure sequence
tattgcatacccgtttttaa

SEQ ID NO: 28490 - DNA, 20 bp, Unknown
  RNA secondary structure sequence
tctggctcccaaaaagatgg

SEQ ID NO: 28491 - DNA, 20 bp, Unknown
  RNA secondary structure sequence
ctctcctgaacaaaagatgg

SEQ ID NO: 28492 - DNA, 20 bp, Unknown
  RNA secondary structure sequence
cgattgtgcacgccatgaac

SEQ ID NO: 28493 - DNA, 20 bp, Unknown
  RNA secondary structure sequence
actcactggtaaaggctccg

SEQ ID NO: 28494 - DNA, 20 bp, Unknown
  RNA secondary structure sequence
tggtggcacacgccatgaac

SEQ ID NO: 28495 - DNA, 20 bp, Unknown
  RNA secondary structure sequence
aatggacacaccaaatgtct

SEQ ID NO: 28496 - DNA, 20 bp, Unknown
  RNA secondary structure sequence
gaagcctgactagattctct

SEQ ID NO: 28497 - DNA, 20 bp, Unknown
  RNA secondary structure sequence
gggaaagcctttaacttggc

SEQ ID NO: 28498 - DNA, 20 bp, Unknown
  RNA secondary structure sequence
acagcctgctttaacttggc

SEQ ID NO: 28499 - DNA, 20 bp, Unknown
  RNA secondary structure sequence
agagagtgctctgagcactg

SEQ ID NO: 28500 - DNA, 20 bp, Unknown
  RNA secondary structure sequence
tgggtctgggtgtgagctgt

SEQ ID NO: 28501 - DNA, 20 bp, Unknown
  RNA secondary structure sequence
tttgttttccagtatgtacg

SEQ ID NO: 28502 - DNA, 20 bp, Unknown
  RNA secondary structure sequence
gagcttgtctgagtggaggc

SEQ ID NO: 28503 - DNA, 20 bp, Unknown
  RNA secondary structure sequence
tgaacaagggacaatctaag

SEQ ID NO: 28504 - DNA, 20 bp, Unknown
  RNA secondary structure sequence
ctcgaccacagatgctctga

SEQ ID NO: 28505 - DNA, 20 bp, Unknown
  RNA secondary structure sequence
tggtttagcagatgctctga

SEQ ID NO: 28506 - DNA, 20 bp, Unknown
  RNA secondary structure sequence
attgtggtataaatggaata

SEQ ID NO: 28507 - DNA, 20 bp, Unknown
  RNA secondary structure sequence
gccacataataaatggaata

SEQ ID NO: 28508 - DNA, 20 bp, Unknown
  RNA secondary structure sequence
agcggggcaaacagtgagtg

SEQ ID NO: 28509 - DNA, 20 bp, Unknown
  RNA secondary structure sequence
ttaccctaaaacagtgagtg

SEQ ID NO: 28510 - DNA, 20 bp, Unknown
  RNA secondary structure sequence
gaagaagaaggtgtcaacca

SEQ ID NO: 28511 - DNA, 20 bp, Unknown
  RNA secondary structure sequence
cttgctcaatgccacagcca

SEQ ID NO: 28512 - DNA, 20 bp, Unknown
  RNA secondary structure sequence
gaatattaaatgaaaggaga

SEQ ID NO: 28513 - DNA, 20 bp, Unknown
  RNA secondary structure sequence
ccgtgggcttttctgtttgg

SEQ ID NO: 28514 - DNA, 20 bp, Unknown
  RNA secondary structure sequence
gtgacttctagagctcagtg

SEQ ID NO: 28515 - DNA, 20 bp, Unknown
  RNA secondary structure sequence
acgggtgctgggacaatcgg

SEQ ID NO: 28516 - DNA, 20 bp, Unknown
  RNA secondary structure sequence
aggtgtgaagagcctattga

SEQ ID NO: 28517 - DNA, 20 bp, Unknown
  RNA secondary structure sequence
aggtgtgaccccaggtcgac

SEQ ID NO: 28518 - DNA, 20 bp, Unknown
  RNA secondary structure sequence
tcataaagcgaattggattg

SEQ ID NO: 28519 - DNA, 20 bp, Unknown
  RNA secondary structure sequence
accatatagctattggattg

SEQ ID NO: 28520 - DNA, 20 bp, Unknown
  RNA secondary structure sequence
tccctcggtcgagtcatcat

SEQ ID NO: 28521 - DNA, 20 bp, Unknown
  RNA secondary structure sequence
atcggatataagagtactga

SEQ ID NO: 28522 - DNA, 20 bp, Unknown
  RNA secondary structure sequence
gaaaagagggcctcagacag

SEQ ID NO: 28523 - DNA, 20 bp, Unknown
  RNA secondary structure sequence
agtacaccccaatctcccag

SEQ ID NO: 28524 - DNA, 20 bp, Unknown
  RNA secondary structure sequence
agtacaccgagcggcatgga

SEQ ID NO: 28525 - DNA, 20 bp, Unknown
  RNA secondary structure sequence
ccacgtacggggtgacattg

SEQ ID NO: 28526 - DNA, 20 bp, Unknown
  RNA secondary structure sequence
ggggtctgattcgacgtcat

SEQ ID NO: 28527 - DNA, 20 bp, Unknown
  RNA secondary structure sequence
gtttgcatggatccaagacc

SEQ ID NO: 28528 - DNA, 20 bp, Unknown
  RNA secondary structure sequence
atcatcaactgtttactccc

SEQ ID NO: 28529 - DNA, 20 bp, Unknown
  RNA secondary structure sequence
gagacccaggtcgaggtccg

SEQ ID NO: 28530 - DNA, 20 bp, Unknown
  RNA secondary structure sequence
ccgcaggttgtgtagagtcg

SEQ ID NO: 28531 - DNA, 20 bp, Unknown
  RNA secondary structure sequence
ggttaaaaatagttttaata

SEQ ID NO: 28532 - DNA, 20 bp, Unknown
  RNA secondary structure sequence
cgaatatcgttggagaattc

SEQ ID NO: 28533 - DNA, 20 bp, Unknown
  RNA secondary structure sequence
aggtcccgagaccagtgttt

SEQ ID NO: 28534 - DNA, 20 bp, Unknown
  RNA secondary structure sequence
caagattcgagttgtgaacg

SEQ ID NO: 28535 - DNA, 20 bp, Unknown
  RNA secondary structure sequence
atatctcagggagctggcga

SEQ ID NO: 28536 - DNA, 20 bp, Unknown
  RNA secondary structure sequence
atatctcattttctaacttc

SEQ ID NO: 28537 - DNA, 20 bp, Unknown
  RNA secondary structure sequence
cgtgcatgattgagatagtc

SEQ ID NO: 28538 - DNA, 20 bp, Unknown
  RNA secondary structure sequence
tcagttcagtcgagtggtgg

SEQ ID NO: 28539 - DNA, 20 bp, Unknown
  RNA secondary structure sequence
tcagttcaaatatcgacctc

SEQ ID NO: 28540 - DNA, 20 bp, Unknown
  RNA secondary structure sequence
tttaagctcaaactgcttaa

SEQ ID NO: 28541 - DNA, 20 bp, Unknown
  RNA secondary structure sequence
gcataccctcttttaataaa

SEQ ID NO: 28542 - DNA, 20 bp, Unknown
  RNA secondary structure sequence
gccttctcctataaattcta

SEQ ID NO: 28543 - DNA, 20 bp, Unknown
  RNA secondary structure sequence
taaagaggagccccgccagc

SEQ ID NO: 28544 - DNA, 20 bp, Unknown
  RNA secondary structure sequence
gttctttgggaacgctctcg

SEQ ID NO: 28545 - DNA, 20 bp, Unknown
  RNA secondary structure sequence
ccctggaaggaacgctctcg

SEQ ID NO: 28546 - DNA, 20 bp, Unknown
  RNA secondary structure sequence
actcaacaatttctccaaca

SEQ ID NO: 28547 - DNA, 20 bp, Unknown
  RNA secondary structure sequence
gccctacgtcgggggctccc

SEQ ID NO: 28548 - DNA, 20 bp, Unknown
  RNA secondary structure sequence
tggcacaactggggagtgac

SEQ ID NO: 28549 - DNA, 20 bp, Unknown
  RNA secondary structure sequence
gtctgcagggtactcagcgg

SEQ ID NO: 28550 - DNA, 20 bp, Unknown
  RNA secondary structure sequence
acacgctttagctcgcgttt

SEQ ID NO: 28551 - DNA, 20 bp, Unknown
  RNA secondary structure sequence
ctctatgcccctggattggc

SEQ ID NO: 28552 - DNA, 20 bp, Unknown
  RNA secondary structure sequence
aacggaaaatcccgttgtaa

SEQ ID NO: 28553 - DNA, 20 bp, Unknown
  RNA secondary structure sequence
ggacctggatcatcggccgt

SEQ ID NO: 28554 - DNA, 20 bp, Unknown
  RNA secondary structure sequence
ttccccttagttggcccaga

SEQ ID NO: 28555 - DNA, 20 bp, Unknown
  RNA secondary structure sequence
gggtggggtccctcaagttg

SEQ ID NO: 28556 - DNA, 20 bp, Unknown
  RNA secondary structure sequence
caagggtacattttttttca

SEQ ID NO: 28557 - DNA, 20 bp, Unknown
  RNA secondary structure sequence
aagaccagatcaattaaatg

SEQ ID NO: 28558 - DNA, 20 bp, Unknown
  RNA secondary structure sequence
agaaatgaggacctcagttg

SEQ ID NO: 28559 - DNA, 20 bp, Unknown
  RNA secondary structure sequence
ttgcggcgatgaaatgaaat

SEQ ID NO: 28560 - DNA, 20 bp, Unknown
  RNA secondary structure sequence
tcccagccaatagaaagtga

SEQ ID NO: 28561 - DNA, 20 bp, Unknown
  RNA secondary structure sequence
gcctccctccagcgacggcc

SEQ ID NO: 28562 - DNA, 20 bp, Unknown
  RNA secondary structure sequence
tggacaaagcctacgccggt

SEQ ID NO: 28563 - DNA, 20 bp, Unknown
  RNA secondary structure sequence
ggcggcccgcagcgggataa

SEQ ID NO: 28564 - DNA, 20 bp, Unknown
  RNA secondary structure sequence
taagtgaggcactagaacga

SEQ ID NO: 28565 - DNA, 20 bp, Unknown
  RNA secondary structure sequence
aagccccagcgctctagagc

SEQ ID NO: 28566 - DNA, 20 bp, Unknown
  RNA secondary structure sequence
ggttgtggttctgcatgttt

SEQ ID NO: 28567 - DNA, 20 bp, Unknown
  RNA secondary structure sequence
caattgtgttttacttgtca

SEQ ID NO: 28568 - DNA, 20 bp, Unknown
  RNA secondary structure sequence
caattgtggggccaaaccac

SEQ ID NO: 28569 - DNA, 20 bp, Unknown
  RNA secondary structure sequence
aaaacatccactccctgtaa

SEQ ID NO: 28570 - DNA, 20 bp, Unknown
  RNA secondary structure sequence
tccggtcacactccctgtaa

SEQ ID NO: 28571 - DNA, 20 bp, Unknown
  RNA secondary structure sequence
aatatccccacaagctgttt

SEQ ID NO: 28572 - DNA, 20 bp, Unknown
  RNA secondary structure sequence
cctcggcttgggtaaggcga

SEQ ID NO: 28573 - DNA, 20 bp, Unknown
  RNA secondary structure sequence
ggcacaaatgggtaaggcga

SEQ ID NO: 28574 - DNA, 20 bp, Unknown
  RNA secondary structure sequence
cctcggctgcccgttccacg

SEQ ID NO: 28575 - DNA, 20 bp, Unknown
  RNA secondary structure sequence
tgaaacacacaagaggacca

SEQ ID NO: 28576 - DNA, 20 bp, Unknown
  RNA secondary structure sequence
ccactcaattatgtcataag

SEQ ID NO: 28577 - DNA, 20 bp, Unknown
  RNA secondary structure sequence
aaagaaagcaataaaattaa

SEQ ID NO: 28578 - DNA, 20 bp, Unknown
  RNA secondary structure sequence
ggctgacctgctttgccttg

SEQ ID NO: 28579 - DNA, 20 bp, Unknown
  RNA secondary structure sequence
agacacaagcatacttctgc

SEQ ID NO: 28580 - DNA, 20 bp, Unknown
  RNA secondary structure sequence
catgctttgcatacttctgc

SEQ ID NO: 28581 - DNA, 20 bp, Unknown
  RNA secondary structure sequence
cacaacaccaacagaagacc

SEQ ID NO: 28582 - DNA, 20 bp, Unknown
  RNA secondary structure sequence
gtcacgtggattcttcaggg

SEQ ID NO: 28583 - DNA, 20 bp, Unknown
  RNA secondary structure sequence
ggagcatgatagtaataatt

SEQ ID NO: 28584 - DNA, 20 bp, Unknown
  RNA secondary structure sequence
ttacggagtattttgtccgc

SEQ ID NO: 28585 - DNA, 20 bp, Unknown
  RNA secondary structure sequence
ttaacaaggtcgacagcgcc

SEQ ID NO: 28586 - DNA, 20 bp, Unknown
  RNA secondary structure sequence
cgtcacttcgtttgtaacaa

SEQ ID NO: 28587 - DNA, 20 bp, Unknown
  RNA secondary structure sequence
gtcccatgcgtcctctgccc

SEQ ID NO: 28588 - DNA, 20 bp, Unknown
  RNA secondary structure sequence
gtcccatgatagagagtgaa

SEQ ID NO: 28589 - DNA, 20 bp, Unknown
  RNA secondary structure sequence
aagttcgccgtcctctgccc

SEQ ID NO: 28590 - DNA, 20 bp, Unknown
  RNA secondary structure sequence
gtagtaggcttcagacttga

SEQ ID NO: 28591 - DNA, 20 bp, Unknown
  RNA secondary structure sequence
aaagccactgttgttgttac

SEQ ID NO: 28592 - DNA, 20 bp, Unknown
  RNA secondary structure sequence
ggaaaaggacaagatatttg

SEQ ID NO: 28593 - DNA, 20 bp, Unknown
  RNA secondary structure sequence
ggaaaaggcgccaggcccct

SEQ ID NO: 28594 - DNA, 20 bp, Unknown
  RNA secondary structure sequence
cgggtattctatagccggcg

SEQ ID NO: 28595 - DNA, 20 bp, Unknown
  RNA secondary structure sequence
gccgtttcgtagtgaccggc

SEQ ID NO: 28596 - DNA, 20 bp, Unknown
  RNA secondary structure sequence
tttctttcgtagtgttcttt

SEQ ID NO: 28597 - DNA, 20 bp, Unknown
  RNA secondary structure sequence
agacacctagggatcgtcaa

SEQ ID NO: 28598 - DNA, 20 bp, Unknown
  RNA secondary structure sequence
ccccacctagggattactcc

SEQ ID NO: 28599 - DNA, 20 bp, Unknown
  RNA secondary structure sequence
tggcaaatagggatttcttg

SEQ ID NO: 28600 - DNA, 20 bp, Unknown
  RNA secondary structure sequence
cgggtcctagggatccggcg

SEQ ID NO: 28601 - DNA, 20 bp, Unknown
  RNA secondary structure sequence
aattcctttaggatcgtcaa

SEQ ID NO: 28602 - DNA, 20 bp, Unknown
  RNA secondary structure sequence
gaatcgagaaaagccacgga

SEQ ID NO: 28603 - DNA, 20 bp, Unknown
  RNA secondary structure sequence
aattcctttaaagccgtcaa

SEQ ID NO: 28604 - DNA, 20 bp, Unknown
  RNA secondary structure sequence
ttccggggagaagccacgga

SEQ ID NO: 28605 - DNA, 20 bp, Unknown
  RNA secondary structure sequence
ttccggggagaagccgtcaa

SEQ ID NO: 28606 - DNA, 20 bp, Unknown
  RNA secondary structure sequence
tggcaaagagaagcttcttg

SEQ ID NO: 28607 - DNA, 20 bp, Unknown
  RNA secondary structure sequence
ccccggggagaagctactcc

SEQ ID NO: 28608 - DNA, 20 bp, Unknown
  RNA secondary structure sequence
gaatcgagaaaggacacgga

SEQ ID NO: 28609 - DNA, 20 bp, Unknown
  RNA secondary structure sequence
aattcctttaaggacgtcaa

SEQ ID NO: 28610 - DNA, 20 bp, Unknown
  RNA secondary structure sequence
gccgtctccaaggaaccggc

SEQ ID NO: 28611 - DNA, 20 bp, Unknown
  RNA secondary structure sequence
gaagcctccaaggaagccat

SEQ ID NO: 28612 - DNA, 20 bp, Unknown
  RNA secondary structure sequence
gaagcctccaaggacacgga

SEQ ID NO: 28613 - DNA, 20 bp, Unknown
  RNA secondary structure sequence
cccgcctccaaggatactcc

SEQ ID NO: 28614 - DNA, 20 bp, Unknown
  RNA secondary structure sequence
cccgtggatctagagctgaa

SEQ ID NO: 28615 - DNA, 20 bp, Unknown
  RNA secondary structure sequence
cccgtggatctagatactcc

SEQ ID NO: 28616 - DNA, 20 bp, Unknown
  RNA secondary structure sequence
aattcctttatagacgtcaa

SEQ ID NO: 28617 - DNA, 20 bp, Unknown
  RNA secondary structure sequence
tggcaaaatctagattcttg

SEQ ID NO: 28618 - DNA, 20 bp, Unknown
  RNA secondary structure sequence
cgggtggatctagaccggcg

SEQ ID NO: 28619 - DNA, 20 bp, Unknown
  RNA secondary structure sequence
gccgtgtccctctcaccggc

SEQ ID NO: 28620 - DNA, 20 bp, Unknown
  RNA secondary structure sequence
gaatcgagaatctccacgga

SEQ ID NO: 28621 - DNA, 20 bp, Unknown
  RNA secondary structure sequence
cgggtgtccctctcccggcg

SEQ ID NO: 28622 - DNA, 20 bp, Unknown
  RNA secondary structure sequence
aattcctttatctccgtcaa

SEQ ID NO: 28623 - DNA, 20 bp, Unknown
  RNA secondary structure sequence
cgtaagtccctctccacgga

SEQ ID NO: 28624 - DNA, 20 bp, Unknown
  RNA secondary structure sequence
cgtaagtccctctcttcttg

SEQ ID NO: 28625 - DNA, 20 bp, Unknown
  RNA secondary structure sequence
cccaagtccctctctactcc

SEQ ID NO: 28626 - DNA, 20 bp, Unknown
  RNA secondary structure sequence
tggcaaaccctctcttcttg

SEQ ID NO: 28627 - DNA, 20 bp, Unknown
  RNA secondary structure sequence
gccgtgagacaggaaccggc

SEQ ID NO: 28628 - DNA, 20 bp, Unknown
  RNA secondary structure sequence
tggcaaagacaggattcttg

SEQ ID NO: 28629 - DNA, 20 bp, Unknown
  RNA secondary structure sequence
catgagagacaggattaata

SEQ ID NO: 28630 - DNA, 20 bp, Unknown
  RNA secondary structure sequence
gccgttcaacagaaaccggc

SEQ ID NO: 28631 - DNA, 20 bp, Unknown
  RNA secondary structure sequence
aattcctttaagaacgtcaa

SEQ ID NO: 28632 - DNA, 20 bp, Unknown
  RNA secondary structure sequence
gtagttcaacagaaagcttt

SEQ ID NO: 28633 - DNA, 20 bp, Unknown
  RNA secondary structure sequence
gtagttcaacagaaccggcg

SEQ ID NO: 28634 - DNA, 20 bp, Unknown
  RNA secondary structure sequence
cccgttcaacagaatactcc

SEQ ID NO: 28635 - DNA, 20 bp, Unknown
  RNA secondary structure sequence
gaatcgagaaagaacacgga

SEQ ID NO: 28636 - DNA, 20 bp, Unknown
  RNA secondary structure sequence
cgggttcaacagaaccggcg

SEQ ID NO: 28637 - DNA, 20 bp, Unknown
  RNA secondary structure sequence
tggcaaatccaagtttcttg

SEQ ID NO: 28638 - DNA, 20 bp, Unknown
  RNA secondary structure sequence
ttaacattccaagtttatct

SEQ ID NO: 28639 - DNA, 20 bp, Unknown
  RNA secondary structure sequence
taaatcaggtacagaatttc

SEQ ID NO: 28640 - DNA, 20 bp, Unknown
  RNA secondary structure sequence
cgggtcaggtacagccggcg

SEQ ID NO: 28641 - DNA, 20 bp, Unknown
  RNA secondary structure sequence
aattcctttaacagcgtcaa

SEQ ID NO: 28642 - DNA, 20 bp, Unknown
  RNA secondary structure sequence
aacagacaccatggtgcatc

SEQ ID NO: 28643 - DNA, 20 bp, Unknown
  RNA secondary structure sequence
aattcctttaatagcgtcaa

SEQ ID NO: 28644 - DNA, 20 bp, Unknown
  RNA secondary structure sequence
ttgttaccatatagcgtcaa

SEQ ID NO: 28645 - DNA, 20 bp, Unknown
  RNA secondary structure sequence
gccgtccacatgaaaccggc

SEQ ID NO: 28646 - DNA, 20 bp, Unknown
  RNA secondary structure sequence
cgccgccacatgaaaaagaa

SEQ ID NO: 28647 - DNA, 20 bp, Unknown
  RNA secondary structure sequence
cgccgccacatgaacgtcaa

SEQ ID NO: 28648 - DNA, 20 bp, Unknown
  RNA secondary structure sequence
aattcctttatgaacgtcaa

SEQ ID NO: 28649 - DNA, 20 bp, Unknown
  RNA secondary structure sequence
gaatcgagaacgaacacgga

SEQ ID NO: 28650 - DNA, 20 bp, Unknown
  RNA secondary structure sequence
cgggtatggccgaaccggcg

SEQ ID NO: 28651 - DNA, 20 bp, Unknown
  RNA secondary structure sequence
tagggatggccgaacgtcaa

SEQ ID NO: 28652 - DNA, 20 bp, Unknown
  RNA secondary structure sequence
aattcctttacgaacgtcaa

SEQ ID NO: 28653 - DNA, 20 bp, Unknown
  RNA secondary structure sequence
tggcaaaggccgaattcttg

SEQ ID NO: 28654 - DNA, 20 bp, Unknown
  RNA secondary structure sequence
gaatcgagaacccccacgga

SEQ ID NO: 28655 - DNA, 20 bp, Unknown
  RNA secondary structure sequence
gccgtcccttccccaccggc

SEQ ID NO: 28656 - DNA, 20 bp, Unknown
  RNA secondary structure sequence
aattcctttacccccgtcaa

SEQ ID NO: 28657 - DNA, 20 bp, Unknown
  RNA secondary structure sequence
tcccgcccttccccccggcg

SEQ ID NO: 28658 - DNA, 20 bp, Unknown
  RNA secondary structure sequence
tcccgcccttccccttcccg

SEQ ID NO: 28659 - DNA, 20 bp, Unknown
  RNA secondary structure sequence
ccccgcccttcccctactcc

SEQ ID NO: 28660 - DNA, 20 bp, Unknown
  RNA secondary structure sequence
tggcaaacttccccttcttg

SEQ ID NO: 28661 - DNA, 20 bp, Unknown
  RNA secondary structure sequence
cgggtcccttccccccggcg

SEQ ID NO: 28662 - DNA, 20 bp, Unknown
  RNA secondary structure sequence
gaatcgagaataaccacgga

SEQ ID NO: 28663 - DNA, 20 bp, Unknown
  RNA secondary structure sequence
cggtgtatcttaaccgtcaa

SEQ ID NO: 28664 - DNA, 20 bp, Unknown
  RNA secondary structure sequence
cggtgtatcttaacttcttg

SEQ ID NO: 28665 - DNA, 20 bp, Unknown
  RNA secondary structure sequence
tggcaaatcttaacttcttg

SEQ ID NO: 28666 - DNA, 20 bp, Unknown
  RNA secondary structure sequence
gccgtgcgttgcgtaccggc

SEQ ID NO: 28667 - DNA, 20 bp, Unknown
  RNA secondary structure sequence
gaatcgagaagcgtcacgga

SEQ ID NO: 28668 - DNA, 20 bp, Unknown
  RNA secondary structure sequence
cgggtgcgttgcgtccggcg

SEQ ID NO: 28669 - DNA, 20 bp, Unknown
  RNA secondary structure sequence
aattcctttagcgtcgtcaa

SEQ ID NO: 28670 - DNA, 20 bp, Unknown
  RNA secondary structure sequence
gccgtgcgttgcgtcgtcaa

SEQ ID NO: 28671 - DNA, 20 bp, Unknown
  RNA secondary structure sequence
gccgtgcgttgcgttactcc

SEQ ID NO: 28672 - DNA, 20 bp, Unknown
  RNA secondary structure sequence
gccgtgcgttgcgttccaag

SEQ ID NO: 28673 - DNA, 20 bp, Unknown
  RNA secondary structure sequence
gccgtgaatttttaaccggc

SEQ ID NO: 28674 - DNA, 20 bp, Unknown
  RNA secondary structure sequence
aattcctttatttacgtcaa

SEQ ID NO: 28675 - DNA, 20 bp, Unknown
  RNA secondary structure sequence
gtggagaatttttaaagaag

SEQ ID NO: 28676 - DNA, 20 bp, Unknown
  RNA secondary structure sequence
gtggagaatttttaccggcg

SEQ ID NO: 28677 - DNA, 20 bp, Unknown
  RNA secondary structure sequence
tggcaaaatttttattcttg

SEQ ID NO: 28678 - DNA, 20 bp, Unknown
  RNA secondary structure sequence
gaatcgagaaccaacacgga

SEQ ID NO: 28679 - DNA, 20 bp, Unknown
  RNA secondary structure sequence
cgggtgctgaccaaccggcg

SEQ ID NO: 28680 - DNA, 20 bp, Unknown
  RNA secondary structure sequence
ccaaagctgaccaacgtcaa

SEQ ID NO: 28681 - DNA, 20 bp, Unknown
  RNA secondary structure sequence
cccaagctgaccaatactcc

SEQ ID NO: 28682 - DNA, 20 bp, Unknown
  RNA secondary structure sequence
tggcaaatgaccaattcttg

SEQ ID NO: 28683 - DNA, 20 bp, Unknown
  RNA secondary structure sequence
gctccactcctggtggtgcc

SEQ ID NO: 28684 - DNA, 20 bp, Unknown
  RNA secondary structure sequence
gacggtatctgatcgtcttc

SEQ ID NO: 28685 - DNA, 20 bp, Unknown
  RNA secondary structure sequence
tacagacaccatggtgcatc

SEQ ID NO: 28686 - DNA, 20 bp, Unknown
  RNA secondary structure sequence
gccgtacaccatggaccggc

SEQ ID NO: 28687 - DNA, 20 bp, Unknown
  RNA secondary structure sequence
gccgtacaccatggtgcatc

SEQ ID NO: 28688 - DNA, 20 bp, Unknown
  RNA secondary structure sequence
gaatcgagaaatggcacgga

SEQ ID NO: 28689 - DNA, 20 bp, Unknown
  RNA secondary structure sequence
gaatcgagaaatggtgcatc

SEQ ID NO: 28690 - DNA, 20 bp, Unknown
  RNA secondary structure sequence
agcgagcgaccaaaggaacc

SEQ ID NO: 28691 - DNA, 20 bp, Unknown
  RNA secondary structure sequence
gcgggtcaccatggtgcatc

SEQ ID NO: 28692 - DNA, 20 bp, Unknown
  RNA secondary structure sequence
cgggtacaccatggccggcg

SEQ ID NO: 28693 - DNA, 20 bp, Unknown
  RNA secondary structure sequence
cgggtacaccatggtgcatc

SEQ ID NO: 28694 - DNA, 20 bp, Unknown
  RNA secondary structure sequence
caattcctttatggtgcatc

SEQ ID NO: 28695 - DNA, 20 bp, Unknown
  RNA secondary structure sequence
aattcctttaatggcgtcaa

SEQ ID NO: 28696 - DNA, 20 bp, Unknown
  RNA secondary structure sequence
aattcctttaatggtgcatc

SEQ ID NO: 28697 - DNA, 20 bp, Unknown
  RNA secondary structure sequence
aacaaccggccgtgtgcatc

SEQ ID NO: 28698 - DNA, 20 bp, Unknown
  RNA secondary structure sequence
aacaagcgaccaaaggaacc

SEQ ID NO: 28699 - DNA, 20 bp, Unknown
  RNA secondary structure sequence
aacacacggaatcgagaatc

SEQ ID NO: 28700 - DNA, 20 bp, Unknown
  RNA secondary structure sequence
aacacactcctggtggtgcc

SEQ ID NO: 28701 - DNA, 20 bp, Unknown
  RNA secondary structure sequence
aacacgtgttgagtcaaatt

SEQ ID NO: 28702 - DNA, 20 bp, Unknown
  RNA secondary structure sequence
aacagaaccggccgtgcatc

SEQ ID NO: 28703 - DNA, 20 bp, Unknown
  RNA secondary structure sequence
aacagacaaccaaaggaacc

SEQ ID NO: 28704 - DNA, 20 bp, Unknown
  RNA secondary structure sequence
aacagacacaccatactccc

SEQ ID NO: 28705 - DNA, 20 bp, Unknown
  RNA secondary structure sequence
aacagacacacggaatcgag

SEQ ID NO: 28706 - DNA, 20 bp, Unknown
  RNA secondary structure sequence
aacagacaccaatcgtcttc

SEQ ID NO: 28707 - DNA, 20 bp, Unknown
  RNA secondary structure sequence
aacagacaccacacggaatc

SEQ ID NO: 28708 - DNA, 20 bp, Unknown
  RNA secondary structure sequence
aacagacaccacatactccc

SEQ ID NO: 28709 - DNA, 20 bp, Unknown
  RNA secondary structure sequence
aacagacaccaccggcgggt

SEQ ID NO: 28710 - DNA, 20 bp, Unknown
  RNA secondary structure sequence
aacagacaccaggtggtgcc

SEQ ID NO: 28711 - DNA, 20 bp, Unknown
  RNA secondary structure sequence
aacagacaccatgaccggcc

SEQ ID NO: 28712 - DNA, 20 bp, Unknown
  RNA secondary structure sequence
aacagacaccatgaggaacc

SEQ ID NO: 28713 - DNA, 20 bp, Unknown
  RNA secondary structure sequence
aacagacaccatgcgtcaat

SEQ ID NO: 28714 - DNA, 20 bp, Unknown
  RNA secondary structure sequence
aacagacaccatggaccggc

SEQ ID NO: 28715 - DNA, 20 bp, Unknown
  RNA secondary structure sequence
aacagacaccatggcacgga

SEQ ID NO: 28716 - DNA, 20 bp, Unknown
  RNA secondary structure sequence
aacagacaccatggccggcg

SEQ ID NO: 28717 - DNA, 20 bp, Unknown
  RNA secondary structure sequence
aacagacaccatggcgtcaa

SEQ ID NO: 28718 - DNA, 20 bp, Unknown
  RNA secondary structure sequence
aacagacaccatggggaacc

SEQ ID NO: 28719 - DNA, 20 bp, Unknown
  RNA secondary structure sequence
aacagacaccatggggtgcc

SEQ ID NO: 28720 - DNA, 20 bp, Unknown
  RNA secondary structure sequence
aacagacaccatggtaaatt

SEQ ID NO: 28721 - DNA, 20 bp, Unknown
  RNA secondary structure sequence
aacagacaccatggtactcc

SEQ ID NO: 28722 - DNA, 20 bp, Unknown
  RNA secondary structure sequence
aacagacaccatggtatcgc

SEQ ID NO: 28723 - DNA, 20 bp, Unknown
  RNA secondary structure sequence
aacagacaccatggtcacgg

SEQ ID NO: 28724 - DNA, 20 bp, Unknown
  RNA secondary structure sequence
aacagacaccatggtcgtca

SEQ ID NO: 28725 - DNA, 20 bp, Unknown
  RNA secondary structure sequence
aacagacaccatggtgcaca

SEQ ID NO: 28726 - DNA, 20 bp, Unknown
  RNA secondary structure sequence
aacagacaccatggtgcacg

SEQ ID NO: 28727 - DNA, 20 bp, Unknown
  RNA secondary structure sequence
aacagacaccatggtgcatt

SEQ ID NO: 28728 - DNA, 20 bp, Unknown
  RNA secondary structure sequence
aacagacaccatggtgcgcc

SEQ ID NO: 28729 - DNA, 20 bp, Unknown
  RNA secondary structure sequence
aacagacaccatggtgtgcc

SEQ ID NO: 28730 - DNA, 20 bp, Unknown
  RNA secondary structure sequence
aacagacaccatggtgttct

SEQ ID NO: 28731 - DNA, 20 bp, Unknown
  RNA secondary structure sequence
aacagacaccatggttcttg

SEQ ID NO: 28732 - DNA, 20 bp, Unknown
  RNA secondary structure sequence
aacagacaccatgtactccc

SEQ ID NO: 28733 - DNA, 20 bp, Unknown
  RNA secondary structure sequence
aacagacaccatgtcaaatt

SEQ ID NO: 28734 - DNA, 20 bp, Unknown
  RNA secondary structure sequence
aacagacaccatgtggtgcc

SEQ ID NO: 28735 - DNA, 20 bp, Unknown
  RNA secondary structure sequence
aacagacacgtcaattcctt

SEQ ID NO: 28736 - DNA, 20 bp, Unknown
  RNA secondary structure sequence
aacagacacttcttggcaaa

SEQ ID NO: 28737 - DNA, 20 bp, Unknown
  RNA secondary structure sequence
aacagacatactcccgcatc

SEQ ID NO: 28738 - DNA, 20 bp, Unknown
  RNA secondary structure sequence
aacagaccaaccatactccc

SEQ ID NO: 28739 - DNA, 20 bp, Unknown
  RNA secondary structure sequence
aacagaccggcgggtgcatc

SEQ ID NO: 28740 - DNA, 20 bp, Unknown
  RNA secondary structure sequence
aacagacgtcaattccttta

SEQ ID NO: 28741 - DNA, 20 bp, Unknown
  RNA secondary structure sequence
aacagacgttgagtcaaatt

SEQ ID NO: 28742 - DNA, 20 bp, Unknown
  RNA secondary structure sequence
aacagagcaaccatactccc

SEQ ID NO: 28743 - DNA, 20 bp, Unknown
  RNA secondary structure sequence
aacaggcgaccaaaggaacc

SEQ ID NO: 28744 - DNA, 20 bp, Unknown
  RNA secondary structure sequence
aacattcttggcaaagcatc

SEQ ID NO: 28745 - DNA, 20 bp, Unknown
  RNA secondary structure sequence
aacccgtgttgagtcaaatt

SEQ ID NO: 28746 - DNA, 20 bp, Unknown
  RNA secondary structure sequence
aacgagcgaccaaaggaacc

SEQ ID NO: 28747 - DNA, 20 bp, Unknown
  RNA secondary structure sequence
aacggtatctgatcgtcttc

SEQ ID NO: 28748 - DNA, 20 bp, Unknown
  RNA secondary structure sequence
acacggaatcgagaagcatc

SEQ ID NO: 28749 - DNA, 20 bp, Unknown
  RNA secondary structure sequence
acgtcaattcctttagcatc

SEQ ID NO: 28750 - DNA, 20 bp, Unknown
  RNA secondary structure sequence
agctttgcaaccatactccc

SEQ ID NO: 28751 - DNA, 20 bp, Unknown
  RNA secondary structure sequence
atactcccccatggtgcatc

SEQ ID NO: 28752 - DNA, 20 bp, Unknown
  RNA secondary structure sequence
atcccgtgttgagtcaaatt

SEQ ID NO: 28753 - DNA, 20 bp, Unknown
  RNA secondary structure sequence
ccggccgtccatggtgcatc

SEQ ID NO: 28754 - DNA, 20 bp, Unknown
  RNA secondary structure sequence
ttcttggcaaatggtgcatc

SEQ ID NO: 28755 - DNA, 20 bp, Unknown
  RNA secondary structure sequence
cggcgggtccatggtgcatc

SEQ ID NO: 28756 - DNA, 20 bp, Unknown
  RNA secondary structure sequence
gaattaaccagacaaatcgc

SEQ ID NO: 28757 - DNA, 20 bp, Unknown
  RNA secondary structure sequence
ttggcaaaccatggtgcatc

SEQ ID NO: 28758 - DNA, 20 bp, Unknown
  RNA secondary structure sequence
cccagacaccatggtactcc

SEQ ID NO: 28759 - DNA, 20 bp, Unknown
  RNA secondary structure sequence
cccagacaccatggtgcatc

SEQ ID NO: 28760 - DNA, 20 bp, Unknown
  RNA secondary structure sequence
tggcaaaaccatggtgcatc

SEQ ID NO: 28761 - DNA, 20 bp, Unknown
  RNA secondary structure sequence
tggcaaaaccatggttcttg

SEQ ID NO: 28762 - DNA, 20 bp, Unknown
  RNA secondary structure sequence
ggcaaacaccatggtgcatc

SEQ ID NO: 28763 - DNA, 20 bp, Unknown
  RNA secondary structure sequence
atcgagaaccatggtgcatc

SEQ ID NO: 28764 - DNA, 20 bp, Unknown
  RNA secondary structure sequence
ttcctttaccatggtgcatc

SEQ ID NO: 28765 - DNA, 20 bp, Unknown
  RNA secondary structure sequence
cacagacaccatggtgcatc

SEQ ID NO: 28766 - DNA, 20 bp, Unknown
  RNA secondary structure sequence
gccgtagtctggggaccggc

SEQ ID NO: 28767 - DNA, 20 bp, Unknown
  RNA secondary structure sequence
tcctcagtctgcggcacgga

SEQ ID NO: 28768 - DNA, 20 bp, Unknown
  RNA secondary structure sequence
tcctcagtctgcggcgtcaa

SEQ ID NO: 28769 - DNA, 20 bp, Unknown
  RNA secondary structure sequence
tcctcagtctgcggtactcc

SEQ ID NO: 28770 - DNA, 20 bp, Unknown
  RNA secondary structure sequence
tcctcagtctgcggtgggct

SEQ ID NO: 28771 - DNA, 20 bp, Unknown
  RNA secondary structure sequence
tcctcagtctgcggttcttg

SEQ ID NO: 28772 - DNA, 20 bp, Unknown
  RNA secondary structure sequence
ccctcagtctgcggtactcc

SEQ ID NO: 28773 - DNA, 20 bp, Unknown
  RNA secondary structure sequence
tggcaaatctgcggttcttg

SEQ ID NO: 28774 - DNA, 20 bp, Unknown
  RNA secondary structure sequence
cgggtggaagaaaaccggcg

SEQ ID NO: 28775 - DNA, 20 bp, Unknown
  RNA secondary structure sequence
aaaagggaagaaaatactcc

SEQ ID NO: 28776 - DNA, 20 bp, Unknown
  RNA secondary structure sequence
aaaagggaagaaaattcttg

SEQ ID NO: 28777 - DNA, 20 bp, Unknown
  RNA secondary structure sequence
gaatcgagaaaaaacacgga

SEQ ID NO: 28778 - DNA, 20 bp, Unknown
  RNA secondary structure sequence
tggcaaaaagaaaattcttg

SEQ ID NO: 28779 - DNA, 20 bp, Unknown
  RNA secondary structure sequence
gaatcgagaaaactcacgga

SEQ ID NO: 28780 - DNA, 20 bp, Unknown
  RNA secondary structure sequence
cgggtaatcaaactccggcg

SEQ ID NO: 28781 - DNA, 20 bp, Unknown
  RNA secondary structure sequence
aattcctttaaactcgtcaa

SEQ ID NO: 28782 - DNA, 20 bp, Unknown
  RNA secondary structure sequence
gccgtaatcaaactaccggc

SEQ ID NO: 28783 - DNA, 20 bp, Unknown
  RNA secondary structure sequence
agacaaatcaaactccggcg

SEQ ID NO: 28784 - DNA, 20 bp, Unknown
  RNA secondary structure sequence
agacaaatcaaactcgtcaa

SEQ ID NO: 28785 - DNA, 20 bp, Unknown
  RNA secondary structure sequence
agacaaatcaaacttactcc

SEQ ID NO: 28786 - DNA, 20 bp, Unknown
  RNA secondary structure sequence
tggcaaatcaaactttcttg

SEQ ID NO: 28787 - DNA, 20 bp, Unknown
  RNA secondary structure sequence
gaatcgagaaccctcacgga

SEQ ID NO: 28788 - DNA, 20 bp, Unknown
  RNA secondary structure sequence
cgggtcggttccctccggcg

SEQ ID NO: 28789 - DNA, 20 bp, Unknown
  RNA secondary structure sequence
gtaaccggttccctcacgga

SEQ ID NO: 28790 - DNA, 20 bp, Unknown
  RNA secondary structure sequence
cccaccggttcccttactcc

SEQ ID NO: 28791 - DNA, 20 bp, Unknown
  RNA secondary structure sequence
gccgtcggttccctaccggc

SEQ ID NO: 28792 - DNA, 20 bp, Unknown
  RNA secondary structure sequence
gaatcgagaattcccacgga

SEQ ID NO: 28793 - DNA, 20 bp, Unknown
  RNA secondary structure sequence
gccgtgctgcttccaccggc

SEQ ID NO: 28794 - DNA, 20 bp, Unknown
  RNA secondary structure sequence
gagcggctgcttcccgtcaa

SEQ ID NO: 28795 - DNA, 20 bp, Unknown
  RNA secondary structure sequence
gagcggctgcttcctactcc

SEQ ID NO: 28796 - DNA, 20 bp, Unknown
  RNA secondary structure sequence
ccccggctgcttcctactcc

SEQ ID NO: 28797 - DNA, 20 bp, Unknown
  RNA secondary structure sequence
tggcaaatgcttccttcttg

SEQ ID NO: 28798 - DNA, 20 bp, Unknown
  RNA secondary structure sequence
gccgtcggtccacgaccggc

SEQ ID NO: 28799 - DNA, 20 bp, Unknown
  RNA secondary structure sequence
acgtacggtccacgtactcc

SEQ ID NO: 28800 - DNA, 20 bp, Unknown
  RNA secondary structure sequence
ccctacggtccacgtactcc

SEQ ID NO: 28801 - DNA, 20 bp, Unknown
  RNA secondary structure sequence
tggcaaagtccacgttcttg

SEQ ID NO: 28802 - DNA, 20 bp, Unknown
  RNA secondary structure sequence
catcggcatgccgcaccggc

SEQ ID NO: 28803 - DNA, 20 bp, Unknown
  RNA secondary structure sequence
catcggcatgccgctactcc

SEQ ID NO: 28804 - DNA, 20 bp, Unknown
  RNA secondary structure sequence
cgggtgcatgccgcccggcg

SEQ ID NO: 28805 - DNA, 20 bp, Unknown
  RNA secondary structure sequence
aattcctttaccgccgtcaa

SEQ ID NO: 28806 - DNA, 20 bp, Unknown
  RNA secondary structure sequence
ccccggcatgccgctactcc

SEQ ID NO: 28807 - DNA, 20 bp, Unknown
  RNA secondary structure sequence
gccgtggcgggggaaccggc

SEQ ID NO: 28808 - DNA, 20 bp, Unknown
  RNA secondary structure sequence
gaatcgagaagggacacgga

SEQ ID NO: 28809 - DNA, 20 bp, Unknown
  RNA secondary structure sequence
cccacggcgggggatactcc

SEQ ID NO: 28810 - DNA, 20 bp, Unknown
  RNA secondary structure sequence
aaattaaccagacaaatcgc

SEQ ID NO: 28811 - DNA, 20 bp, Unknown
  RNA secondary structure sequence
actccactcctggtggtgcc

SEQ ID NO: 28812 - DNA, 20 bp, Unknown
  RNA secondary structure sequence
ataacggcaaccatactccc

SEQ ID NO: 28813 - DNA, 20 bp, Unknown
  RNA secondary structure sequence
ataacggcaccaaaggaacc

SEQ ID NO: 28814 - DNA, 20 bp, Unknown
  RNA secondary structure sequence
ataacggcgaccatactccc

SEQ ID NO: 28815 - DNA, 20 bp, Unknown
  RNA secondary structure sequence
ataacggcgggaaaggaacc

SEQ ID NO: 28816 - DNA, 20 bp, Unknown
  RNA secondary structure sequence
ataacggcgggacaaatcgc

SEQ ID NO: 28817 - DNA, 20 bp, Unknown
  RNA secondary structure sequence
ataacggcgggcatactccc

SEQ ID NO: 28818 - DNA, 20 bp, Unknown
  RNA secondary structure sequence
ataacggcggggaaggaacc

SEQ ID NO: 28819 - DNA, 20 bp, Unknown
  RNA secondary structure sequence
ataacggcggggcaaatcgc

SEQ ID NO: 28820 - DNA, 20 bp, Unknown
  RNA secondary structure sequence
ataacggcgggggaactccc

SEQ ID NO: 28821 - DNA, 20 bp, Unknown
  RNA secondary structure sequence
ataacggcgggggacaaatt

SEQ ID NO: 28822 - DNA, 20 bp, Unknown
  RNA secondary structure sequence
ataacggcgggggaccggcg

SEQ ID NO: 28823 - DNA, 20 bp, Unknown
  RNA secondary structure sequence
ataacggcgggggagatcgc

SEQ ID NO: 28824 - DNA, 20 bp, Unknown
  RNA secondary structure sequence
ataacggcgggggaggccgc

SEQ ID NO: 28825 - DNA, 20 bp, Unknown
  RNA secondary structure sequence
ataacggcgggggaggccgt

SEQ ID NO: 28826 - DNA, 20 bp, Unknown
  RNA secondary structure sequence
ataacggcgggggaggcgcc

SEQ ID NO: 28827 - DNA, 20 bp, Unknown
  RNA secondary structure sequence
ataacggcgggggaggcttc

SEQ ID NO: 28828 - DNA, 20 bp, Unknown
  RNA secondary structure sequence
ataacggcgggggtggtgcc

SEQ ID NO: 28829 - DNA, 20 bp, Unknown
  RNA secondary structure sequence
ataacggcgtgagtcaaatt

SEQ ID NO: 28830 - DNA, 20 bp, Unknown
  RNA secondary structure sequence
ataacgggaccaaaggaacc

SEQ ID NO: 28831 - DNA, 20 bp, Unknown
  RNA secondary structure sequence
ataacgtgttgagtcaaatt

SEQ ID NO: 28832 - DNA, 20 bp, Unknown
  RNA secondary structure sequence
ataactgcaaccatactccc

SEQ ID NO: 28833 - DNA, 20 bp, Unknown
  RNA secondary structure sequence
ataccactcctggtggtgcc

SEQ ID NO: 28834 - DNA, 20 bp, Unknown
  RNA secondary structure sequence
ataccgtgttgagtcaaatt

SEQ ID NO: 28835 - DNA, 20 bp, Unknown
  RNA secondary structure sequence
atagagcgaccaaaggaacc

SEQ ID NO: 28836 - DNA, 20 bp, Unknown
  RNA secondary structure sequence
atcgagcgaccaaaggaacc

SEQ ID NO: 28837 - DNA, 20 bp, Unknown
  RNA secondary structure sequence
aattcctttagggacgtcaa

SEQ ID NO: 28838 - DNA, 20 bp, Unknown
  RNA secondary structure sequence
ggctttgcaaccatactccc

SEQ ID NO: 28839 - DNA, 20 bp, Unknown
  RNA secondary structure sequence
gtcgagcgaccaaaggaacc

SEQ ID NO: 28840 - DNA, 20 bp, Unknown
  RNA secondary structure sequence
gtctttgcaaccatactccc

SEQ ID NO: 28841 - DNA, 20 bp, Unknown
  RNA secondary structure sequence
gtgccactcctggtggtgcc

SEQ ID NO: 28842 - DNA, 20 bp, Unknown
  RNA secondary structure sequence
gtgccgtgttgagtcaaatt

SEQ ID NO: 28843 - DNA, 20 bp, Unknown
  RNA secondary structure sequence
gtgttaaccagacaaatcgc

SEQ ID NO: 28844 - DNA, 20 bp, Unknown
  RNA secondary structure sequence
gtgttaatctgatcgtcttc

SEQ ID NO: 28845 - DNA, 20 bp, Unknown
  RNA secondary structure sequence
gtgttacgaccaaaggaacc

SEQ ID NO: 28846 - DNA, 20 bp, Unknown
  RNA secondary structure sequence
gtgttagcaaccatactccc

SEQ ID NO: 28847 - DNA, 20 bp, Unknown
  RNA secondary structure sequence
gtgttagtcagacaaatcgc

SEQ ID NO: 28848 - DNA, 20 bp, Unknown
  RNA secondary structure sequence
gtgttagtcctggtggtgcc

SEQ ID NO: 28849 - DNA, 20 bp, Unknown
  RNA secondary structure sequence
gtgttagttagacaaatcgc

SEQ ID NO: 28850 - DNA, 20 bp, Unknown
  RNA secondary structure sequence
gtgttagttgcaaaggaacc

SEQ ID NO: 28851 - DNA, 20 bp, Unknown
  RNA secondary structure sequence
gtgttagttggacaaatcgc

SEQ ID NO: 28852 - DNA, 20 bp, Unknown
  RNA secondary structure sequence
gtgttagttgtgatactccc

SEQ ID NO: 28853 - DNA, 20 bp, Unknown
  RNA secondary structure sequence
gtgttagttgtggtggtgcc

SEQ ID NO: 28854 - DNA, 20 bp, Unknown
  RNA secondary structure sequence
gtgttagttgtgtaggaacc

SEQ ID NO: 28855 - DNA, 20 bp, Unknown
  RNA secondary structure sequence
gtgttagttgtgtcgtcttc

SEQ ID NO: 28856 - DNA, 20 bp, Unknown
  RNA secondary structure sequence
gtgttagttgtgttaatcgc

SEQ ID NO: 28857 - DNA, 20 bp, Unknown
  RNA secondary structure sequence
gtgttagttgtgttaccggc

SEQ ID NO: 28858 - DNA, 20 bp, Unknown
  RNA secondary structure sequence
gtgttagttgtgttagaacc

SEQ ID NO: 28859 - DNA, 20 bp, Unknown
  RNA secondary structure sequence
gtgttagttgtgttagtatt

SEQ ID NO: 28860 - DNA, 20 bp, Unknown
  RNA secondary structure sequence
gtgttagttgtgttagtccc

SEQ ID NO: 28861 - DNA, 20 bp, Unknown
  RNA secondary structure sequence
gtgttagttgtgttagtgcc

SEQ ID NO: 28862 - DNA, 20 bp, Unknown
  RNA secondary structure sequence
gtgttagttgtgttagttcc

SEQ ID NO: 28863 - DNA, 20 bp, Unknown
  RNA secondary structure sequence
gtgttagttgtgttagttgc

SEQ ID NO: 28864 - DNA, 20 bp, Unknown
  RNA secondary structure sequence
gtgttagttgtgttagttgt

SEQ ID NO: 28865 - DNA, 20 bp, Unknown
  RNA secondary structure sequence
gtgttagttgtgttatcttc

SEQ ID NO: 28866 - DNA, 20 bp, Unknown
  RNA secondary structure sequence
gtgttagttgtgttcaaatt

SEQ ID NO: 28867 - DNA, 20 bp, Unknown
  RNA secondary structure sequence
gtgttagttgtgttccggcg

SEQ ID NO: 28868 - DNA, 20 bp, Unknown
  RNA secondary structure sequence
gtgttagttgtgttggtgcc

SEQ ID NO: 28869 - DNA, 20 bp, Unknown
  RNA secondary structure sequence
gtgttagtttgatcgtcttc

SEQ ID NO: 28870 - DNA, 20 bp, Unknown
  RNA secondary structure sequence
gtgtttatctgatcgtcttc

SEQ ID NO: 28871 - DNA, 20 bp, Unknown
  RNA secondary structure sequence
gaatcgagaatgttcacgga

SEQ ID NO: 28872 - DNA, 20 bp, Unknown
  RNA secondary structure sequence
cccttagttgtgtttactcc

SEQ ID NO: 28873 - DNA, 20 bp, Unknown
  RNA secondary structure sequence
aattcctttatgttcgtcaa

SEQ ID NO: 28874 - DNA, 20 bp, Unknown
  RNA secondary structure sequence
gacatttctgacatttctga

SEQ ID NO: 28875 - DNA, 20 bp, Unknown
  RNA secondary structure sequence
cactatctgctagaccggcg

SEQ ID NO: 28876 - DNA, 20 bp, Unknown
  RNA secondary structure sequence
gaatcgagaatagacacgga

SEQ ID NO: 28877 - DNA, 20 bp, Unknown
  RNA secondary structure sequence
gccgttgctgtggaaccggc

SEQ ID NO: 28878 - DNA, 20 bp, Unknown
  RNA secondary structure sequence
gaatcgagaatggacacgga

SEQ ID NO: 28879 - DNA, 20 bp, Unknown
  RNA secondary structure sequence
cgggttgctgtggaccggcg

SEQ ID NO: 28880 - DNA, 20 bp, Unknown
  RNA secondary structure sequence
ccaagtgctgtggacgtcaa

SEQ ID NO: 28881 - DNA, 20 bp, Unknown
  RNA secondary structure sequence
ccaagtgctgtggactggcc

SEQ ID NO: 28882 - DNA, 20 bp, Unknown
  RNA secondary structure sequence
ccaagtgctgtggattcttg

SEQ ID NO: 28883 - DNA, 20 bp, Unknown
  RNA secondary structure sequence
gccgtttctgacataccggc

SEQ ID NO: 28884 - DNA, 20 bp, Unknown
  RNA secondary structure sequence
gaatcgagaaacatcacgga

SEQ ID NO: 28885 - DNA, 20 bp, Unknown
  RNA secondary structure sequence
gaatcgagaaacatttctga

SEQ ID NO: 28886 - DNA, 20 bp, Unknown
  RNA secondary structure sequence
gacatttctgacatcacgga

SEQ ID NO: 28887 - DNA, 20 bp, Unknown
  RNA secondary structure sequence
cgggtttctgacatccggcg

SEQ ID NO: 28888 - DNA, 20 bp, Unknown
  RNA secondary structure sequence
aattcctttaacatcgtcaa

SEQ ID NO: 28889 - DNA, 20 bp, Unknown
  RNA secondary structure sequence
aattcctttaacatttctga

SEQ ID NO: 28890 - DNA, 20 bp, Unknown
  RNA secondary structure sequence
gacatttctgacatcgtcaa

SEQ ID NO: 28891 - DNA, 20 bp, Unknown
  RNA secondary structure sequence
cccatttctgacattactcc

SEQ ID NO: 28892 - DNA, 20 bp, Unknown
  RNA secondary structure sequence
aacatttctgacatttctga

SEQ ID NO: 28893 - DNA, 20 bp, Unknown
  RNA secondary structure sequence
agaatttctgacatttctga

SEQ ID NO: 28894 - DNA, 20 bp, Unknown
  RNA secondary structure sequence
tttatttctgacatttctga

SEQ ID NO: 28895 - DNA, 20 bp, Unknown
  RNA secondary structure sequence
ccgttttctgacatttctga

SEQ ID NO: 28896 - DNA, 20 bp, Unknown
  RNA secondary structure sequence
gggttttctgacatttctga

SEQ ID NO: 28897 - DNA, 20 bp, Unknown
  RNA secondary structure sequence
gccgtttctgacatttctga

SEQ ID NO: 28898 - DNA, 20 bp, Unknown
  RNA secondary structure sequence
cgggtttctgacatttctga

SEQ ID NO: 28899 - DNA, 20 bp, Unknown
  RNA secondary structure sequence
ggccgttctgacatttctga

SEQ ID NO: 28900 - DNA, 20 bp, Unknown
  RNA secondary structure sequence
cccatttctgacatttctga

SEQ ID NO: 28901 - DNA, 20 bp, Unknown
  RNA secondary structure sequence
gcgggttctgacatttctga

SEQ ID NO: 28902 - DNA, 20 bp, Unknown
  RNA secondary structure sequence
caattcctttacatttctga

SEQ ID NO: 28903 - DNA, 20 bp, Unknown
  RNA secondary structure sequence
ggcaaatctgacatttctga

SEQ ID NO: 28904 - DNA, 20 bp, Unknown
  RNA secondary structure sequence
ccggccgttgacatttctga

SEQ ID NO: 28905 - DNA, 20 bp, Unknown
  RNA secondary structure sequence
cggcgggttgacatttctga

SEQ ID NO: 28906 - DNA, 20 bp, Unknown
  RNA secondary structure sequence
gacaaccggccgttttctga

SEQ ID NO: 28907 - DNA, 20 bp, Unknown
  RNA secondary structure sequence
gacacgtcaattcctttaga

SEQ ID NO: 28908 - DNA, 20 bp, Unknown
  RNA secondary structure sequence
gacatactcctggtggtgcc

SEQ ID NO: 28909 - DNA, 20 bp, Unknown
  RNA secondary structure sequence
gacatgcgaccaaaggaacc

SEQ ID NO: 28910 - DNA, 20 bp, Unknown
  RNA secondary structure sequence
gacattaccagacaaatcgc

SEQ ID NO: 28911 - DNA, 20 bp, Unknown
  RNA secondary structure sequence
gacattaccggccgttctga

SEQ ID NO: 28912 - DNA, 20 bp, Unknown
  RNA secondary structure sequence
gacattcacggaatcgagaa

SEQ ID NO: 28913 - DNA, 20 bp, Unknown
  RNA secondary structure sequence
gacattccggcgggttctga

SEQ ID NO: 28914 - DNA, 20 bp, Unknown
  RNA secondary structure sequence
gacattcgtcaattccttta

SEQ ID NO: 28915 - DNA, 20 bp, Unknown
  RNA secondary structure sequence
gacattcttggcaaatctga

SEQ ID NO: 28916 - DNA, 20 bp, Unknown
  RNA secondary structure sequence
gacatttactccctttctga

SEQ ID NO: 28917 - DNA, 20 bp, Unknown
  RNA secondary structure sequence
gacatttccgtcaattcctt

SEQ ID NO: 28918 - DNA, 20 bp, Unknown
  RNA secondary structure sequence
gacatttctagacaaatcgc

SEQ ID NO: 28919 - DNA, 20 bp, Unknown
  RNA secondary structure sequence
gacatttctccaaaggaacc

SEQ ID NO: 28920 - DNA, 20 bp, Unknown
  RNA secondary structure sequence
gacatttctccggcgggtga

SEQ ID NO: 28921 - DNA, 20 bp, Unknown
  RNA secondary structure sequence
gacatttctgaaccggccgt

SEQ ID NO: 28922 - DNA, 20 bp, Unknown
  RNA secondary structure sequence
gacatttctgaagtcaaatt

SEQ ID NO: 28923 - DNA, 20 bp, Unknown
  RNA secondary structure sequence
gacatttctgacaaccggcc

SEQ ID NO: 28924 - DNA, 20 bp, Unknown
  RNA secondary structure sequence
gacatttctgacacacggaa

SEQ ID NO: 28925 - DNA, 20 bp, Unknown
  RNA secondary structure sequence
gacatttctgacaccggcgg

SEQ ID NO: 28926 - DNA, 20 bp, Unknown
  RNA secondary structure sequence
gacatttctgacacggaatc

SEQ ID NO: 28927 - DNA, 20 bp, Unknown
  RNA secondary structure sequence
gacatttctgacacgtcaat

SEQ ID NO: 28928 - DNA, 20 bp, Unknown
  RNA secondary structure sequence
gacatttctgacataccggc

SEQ ID NO: 28929 - DNA, 20 bp, Unknown
  RNA secondary structure sequence
gacatttctgacatactccc

SEQ ID NO: 28930 - DNA, 20 bp, Unknown
  RNA secondary structure sequence
gacatttctgacatccggcg

SEQ ID NO: 28931 - DNA, 20 bp, Unknown
  RNA secondary structure sequence
gacatttctgacattactcc

SEQ ID NO: 28932 - DNA, 20 bp, Unknown
  RNA secondary structure sequence
gacatttctgacattcacgg

SEQ ID NO: 28933 - DNA, 20 bp, Unknown
  RNA secondary structure sequence
gacatttctgacattctccc

SEQ ID NO: 28934 - DNA, 20 bp, Unknown
  RNA secondary structure sequence
gacatttctgacattgaacc

SEQ ID NO: 28935 - DNA, 20 bp, Unknown
  RNA secondary structure sequence
gacatttctgacatttaccg

SEQ ID NO: 28936 - DNA, 20 bp, Unknown
  RNA secondary structure sequence
gacatttctgacatttactc

SEQ ID NO: 28937 - DNA, 20 bp, Unknown
  RNA secondary structure sequence
gacatttctgacatttcacc

SEQ ID NO: 28938 - DNA, 20 bp, Unknown
  RNA secondary structure sequence
gacatttctgacatttcatt

SEQ ID NO: 28939 - DNA, 20 bp, Unknown
  RNA secondary structure sequence
gacatttctgacatttcgcc

SEQ ID NO: 28940 - DNA, 20 bp, Unknown
  RNA secondary structure sequence
gacatttctgacatttctcc

SEQ ID NO: 28941 - DNA, 20 bp, Unknown
  RNA secondary structure sequence
gacatttctgacatttctcg

SEQ ID NO: 28942 - DNA, 20 bp, Unknown
  RNA secondary structure sequence
gacatttctgacatttctgc

SEQ ID NO: 28943 - DNA, 20 bp, Unknown
  RNA secondary structure sequence
gacatttctgacatttcttc

SEQ ID NO: 28944 - DNA, 20 bp, Unknown
  RNA secondary structure sequence
gacatttctgacatttcttg

SEQ ID NO: 28945 - DNA, 20 bp, Unknown
  RNA secondary structure sequence
gacatttctgacatttcttt

SEQ ID NO: 28946 - DNA, 20 bp, Unknown
  RNA secondary structure sequence
gacatttctgacgtggtgcc

SEQ ID NO: 28947 - DNA, 20 bp, Unknown
  RNA secondary structure sequence
gacatttctgatactcccga

SEQ ID NO: 28948 - DNA, 20 bp, Unknown
  RNA secondary structure sequence
gacatttctgattcttggca

SEQ ID NO: 28949 - DNA, 20 bp, Unknown
  RNA secondary structure sequence
gacatttctgcaaaggaacc

SEQ ID NO: 28950 - DNA, 20 bp, Unknown
  RNA secondary structure sequence
gacatttctttcttggcaaa

SEQ ID NO: 28951 - DNA, 20 bp, Unknown
  RNA secondary structure sequence
gacatttgaccaaaggaacc

SEQ ID NO: 28952 - DNA, 20 bp, Unknown
  RNA secondary structure sequence
gacattttcctggtggtgcc

SEQ ID NO: 28953 - DNA, 20 bp, Unknown
  RNA secondary structure sequence
gacgagcgaccaaaggaacc

SEQ ID NO: 28954 - DNA, 20 bp, Unknown
  RNA secondary structure sequence
gatccactcctggtggtgcc

SEQ ID NO: 28955 - DNA, 20 bp, Unknown
  RNA secondary structure sequence
gcgtcaattcctttatctga

SEQ ID NO: 28956 - DNA, 20 bp, Unknown
  RNA secondary structure sequence
gtactccctgacatttctga

SEQ ID NO: 28957 - DNA, 20 bp, Unknown
  RNA secondary structure sequence
tggcaaactgacatttctga

SEQ ID NO: 28958 - DNA, 20 bp, Unknown
  RNA secondary structure sequence
tggcaaactgacatttcttg

SEQ ID NO: 28959 - DNA, 20 bp, Unknown
  RNA secondary structure sequence
ttggcaaatgacatttctga

SEQ ID NO: 28960 - DNA, 20 bp, Unknown
  RNA secondary structure sequence
atcgagaatgacatttctga

SEQ ID NO: 28961 - DNA, 20 bp, Unknown
  RNA secondary structure sequence
tacatttctgacatttctga

SEQ ID NO: 28962 - DNA, 20 bp, Unknown
  RNA secondary structure sequence
cacatttctgacatttctga

SEQ ID NO: 28963 - DNA, 20 bp, Unknown
  RNA secondary structure sequence
caaatttctgacatttctga

SEQ ID NO: 28964 - DNA, 20 bp, Unknown
  RNA secondary structure sequence
cgagaatctgacatttctga

SEQ ID NO: 28965 - DNA, 20 bp, Unknown
  RNA secondary structure sequence
cctttatctgacatttctga

SEQ ID NO: 28966 - DNA, 20 bp, Unknown
  RNA secondary structure sequence
gaatcgagaaggaacacgga

SEQ ID NO: 28967 - DNA, 20 bp, Unknown
  RNA secondary structure sequence
ccaaatccctggaacacgga

SEQ ID NO: 28968 - DNA, 20 bp, Unknown
  RNA secondary structure sequence
ccaaatccctggaaccggcg

SEQ ID NO: 28969 - DNA, 20 bp, Unknown
  RNA secondary structure sequence
ccaaatccctggaaggagtg

SEQ ID NO: 28970 - DNA, 20 bp, Unknown
  RNA secondary structure sequence
cccaatccctggaatactcc

SEQ ID NO: 28971 - DNA, 20 bp, Unknown
  RNA secondary structure sequence
tggcaaacctggaattcttg

SEQ ID NO: 28972 - DNA, 20 bp, Unknown
  RNA secondary structure sequence
gccgtggcgcacctaccggc

SEQ ID NO: 28973 - DNA, 20 bp, Unknown
  RNA secondary structure sequence
aattcctttaacctcgtcaa

SEQ ID NO: 28974 - DNA, 20 bp, Unknown
  RNA secondary structure sequence
aatcaggcgcacctcgtcaa

SEQ ID NO: 28975 - DNA, 20 bp, Unknown
  RNA secondary structure sequence
aatcaggcgcaccttactcc

SEQ ID NO: 28976 - DNA, 20 bp, Unknown
  RNA secondary structure sequence
ccccaggcgcaccttactcc

SEQ ID NO: 28977 - DNA, 240 bp, Unknown
  18S rRNA complementary sequence
cacctacggaaaccttgttacgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgggaattcctcgttcatggggaataattgcaatcccc

SEQ ID NO: 28978 - DNA, 116 bp, Unknown
  18S rRNA complementary sequence
gggacgccgaccgctcgggggtcgcgtaactagttagcatgccagagtctcgttcgttatcggaattaaccagacaaatcgctccaccaactaagaacggccatgcaccaccaccc

SEQ ID NO: 28979 - DNA, 296 bp, Unknown
  18S rRNA complementary sequence
gtttatggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcaaagtaaacgcttcggg

SEQ ID NO: 28980 - DNA, 80 bp, Unknown
  18S rRNA complementary sequence
agagcatcgagggggcgccgagaggcaaggggcggggacgggcggtggctcgcctcgcggcggaccgcccgcccgctccc

SEQ ID NO: 28981 - DNA, 10 bp, Unknown
  18S rRNA complementary sequence
tacgagcttt

SEQ ID NO: 28982 - DNA, 120 bp, Unknown
  18S rRNA complementary sequence
atacgctattggagctggaattaccgcggctgctggcaccagacttgccctccaatggatcctcgttaaaggatttaaagtggactcattccaattacagggcctcgaaagagtcctgta

SEQ ID NO: 28983 - DNA, 80 bp, Unknown
  18S rRNA complementary sequence
gggggcgtgcgatcggcccgaggttatctagagtcaccaaagccgccggcgcccgccccccggccggggccggagagggg

SEQ ID NO: 28984 - DNA, 203 bp, Homo sapiens; identical to SEQ ID NO: 231

SEQ ID NO: 28985 - DNA, 203 bp, Homo sapiens; identical to SEQ ID NO: 232

SEQ ID NO: 28986 - DNA, 203 bp, Homo sapiens; identical to SEQ ID NO: 241

SEQ ID NO: 28987 - DNA, 203 bp, Homo sapiens; identical to SEQ ID NO: 245

SEQ ID NO: 28988 - DNA, 203 bp, Homo sapiens; identical to SEQ ID NO: 254

SEQ ID NO: 28989 - DNA, 203 bp, Homo sapiens; identical to SEQ ID NO: 256

SEQ ID NO: 28990 - DNA, 203 bp, Homo sapiens; identical to SEQ ID NO: 259

SEQ ID NO: 28991 - DNA, 203 bp, Homo sapiens; identical to SEQ ID NO: 261

SEQ ID NO: 28992 - DNA, 203 bp, Homo sapiens; identical to SEQ ID NO: 265

SEQ ID NO: 28993 - DNA, 203 bp, Homo sapiens; identical to SEQ ID NO: 270

SEQ ID NO: 28994 - DNA, 203 bp, Homo sapiens; identical to SEQ ID NO: 271

SEQ ID NO: 28995 - DNA, 203 bp, Homo sapiens; identical to SEQ ID NO: 272

SEQ ID NO: 28996 - DNA, 203 bp, Homo sapiens; identical to SEQ ID NO: 273

SEQ ID NO: 28997 - DNA, 203 bp, Homo sapiens; identical to SEQ ID NO: 275

SEQ ID NO: 28998 - DNA, 203 bp, Homo sapiens; identical to SEQ ID NO: 276

SEQ ID NO: 28999 - DNA, 203 bp, Homo sapiens; identical to SEQ ID NO: 278

SEQ ID NO: 29000 - DNA, 203 bp, Homo sapiens; identical to SEQ ID NO: 290

SEQ ID NO: 29001 - DNA, 203 bp, Homo sapiens; identical to SEQ ID NO: 293

SEQ ID NO: 29002 - DNA, 203 bp, Homo sapiens; identical to SEQ ID NO: 295

SEQ ID NO: 29003 - DNA, 203 bp, Homo sapiens; identical to SEQ ID NO: 296

SEQ ID NO: 29004 - DNA, 203 bp, Homo sapiens; identical to SEQ ID NO: 297

SEQ ID NO: 29005 - DNA, 203 bp, Homo sapiens; identical to SEQ ID NO: 1

SEQ ID NO: 29006 - DNA, 203 bp, Homo sapiens; identical to SEQ ID NO: 300

SEQ ID NO: 29007 - DNA, 203 bp, Homo sapiens; identical to SEQ ID NO: 305

SEQ ID NO: 29008 - DNA, 203 bp, Homo sapiens; identical to SEQ ID NO: 307

SEQ ID NO: 29009 - DNA, 203 bp, Homo sapiens; identical to SEQ ID NO: 308

SEQ ID NO: 29010 - DNA, 203 bp, Homo sapiens; identical to SEQ ID NO: 314

SEQ ID NO: 29011 - DNA, 203 bp, Homo sapiens; identical to SEQ ID NO: 316

SEQ ID NO: 29012 - DNA, 203 bp, Homo sapiens; identical to SEQ ID NO: 317

SEQ ID NO: 29013 - DNA, 203 bp, Homo sapiens; identical to SEQ ID NO: 321

SEQ ID NO: 29014 - DNA, 203 bp, Homo sapiens; identical to SEQ ID NO: 329

SEQ ID NO: 29015 - DNA, 203 bp, Homo sapiens; identical to SEQ ID NO: 335

SEQ ID NO: 29016 - DNA, 203 bp, Homo sapiens; identical to SEQ ID NO: 339

SEQ ID NO: 29017 - DNA, 203 bp, Homo sapiens; identical to SEQ ID NO: 345

SEQ ID NO: 29018 - DNA, 203 bp, Homo sapiens; identical to SEQ ID NO: 348

SEQ ID NO: 29019 - DNA, 203 bp, Homo sapiens; identical to SEQ ID NO: 353

SEQ ID NO: 29020 - DNA, 203 bp, Homo sapiens; identical to SEQ ID NO: 358

SEQ ID NO: 29021 - DNA, 203 bp, Homo sapiens; identical to SEQ ID NO: 360

SEQ ID NO: 29022 - DNA, 203 bp, Homo sapiens; identical to SEQ ID NO: 363

SEQ ID NO: 29023 - DNA, 203 bp, Homo sapiens; identical to SEQ ID NO: 366

SEQ ID NO: 29024 - DNA, 203 bp, Homo sapiens; identical to SEQ ID NO: 377

SEQ ID NO: 29025 - DNA, 203 bp, Homo sapiens; identical to SEQ ID NO: 378

SEQ ID NO: 29026 - DNA, 203 bp, Homo sapiens; identical to SEQ ID NO: 383

SEQ ID NO: 29027 - DNA, 203 bp, Homo sapiens; identical to SEQ ID NO: 394

SEQ ID NO: 29028 - DNA, 203 bp, Homo sapiens; identical to SEQ ID NO: 404

SEQ ID NO: 29029 - DNA, 203 bp, Homo sapiens; identical to SEQ ID NO: 413

SEQ ID NO: 29030 - DNA, 203 bp, Homo sapiens; identical to SEQ ID NO: 416

SEQ ID NO: 29031 - DNA, 203 bp, Homo sapiens; identical to SEQ ID NO: 417

SEQ ID NO: 29032 - DNA, 203 bp, Homo sapiens; identical to SEQ ID NO: 421

SEQ ID NO: 29033 - DNA, 203 bp, Homo sapiens; identical to SEQ ID NO: 424

SEQ ID NO: 29034 - DNA, 203 bp, Homo sapiens; identical to SEQ ID NO: 429

SEQ ID NO: 29035 - DNA, 203 bp, Homo sapiens; identical to SEQ ID NO: 434

SEQ ID NO: 29036 - DNA, 203 bp, Homo sapiens; identical to SEQ ID NO: 441

SEQ ID NO: 29037 - DNA, 203 bp, Homo sapiens; identical to SEQ ID NO: 443

SEQ ID NO: 29038 - DNA, 203 bp, Homo sapiens; identical to SEQ ID NO: 448

SEQ ID NO: 29039 - DNA, 203 bp, Homo sapiens; identical to SEQ ID NO: 450

SEQ ID NO: 29040 - DNA, 203 bp, Homo sapiens; identical to SEQ ID NO: 454

SEQ ID NO: 29041 - DNA, 203 bp, Homo sapiens; identical to SEQ ID NO: 464

SEQ ID NO: 29042 - DNA, 203 bp, Homo sapiens; identical to SEQ ID NO: 466

SEQ ID NO: 29043 - DNA, 203 bp, Homo sapiens; identical to SEQ ID NO: 468

SEQ ID NO: 29044 - DNA, 203 bp, Homo sapiens; identical to SEQ ID NO: 477

SEQ ID NO: 29045 - DNA, 203 bp, Homo sapiens; identical to SEQ ID NO: 482

SEQ ID NO: 29046 - DNA, 203 bp, Homo sapiens; identical to SEQ ID NO: 485

SEQ ID NO: 29047 - DNA, 203 bp, Homo sapiens; identical to SEQ ID NO: 486

SEQ ID NO: 29048 - DNA, 203 bp, Homo sapiens; identical to SEQ ID NO: 487

SEQ ID NO: 29049 - DNA, 203 bp, Homo sapiens; identical to SEQ ID NO: 492

SEQ ID NO: 29050 - DNA, 203 bp, Homo sapiens; identical to SEQ ID NO: 502

SEQ ID NO: 29051 - DNA, 203 bp, Homo sapiens; identical to SEQ ID NO: 507

SEQ ID NO: 29052 - DNA, 203 bp, Homo sapiens; identical to SEQ ID NO: 508

SEQ ID NO: 29053 - DNA, 203 bp, Homo sapiens; identical to SEQ ID NO: 516

SEQ ID NO: 29054 - DNA, 203 bp, Homo sapiens; identical to SEQ ID NO: 521

SEQ ID NO: 29055 - DNA, 203 bp, Homo sapiens; identical to SEQ ID NO: 522

SEQ ID NO: 29056 - DNA, 203 bp, Homo sapiens; identical to SEQ ID NO: 527

SEQ ID NO: 29057 - DNA, 203 bp, Homo sapiens; identical to SEQ ID NO: 528

SEQ ID NO: 29058 - DNA, 203 bp, Homo sapiens; identical to SEQ ID NO: 533

SEQ ID NO: 29059 - DNA, 203 bp, Homo sapiens; identical to SEQ ID NO: 541

SEQ ID NO: 29060 - DNA, 203 bp, Homo sapiens; identical to SEQ ID NO: 545

SEQ ID NO: 29061 - DNA, 203 bp, Homo sapiens; identical to SEQ ID NO: 549

SEQ ID NO: 29062 - DNA, 203 bp, Homo sapiens; identical to SEQ ID NO: 550

SEQ ID NO: 29063 - DNA, 203 bp, Homo sapiens; identical to SEQ ID NO: 553

SEQ ID NO: 29064 - DNA, 203 bp, Homo sapiens; identical to SEQ ID NO: 559

SEQ ID NO: 29065 - DNA, 203 bp, Homo sapiens; identical to SEQ ID NO: 560

SEQ ID NO: 29066 - DNA, 203 bp, Homo sapiens; identical to SEQ ID NO: 561

SEQ ID NO: 29067 - DNA, 203 bp, Homo sapiens; identical to SEQ ID NO: 572

SEQ ID NO: 29068 - DNA, 203 bp, Homo sapiens; identical to SEQ ID NO: 575

SEQ ID NO: 29069 - DNA, 203 bp, Homo sapiens; identical to SEQ ID NO: 576

SEQ ID NO: 29070 - DNA, 203 bp, Homo sapiens; identical to SEQ ID NO: 581

SEQ ID NO: 29071 - DNA, 203 bp, Homo sapiens; identical to SEQ ID NO: 582

SEQ ID NO: 29072 - DNA, 203 bp, Homo sapiens; identical to SEQ ID NO: 585

SEQ ID NO: 29073 - DNA, 203 bp, Homo sapiens; identical to SEQ ID NO: 587

SEQ ID NO: 29074 - DNA, 203 bp, Homo sapiens; identical to SEQ ID NO: 589

SEQ ID NO: 29075 - DNA, 203 bp, Homo sapiens; identical to SEQ ID NO: 590

SEQ ID NO: 29076 - DNA, 203 bp, Homo sapiens; identical to SEQ ID NO: 594

SEQ ID NO: 29077 - DNA, 203 bp, Homo sapiens; identical to SEQ ID NO: 596

SEQ ID NO: 29078 - DNA, 203 bp, Homo sapiens; identical to SEQ ID NO: 598

SEQ ID NO: 29079 - DNA, 203 bp, Homo sapiens; identical to SEQ ID NO: 606

SEQ ID NO: 29080 - DNA, 203 bp, Homo sapiens; identical to SEQ ID NO: 617

SEQ ID NO: 29081 - DNA, 203 bp, Homo sapiens; identical to SEQ ID NO: 619

SEQ ID NO: 29082 - DNA, 203 bp, Homo sapiens; identical to SEQ ID NO: 624

SEQ ID NO: 29083 - DNA, 203 bp, Homo sapiens; identical to SEQ ID NO: 630

SEQ ID NO: 29084 - DNA, 203 bp, Homo sapiens; identical to SEQ ID NO: 633

SEQ ID NO: 29085 - DNA, 203 bp, Homo sapiens; identical to SEQ ID NO: 634

SEQ ID NO: 29086 - DNA, 203 bp, Homo sapiens; identical to SEQ ID NO: 640

SEQ ID NO: 29087 - DNA, 203 bp, Homo sapiens; identical to SEQ ID NO: 641

SEQ ID NO: 29088 - DNA, 203 bp, Homo sapiens; identical to SEQ ID NO: 655

SEQ ID NO: 29089 - DNA, 203 bp, Homo sapiens; identical to SEQ ID NO: 657

SEQ ID NO: 29090 - DNA, 203 bp, Homo sapiens; identical to SEQ ID NO: 660

SEQ ID NO: 29091 - DNA, 203 bp, Homo sapiens; identical to SEQ ID NO: 664

SEQ ID NO: 29092 - DNA, 203 bp, Homo sapiens; identical to SEQ ID NO: 2

SEQ ID NO: 29093 - DNA, 203 bp, Homo sapiens; identical to SEQ ID NO: 668

SEQ ID NO: 29094 - DNA, 203 bp, Homo sapiens; identical to SEQ ID NO: 669

SEQ ID NO: 29095 - DNA, 203 bp, Homo sapiens; identical to SEQ ID NO: 697

SEQ ID NO: 29096 - DNA, 203 bp, Homo sapiens; identical to SEQ ID NO: 703

SEQ ID NO: 29097 - DNA, 203 bp, Homo sapiens; identical to SEQ ID NO: 704

SEQ ID NO: 29098 - DNA, 203 bp, Homo sapiens; identical to SEQ ID NO: 710

SEQ ID NO: 29099 - DNA, 203 bp, Homo sapiens; identical to SEQ ID NO: 711

SEQ ID NO: 29100 - DNA, 203 bp, Homo sapiens; identical to SEQ ID NO: 713

SEQ ID NO: 29101 - DNA, 203 bp, Homo sapiens; identical to SEQ ID NO: 714

SEQ ID NO: 29102 - DNA, 203 bp, Homo sapiens; identical to SEQ ID NO: 717

SEQ ID NO: 29103 - DNA, 203 bp, Homo sapiens; identical to SEQ ID NO: 726

SEQ ID NO: 29104 - DNA, 203 bp, Homo sapiens; identical to SEQ ID NO: 728

SEQ ID NO: 29105 - DNA, 203 bp, Homo sapiens; identical to SEQ ID NO: 732

SEQ ID NO: 29106 - DNA, 203 bp, Homo sapiens; identical to SEQ ID NO: 736

SEQ ID NO: 29107 - DNA, 203 bp, Homo sapiens; identical to SEQ ID NO: 744

SEQ ID NO: 29108 - DNA, 203 bp, Homo sapiens; identical to SEQ ID NO: 746

SEQ ID NO: 29109 - DNA, 203 bp, Homo sapiens; identical to SEQ ID NO: 749

SEQ ID NO: 29110 - DNA, 203 bp, Homo sapiens; identical to SEQ ID NO: 755

SEQ ID NO: 29111 - DNA, 203 bp, Homo sapiens; identical to SEQ ID NO: 756

SEQ ID NO: 29112 - DNA, 203 bp, Homo sapiens; identical to SEQ ID NO: 771

SEQ ID NO: 29113 - DNA, 203 bp, Homo sapiens; identical to SEQ ID NO: 772

SEQ ID NO: 29114 - DNA, 203 bp, Homo sapiens; identical to SEQ ID NO: 774

SEQ ID NO: 29115 - DNA, 203 bp, Homo sapiens; identical to SEQ ID NO: 783

SEQ ID NO: 29116 - DNA, 203 bp, Homo sapiens; identical to SEQ ID NO: 784

SEQ ID NO: 29117 - DNA, 203 bp, Homo sapiens; identical to SEQ ID NO: 786

SEQ ID NO: 29118 - DNA, 203 bp, Homo sapiens; identical to SEQ ID NO: 794

SEQ ID NO: 29119 - DNA, 203 bp, Homo sapiens; identical to SEQ ID NO: 798

SEQ ID NO: 29120 - DNA, 203 bp, Homo sapiens; identical to SEQ ID NO: 799

SEQ ID NO: 29121 - DNA, 203 bp, Homo sapiens; identical to SEQ ID NO: 815

SEQ ID NO: 29122 - DNA, 203 bp, Homo sapiens; identical to SEQ ID NO: 820

SEQ ID NO: 29123 - DNA, 203 bp, Homo sapiens; identical to SEQ ID NO: 822

SEQ ID NO: 29124 - DNA, 203 bp, Homo sapiens; identical to SEQ ID NO: 824

SEQ ID NO: 29125 - DNA, 203 bp, Homo sapiens; identical to SEQ ID NO: 833

SEQ ID NO: 29126 - DNA, 203 bp, Homo sapiens; identical to SEQ ID NO: 834

SEQ ID NO: 29127 - DNA, 203 bp, Homo sapiens; identical to SEQ ID NO: 835

SEQ ID NO: 29128 - DNA, 203 bp, Homo sapiens; identical to SEQ ID NO: 843

SEQ ID NO: 29129 - DNA, 203 bp, Homo sapiens; identical to SEQ ID NO: 844

SEQ ID NO: 29130 - DNA, 203 bp, Homo sapiens; identical to SEQ ID NO: 849

SEQ ID NO: 29131 - DNA, 203 bp, Homo sapiens; identical to SEQ ID NO: 856

SEQ ID NO: 29132 - DNA, 203 bp, Homo sapiens; identical to SEQ ID NO: 860

SEQ ID NO: 29133 - DNA, 203 bp, Homo sapiens; identical to SEQ ID NO: 861

SEQ ID NO: 29134 - DNA, 203 bp, Homo sapiens; identical to SEQ ID NO: 863

SEQ ID NO: 29135 - DNA, 203 bp, Homo sapiens; identical to SEQ ID NO: 865

SEQ ID NO: 29136 - DNA, 203 bp, Homo sapiens; identical to SEQ ID NO: 866

SEQ ID NO: 29137 - DNA, 203 bp, Homo sapiens; identical to SEQ ID NO: 882

SEQ ID NO: 29138 - DNA, 203 bp, Homo sapiens; identical to SEQ ID NO: 885

SEQ ID NO: 29139 - DNA, 203 bp, Homo sapiens; identical to SEQ ID NO: 886

SEQ ID NO: 29140 - DNA, 203 bp, Homo sapiens; identical to SEQ ID NO: 892

SEQ ID NO: 29141 - DNA, 203 bp, Homo sapiens; identical to SEQ ID NO: 893

SEQ ID NO: 29142 - DNA, 203 bp, Homo sapiens; identical to SEQ ID NO: 894

SEQ ID NO: 29143 - DNA, 203 bp, Homo sapiens; identical to SEQ ID NO: 910

SEQ ID NO: 29144 - DNA, 203 bp, Homo sapiens; identical to SEQ ID NO: 917

SEQ ID NO: 29145 - DNA, 203 bp, Homo sapiens; identical to SEQ ID NO: 924

SEQ ID NO: 29146 - DNA, 203 bp, Homo sapiens; identical to SEQ ID NO: 930

SEQ ID NO: 29147 - DNA, 203 bp, Homo sapiens; identical to SEQ ID NO: 931

SEQ ID NO: 29148 - DNA, 203 bp, Homo sapiens; identical to SEQ ID NO: 934

SEQ ID NO: 29149 - DNA, 203 bp, Homo sapiens; identical to SEQ ID NO: 939

SEQ ID NO: 29150 - DNA, 203 bp, Homo sapiens; identical to SEQ ID NO: 940

SEQ ID NO: 29151 - DNA, 203 bp, Homo sapiens; identical to SEQ ID NO: 942

SEQ ID NO: 29152 - DNA, 203 bp, Homo sapiens; identical to SEQ ID NO: 946

SEQ ID NO: 29153 - DNA, 203 bp, Homo sapiens; identical to SEQ ID NO: 948

SEQ ID NO: 29154 - DNA, 203 bp, Homo sapiens; identical to SEQ ID NO: 952

SEQ ID NO: 29155 - DNA, 203 bp, Homo sapiens; identical to SEQ ID NO: 956

SEQ ID NO: 29156 - DNA, 203 bp, Homo sapiens; identical to SEQ ID NO: 959

SEQ ID NO: 29157 - DNA, 203 bp, Homo sapiens; identical to SEQ ID NO: 979

SEQ ID NO: 29158 - DNA, 203 bp, Homo sapiens; identical to SEQ ID NO: 982

SEQ ID NO: 29159 - DNA, 203 bp, Homo sapiens; identical to SEQ ID NO: 984

SEQ ID NO: 29160 - DNA, 203 bp, Homo sapiens; identical to SEQ ID NO: 986

SEQ ID NO: 29161 - DNA, 203 bp, Homo sapiens; identical to SEQ ID NO: 987

SEQ ID NO: 29162 - DNA, 203 bp, Homo sapiens; identical to SEQ ID NO: 988

SEQ ID NO: 29163 - DNA, 203 bp, Homo sapiens; identical to SEQ ID NO: 990

SEQ ID NO: 29164 - DNA, 203 bp, Homo sapiens; identical to SEQ ID NO: 994

SEQ ID NO: 29165 - DNA, 203 bp, Homo sapiens; identical to SEQ ID NO: 1001

SEQ ID NO: 29166 - DNA, 203 bp, Homo sapiens; identical to SEQ ID NO: 1007

SEQ ID NO: 29167 - DNA, 203 bp, Homo sapiens; identical to SEQ ID NO: 1008

SEQ ID NO: 29168 - DNA, 203 bp, Homo sapiens; identical to SEQ ID NO: 1009

SEQ ID NO: 29169 - DNA, 203 bp, Homo sapiens; identical to SEQ ID NO: 1019

SEQ ID NO: 29170 - DNA, 203 bp, Homo sapiens; identical to SEQ ID NO: 1023

SEQ ID NO: 29171 - DNA, 203 bp, Homo sapiens; identical to SEQ ID NO: 1027

SEQ ID NO: 29172 - DNA, 203 bp, Homo sapiens; identical to SEQ ID NO: 1038

SEQ ID NO: 29173 - DNA, 203 bp, Homo sapiens; identical to SEQ ID NO: 1039

SEQ ID NO: 29174 - DNA, 203 bp, Homo sapiens; identical to SEQ ID NO: 1040

SEQ ID NO: 29175 - DNA, 203 bp, Homo sapiens; identical to SEQ ID NO: 1044

SEQ ID NO: 29176 - DNA, 203 bp, Homo sapiens; identical to SEQ ID NO: 1048

SEQ ID NO: 29177 - DNA, 203 bp, Homo sapiens; identical to SEQ ID NO: 1049

SEQ ID NO: 29178 - DNA, 203 bp, Homo sapiens; identical to SEQ ID NO: 1056

SEQ ID NO: 29179 - DNA, 203 bp, Homo sapiens; identical to SEQ ID NO: 1064

SEQ ID NO: 29180 - DNA, 203 bp, Homo sapiens; identical to SEQ ID NO: 1068

SEQ ID NO: 29181 - DNA, 203 bp, Homo sapiens; identical to SEQ ID NO: 1069

SEQ ID NO: 29182 - DNA, 203 bp, Homo sapiens; identical to SEQ ID NO: 1071

SEQ ID NO: 29183 - DNA, 203 bp, Homo sapiens; identical to SEQ ID NO: 1072

SEQ ID NO: 29184 - DNA, 203 bp, Homo sapiens; identical to SEQ ID NO: 1073

SEQ ID NO: 29185 - DNA, 203 bp, Homo sapiens; identical to SEQ ID NO: 1075

SEQ ID NO: 29186 - DNA, 203 bp, Homo sapiens; identical to SEQ ID NO: 1077

SEQ ID NO: 29187 - DNA, 203 bp, Homo sapiens; identical to SEQ ID NO: 1078

SEQ ID NO: 29188 - DNA, 203 bp, Homo sapiens; identical to SEQ ID NO: 1079

SEQ ID NO: 29189 - DNA, 203 bp, Homo sapiens; identical to SEQ ID NO: 1080

SEQ ID NO: 29190 - DNA, 203 bp, Homo sapiens; identical to SEQ ID NO: 1082

SEQ ID NO: 29191 - DNA, 203 bp, Homo sapiens; identical to SEQ ID NO: 1083

SEQ ID NO: 29192 - DNA, 203 bp, Homo sapiens; identical to SEQ ID NO: 1090

SEQ ID NO: 29193 - DNA, 203 bp, Homo sapiens; identical to SEQ ID NO: 1097

SEQ ID NO: 29194 - DNA, 203 bp, Homo sapiens; identical to SEQ ID NO: 1098

SEQ ID NO: 29195 - DNA, 203 bp, Homo sapiens; identical to SEQ ID NO: 1101

SEQ ID NO: 29196 - DNA, 203 bp, Homo sapiens; identical to SEQ ID NO: 1106

SEQ ID NO: 29197 - DNA, 203 bp, Homo sapiens; identical to SEQ ID NO: 1111

SEQ ID NO: 29198 - DNA, 203 bp, Homo sapiens; identical to SEQ ID NO: 1117

SEQ ID NO: 29199 - DNA, 203 bp, Homo sapiens; identical to SEQ ID NO: 1120

SEQ ID NO: 29200 - DNA, 203 bp, Homo sapiens; identical to SEQ ID NO: 1121

SEQ ID NO: 29201 - DNA, 203 bp, Homo sapiens; identical to SEQ ID NO: 1124

SEQ ID NO: 29202 - DNA, 203 bp, Homo sapiens; identical to SEQ ID NO: 1125

SEQ ID NO: 29203 - DNA, 203 bp, Homo sapiens; identical to SEQ ID NO: 1129

SEQ ID NO: 29204 - DNA, 203 bp, Homo sapiens; identical to SEQ ID NO: 1132

SEQ ID NO: 29205 - DNA, 203 bp, Homo sapiens; identical to SEQ ID NO: 1133

SEQ ID NO: 29206 - DNA, 203 bp, Homo sapiens; identical to SEQ ID NO: 1135

SEQ ID NO: 29207 - DNA, 203 bp, Homo sapiens; identical to SEQ ID NO: 1136

SEQ ID NO: 29208 - DNA, 203 bp, Homo sapiens; identical to SEQ ID NO: 1140

SEQ ID NO: 29209 - DNA, 203 bp, Homo sapiens; identical to SEQ ID NO: 1141

SEQ ID NO: 29210 - DNA, 203 bp, Homo sapiens; identical to SEQ ID NO: 1143

SEQ ID NO: 29211 - DNA, 203 bp, Homo sapiens; identical to SEQ ID NO: 1151

SEQ ID NO: 29212 - DNA, 203 bp, Homo sapiens; identical to SEQ ID NO: 1153

SEQ ID NO: 29213 - DNA, 203 bp, Homo sapiens; identical to SEQ ID NO: 1159

SEQ ID NO: 29214 - DNA, 203 bp, Homo sapiens; identical to SEQ ID NO: 1161

SEQ ID NO: 29215 - DNA, 203 bp, Homo sapiens; identical to SEQ ID NO: 1166

SEQ ID NO: 29216 - DNA, 203 bp, Homo sapiens; identical to SEQ ID NO: 1169

SEQ ID NO: 29217 - DNA, 203 bp, Homo sapiens; identical to SEQ ID NO: 1170

SEQ ID NO: 29218 - DNA, 203 bp, Homo sapiens; identical to SEQ ID NO: 1175

SEQ ID NO: 29219 - DNA, 203 bp, Homo sapiens; identical to SEQ ID NO: 1177

SEQ ID NO: 29220 - DNA, 203 bp, Homo sapiens; identical to SEQ ID NO: 1178

SEQ ID NO: 29221 - DNA, 203 bp, Homo sapiens; identical to SEQ ID NO: 1184

SEQ ID NO: 29222 - DNA, 203 bp, Homo sapiens; identical to SEQ ID NO: 1193

SEQ ID NO: 29223 - DNA, 203 bp, Homo sapiens; identical to SEQ ID NO: 1194

SEQ ID NO: 29224 - DNA, 203 bp, Homo sapiens; identical to SEQ ID NO: 1203

SEQ ID NO: 29225 - DNA, 203 bp, Homo sapiens; identical to SEQ ID NO: 1204

SEQ ID NO: 29226 - DNA, 203 bp, Homo sapiens; identical to SEQ ID NO: 1205

SEQ ID NO: 29227 - DNA, 203 bp, Homo sapiens; identical to SEQ ID NO: 1216

SEQ ID NO: 29228 - DNA, 203 bp, Homo sapiens; identical to SEQ ID NO: 1219

SEQ ID NO: 29229 - DNA, 203 bp, Homo sapiens; identical to SEQ ID NO: 1229

SEQ ID NO: 29230 - DNA, 203 bp, Homo sapiens; identical to SEQ ID NO: 1230

SEQ ID NO: 29231 - DNA, 203 bp, Homo sapiens; identical to SEQ ID NO: 1233

SEQ ID NO: 29232 - DNA, 203 bp, Homo sapiens; identical to SEQ ID NO: 1243

SEQ ID NO: 29233 - DNA, 203 bp, Homo sapiens; identical to SEQ ID NO: 1246

SEQ ID NO: 29234 - DNA, 203 bp, Homo sapiens; identical to SEQ ID NO: 1249

SEQ ID NO: 29235 - DNA, 203 bp, Homo sapiens; identical to SEQ ID NO: 1252

SEQ ID NO: 29236 - DNA, 203 bp, Homo sapiens; identical to SEQ ID NO: 1256

SEQ ID NO: 29237 - DNA, 203 bp, Homo sapiens; identical to SEQ ID NO: 3

SEQ ID NO: 29238 - DNA, 203 bp, Homo sapiens; identical to SEQ ID NO: 1258

SEQ ID NO: 29239 - DNA, 203 bp, Homo sapiens; identical to SEQ ID NO: 4

SEQ ID NO: 29240 - DNA, 203 bp, Homo sapiens; identical to SEQ ID NO: 1262

SEQ ID NO: 29241 - DNA, 203 bp, Homo sapiens; identical to SEQ ID NO: 1264

SEQ ID NO: 29242 - DNA, 203 bp, Homo sapiens; identical to SEQ ID NO: 1265

SEQ ID NO: 29243 - DNA, 203 bp, Homo sapiens; identical to SEQ ID NO: 1276

SEQ ID NO: 29244 - DNA, 203 bp, Homo sapiens; identical to SEQ ID NO: 1278

SEQ ID NO: 29245 - DNA, 203 bp, Homo sapiens; identical to SEQ ID NO: 1283

SEQ ID NO: 29246 - DNA, 203 bp, Homo sapiens; identical to SEQ ID NO: 1286

SEQ ID NO: 29247 - DNA, 203 bp, Homo sapiens; identical to SEQ ID NO: 1287

SEQ ID NO: 29248 - DNA, 203 bp, Homo sapiens; identical to SEQ ID NO: 1288

SEQ ID NO: 29249 - DNA, 203 bp, Homo sapiens; identical to SEQ ID NO: 1292

SEQ ID NO: 29250 - DNA, 203 bp, Homo sapiens; identical to SEQ ID NO: 1307

SEQ ID NO: 29251 - DNA, 203 bp, Homo sapiens; identical to SEQ ID NO: 1309

SEQ ID NO: 29252 - DNA, 203 bp, Homo sapiens; identical to SEQ ID NO: 1310

SEQ ID NO: 29253 - DNA, 203 bp, Homo sapiens; identical to SEQ ID NO: 1312

SEQ ID NO: 29254 - DNA, 203 bp, Homo sapiens; identical to SEQ ID NO: 1319

SEQ ID NO: 29255 - DNA, 203 bp, Homo sapiens; identical to SEQ ID NO: 1320

SEQ ID NO: 29256 - DNA, 203 bp, Homo sapiens; identical to SEQ ID NO: 1322

SEQ ID NO: 29257 - DNA, 203 bp, Homo sapiens; identical to SEQ ID NO: 1325

SEQ ID NO: 29258 - DNA, 203 bp, Homo sapiens; identical to SEQ ID NO: 1328

SEQ ID NO: 29259 - DNA, 203 bp, Homo sapiens; identical to SEQ ID NO: 1329

SEQ ID NO: 29260 - DNA, 203 bp, Homo sapiens; identical to SEQ ID NO: 1330

SEQ ID NO: 29261 - DNA, 203 bp, Homo sapiens; identical to SEQ ID NO: 1339

SEQ ID NO: 29262 - DNA, 203 bp, Homo sapiens; identical to SEQ ID NO: 1355

SEQ ID NO: 29263 - DNA, 203 bp, Homo sapiens; identical to SEQ ID NO: 1358

SEQ ID NO: 29264 - DNA, 203 bp, Homo sapiens; identical to SEQ ID NO: 1361

SEQ ID NO: 29265 - DNA, 203 bp, Homo sapiens; identical to SEQ ID NO: 1362

SEQ ID NO: 29266 - DNA, 203 bp, Homo sapiens; identical to SEQ ID NO: 1366

SEQ ID NO: 29267 - DNA, 203 bp, Homo sapiens; identical to SEQ ID NO: 1369

SEQ ID NO: 29268 - DNA, 203 bp, Homo sapiens; identical to SEQ ID NO: 1372

SEQ ID NO: 29269 - DNA, 203 bp, Homo sapiens; identical to SEQ ID NO: 1375

SEQ ID NO: 29270 - DNA, 203 bp, Homo sapiens; identical to SEQ ID NO: 1376

SEQ ID NO: 29271 - DNA, 203 bp, Homo sapiens; identical to SEQ ID NO: 1379

SEQ ID NO: 29272 - DNA, 203 bp, Homo sapiens; identical to SEQ ID NO: 1384

SEQ ID NO: 29273 - DNA, 203 bp, Homo sapiens; identical to SEQ ID NO: 1387

SEQ ID NO: 29274 - DNA, 203 bp, Homo sapiens; identical to SEQ ID NO: 1388

SEQ ID NO: 29275 - DNA, 203 bp, Homo sapiens; identical to SEQ ID NO: 1389

SEQ ID NO: 29276 - DNA, 203 bp, Homo sapiens; identical to SEQ ID NO: 1390

SEQ ID NO: 29277 - DNA, 203 bp, Homo sapiens; identical to SEQ ID NO: 1394

SEQ ID NO: 29278 - DNA, 203 bp, Homo sapiens; identical to SEQ ID NO: 1395

SEQ ID NO: 29279 - DNA, 203 bp, Homo sapiens; identical to SEQ ID NO: 1399

SEQ ID NO: 29280 - DNA, 203 bp, Homo sapiens; identical to SEQ ID NO: 1401

SEQ ID NO: 29281 - DNA, 203 bp, Homo sapiens; identical to SEQ ID NO: 1403

SEQ ID NO: 29282 - DNA, 203 bp, Homo sapiens; identical to SEQ ID NO: 1405

SEQ ID NO: 29283 - DNA, 203 bp, Homo sapiens; identical to SEQ ID NO: 1409

SEQ ID NO: 29284 - DNA, 203 bp, Homo sapiens; identical to SEQ ID NO: 1410

SEQ ID NO: 29285 - DNA, 203 bp, Homo sapiens; identical to SEQ ID NO: 1413

SEQ ID NO: 29286 - DNA, 203 bp, Homo sapiens; identical to SEQ ID NO: 1415

SEQ ID NO: 29287 - DNA, 203 bp, Homo sapiens; identical to SEQ ID NO: 1417

SEQ ID NO: 29288 - DNA, 203 bp, Homo sapiens; identical to SEQ ID NO: 1424

SEQ ID NO: 29289 - DNA, 203 bp, Homo sapiens; identical to SEQ ID NO: 1431

SEQ ID NO: 29290 - DNA, 203 bp, Homo sapiens; identical to SEQ ID NO: 1432

SEQ ID NO: 29291 - DNA, 203 bp, Homo sapiens; identical to SEQ ID NO: 1438

SEQ ID NO: 29292 - DNA, 203 bp, Homo sapiens; identical to SEQ ID NO: 1444

SEQ ID NO: 29293 - DNA, 203 bp, Homo sapiens; identical to SEQ ID NO: 1458

SEQ ID NO: 29294 - DNA, 203 bp, Homo sapiens; identical to SEQ ID NO: 1459

SEQ ID NO: 29295 - DNA, 203 bp, Homo sapiens; identical to SEQ ID NO: 1460

SEQ ID NO: 29296 - DNA, 203 bp, Homo sapiens; identical to SEQ ID NO: 1464

SEQ ID NO: 29297 - DNA, 203 bp, Homo sapiens; identical to SEQ ID NO: 1467

SEQ ID NO: 29298 - DNA, 203 bp, Homo sapiens; identical to SEQ ID NO: 1469

SEQ ID NO: 29299 - DNA, 203 bp, Homo sapiens; identical to SEQ ID NO: 1474

SEQ ID NO: 29300 - DNA, 203 bp, Homo sapiens; identical to SEQ ID NO: 1476

SEQ ID NO: 29301 - DNA, 203 bp, Homo sapiens; identical to SEQ ID NO: 1478

SEQ ID NO: 29302 - DNA, 203 bp, Homo sapiens; identical to SEQ ID NO: 1480

SEQ ID NO: 29303 - DNA, 203 bp, Homo sapiens; identical to SEQ ID NO: 1481

SEQ ID NO: 29304 - DNA, 203 bp, Homo sapiens; identical to SEQ ID NO: 1485

SEQ ID NO: 29305 - DNA, 203 bp, Homo sapiens; identical to SEQ ID NO: 1493

SEQ ID NO: 29306 - DNA, 203 bp, Homo sapiens; identical to SEQ ID NO: 1497

SEQ ID NO: 29307 - DNA, 203 bp, Homo sapiens; identical to SEQ ID NO: 1499

SEQ ID NO: 29308 - DNA, 203 bp, Homo sapiens; identical to SEQ ID NO: 1502

SEQ ID NO: 29309 - DNA, 203 bp, Homo sapiens; identical to SEQ ID NO: 1506

SEQ ID NO: 29310 - DNA, 203 bp, Homo sapiens; identical to SEQ ID NO: 1525

SEQ ID NO: 29311 - DNA, 203 bp, Homo sapiens; identical to SEQ ID NO: 1527

SEQ ID NO: 29312 - DNA, 203 bp, Homo sapiens; identical to SEQ ID NO: 1530

SEQ ID NO: 29313 - DNA, 203 bp, Homo sapiens; identical to SEQ ID NO: 1535

SEQ ID NO: 29314 - DNA, 203 bp, Homo sapiens; identical to SEQ ID NO: 1538

SEQ ID NO: 29315 - DNA, 203 bp, Homo sapiens; identical to SEQ ID NO: 1541

SEQ ID NO: 29316 - DNA, 203 bp, Homo sapiens; identical to SEQ ID NO: 1551

SEQ ID NO: 29317 - DNA, 203 bp, Homo sapiens; identical to SEQ ID NO: 1555

SEQ ID NO: 29318 - DNA, 203 bp, Homo sapiens; identical to SEQ ID NO: 1558

SEQ ID NO: 29319 - DNA, 203 bp, Homo sapiens; identical to SEQ ID NO: 1562

SEQ ID NO: 29320 - DNA, 203 bp, Homo sapiens; identical to SEQ ID NO: 1568

SEQ ID NO: 29321 - DNA, 203 bp, Homo sapiens; identical to SEQ ID NO: 1570

SEQ ID NO: 29322 - DNA, 203 bp, Homo sapiens; identical to SEQ ID NO: 1576

SEQ ID NO: 29323 - DNA, 203 bp, Homo sapiens; identical to SEQ ID NO: 1577

SEQ ID NO: 29324 - DNA, 203 bp, Homo sapiens; identical to SEQ ID NO: 1579

SEQ ID NO: 29325 - DNA, 203 bp, Homo sapiens; identical to SEQ ID NO: 1589

SEQ ID NO: 29326 - DNA, 203 bp, Homo sapiens; identical to SEQ ID NO: 1590

SEQ ID NO: 29327 - DNA, 203 bp, Homo sapiens; identical to SEQ ID NO: 1591

SEQ ID NO: 29328 - DNA, 203 bp, Homo sapiens; identical to SEQ ID NO: 1596

SEQ ID NO: 29329 - DNA, 203 bp, Homo sapiens; identical to SEQ ID NO: 1597

SEQ ID NO: 29330 - DNA, 203 bp, Homo sapiens; identical to SEQ ID NO: 1600

SEQ ID NO: 29331 - DNA, 203 bp, Homo sapiens; identical to SEQ ID NO: 1602

SEQ ID NO: 29332 - DNA, 203 bp, Homo sapiens; identical to SEQ ID NO: 1610

SEQ ID NO: 29333 - DNA, 203 bp, Homo sapiens; identical to SEQ ID NO: 1612

SEQ ID NO: 29334 - DNA, 203 bp, Homo sapiens; identical to SEQ ID NO: 1616

SEQ ID NO: 29335 - DNA, 203 bp, Homo sapiens; identical to SEQ ID NO: 1618

SEQ ID NO: 29336 - DNA, 203 bp, Homo sapiens; identical to SEQ ID NO: 1620

SEQ ID NO: 29337 - DNA, 203 bp, Homo sapiens; identical to SEQ ID NO: 1621

SEQ ID NO: 29338 - DNA, 203 bp, Homo sapiens; identical to SEQ ID NO: 1637

SEQ ID NO: 29339 - DNA, 203 bp, Homo sapiens; identical to SEQ ID NO: 1640

SEQ ID NO: 29340 - DNA, 203 bp, Homo sapiens; identical to SEQ ID NO: 1641

SEQ ID NO: 29341 - DNA, 203 bp, Homo sapiens; identical to SEQ ID NO: 1645

SEQ ID NO: 29342 - DNA, 203 bp, Homo sapiens; identical to SEQ ID NO: 1646

SEQ ID NO: 29343 - DNA, 203 bp, Homo sapiens; identical to SEQ ID NO: 1647

SEQ ID NO: 29344 - DNA, 203 bp, Homo sapiens; identical to SEQ ID NO: 1650

SEQ ID NO: 29345 - DNA, 203 bp, Homo sapiens; identical to SEQ ID NO: 1655

SEQ ID NO: 29346 - DNA, 203 bp, Homo sapiens; identical to SEQ ID NO: 1656

SEQ ID NO: 29347 - DNA, 203 bp, Homo sapiens; identical to SEQ ID NO: 1657

SEQ ID NO: 29348 - DNA, 203 bp, Homo sapiens; identical to SEQ ID NO: 1659

SEQ ID NO: 29349 - DNA, 203 bp, Homo sapiens; identical to SEQ ID NO: 1660

SEQ ID NO: 29350 - DNA, 203 bp, Homo sapiens; identical to SEQ ID NO: 1661

SEQ ID NO: 29351 - DNA, 203 bp, Homo sapiens; identical to SEQ ID NO: 1665

SEQ ID NO: 29352 - DNA, 203 bp, Homo sapiens; identical to SEQ ID NO: 1670

SEQ ID NO: 29353 - DNA, 203 bp, Homo sapiens; identical to SEQ ID NO: 1673

SEQ ID NO: 29354 - DNA, 203 bp, Homo sapiens; identical to SEQ ID NO: 1676

SEQ ID NO: 29355 - DNA, 203 bp, Homo sapiens; identical to SEQ ID NO: 1683

SEQ ID NO: 29356 - DNA, 203 bp, Homo sapiens; identical to SEQ ID NO: 1695

SEQ ID NO: 29357 - DNA, 203 bp, Homo sapiens; identical to SEQ ID NO: 1697

SEQ ID NO: 29358 - DNA, 203 bp, Homo sapiens; identical to SEQ ID NO: 1700

SEQ ID NO: 29359 - DNA, 203 bp, Homo sapiens; identical to SEQ ID NO: 1701

SEQ ID NO: 29360 - DNA, 203 bp, Homo sapiens; identical to SEQ ID NO: 1704

SEQ ID NO: 29361 - DNA, 203 bp, Homo sapiens; identical to SEQ ID NO: 1707

SEQ ID NO: 29362 - DNA, 203 bp, Homo sapiens; identical to SEQ ID NO: 1709

SEQ ID NO: 29363 - DNA, 203 bp, Homo sapiens; identical to SEQ ID NO: 1710

SEQ ID NO: 29364 - DNA, 203 bp, Homo sapiens; identical to SEQ ID NO: 5

SEQ ID NO: 29365 - DNA, 203 bp, Homo sapiens; identical to SEQ ID NO: 1714

SEQ ID NO: 29366 - DNA, 203 bp, Homo sapiens; identical to SEQ ID NO: 1715

SEQ ID NO: 29367 - DNA, 203 bp, Homo sapiens; identical to SEQ ID NO: 1718

SEQ ID NO: 29368 - DNA, 203 bp, Homo sapiens; identical to SEQ ID NO: 1720

SEQ ID NO: 29369 - DNA, 203 bp, Homo sapiens; identical to SEQ ID NO: 1723

SEQ ID NO: 29370 - DNA, 203 bp, Homo sapiens; identical to SEQ ID NO: 1724

SEQ ID NO: 29371 - DNA, 203 bp, Homo sapiens; identical to SEQ ID NO: 1725

SEQ ID NO: 29372 - DNA, 203 bp, Homo sapiens; identical to SEQ ID NO: 1726

SEQ ID NO: 29373 - DNA, 203 bp, Homo sapiens; identical to SEQ ID NO: 1727

SEQ ID NO: 29374 - DNA, 203 bp, Homo sapiens; identical to SEQ ID NO: 1729

SEQ ID NO: 29375 - DNA, 203 bp, Homo sapiens; identical to SEQ ID NO: 1748

SEQ ID NO: 29376 - DNA, 203 bp, Homo sapiens; identical to SEQ ID NO: 1756

SEQ ID NO: 29377 - DNA, 203 bp, Homo sapiens; identical to SEQ ID NO: 1758

SEQ ID NO: 29378 - DNA, 203 bp, Homo sapiens; identical to SEQ ID NO: 1760

SEQ ID NO: 29379 - DNA, 203 bp, Homo sapiens; identical to SEQ ID NO: 1766

SEQ ID NO: 29380 - DNA, 203 bp, Homo sapiens; identical to SEQ ID NO: 1767

SEQ ID NO: 29381 - DNA, 203 bp, Homo sapiens; identical to SEQ ID NO: 1768

SEQ ID NO: 29382 - DNA, 203 bp, Homo sapiens; identical to SEQ ID NO: 1778

SEQ ID NO: 29383 - DNA, 203 bp, Homo sapiens; identical to SEQ ID NO: 1779

SEQ ID NO: 29384 - DNA, 203 bp, Homo sapiens; identical to SEQ ID NO: 1781

SEQ ID NO: 29385 - DNA, 203 bp, Homo sapiens; identical to SEQ ID NO: 1782

SEQ ID NO: 29386 - DNA, 203 bp, Homo sapiens; identical to SEQ ID NO: 1793

SEQ ID NO: 29387 - DNA, 203 bp, Homo sapiens; identical to SEQ ID NO: 1794

SEQ ID NO: 29388 - DNA, 203 bp, Homo sapiens; identical to SEQ ID NO: 1795

SEQ ID NO: 29389 - DNA, 203 bp, Homo sapiens; identical to SEQ ID NO: 1803

SEQ ID NO: 29390 - DNA, 203 bp, Homo sapiens; identical to SEQ ID NO: 1810

SEQ ID NO: 29391 - DNA, 203 bp, Homo sapiens; identical to SEQ ID NO: 1814

SEQ ID NO: 29392 - DNA, 203 bp, Homo sapiens; identical to SEQ ID NO: 1817

SEQ ID NO: 29393 - DNA, 203 bp, Homo sapiens; identical to SEQ ID NO: 1820

SEQ ID NO: 29394 - DNA, 203 bp, Homo sapiens; identical to SEQ ID NO: 1822

SEQ ID NO: 29395 - DNA, 203 bp, Homo sapiens; identical to SEQ ID NO: 1823

SEQ ID NO: 29396 - DNA, 203 bp, Homo sapiens; identical to SEQ ID NO: 1834

SEQ ID NO: 29397 - DNA, 203 bp, Homo sapiens; identical to SEQ ID NO: 1835

SEQ ID NO: 29398 - DNA, 203 bp, Homo sapiens; identical to SEQ ID NO: 1843

SEQ ID NO: 29399 - DNA, 203 bp, Homo sapiens; identical to SEQ ID NO: 1844

SEQ ID NO: 29400 - DNA, 203 bp, Homo sapiens; identical to SEQ ID NO: 1850

SEQ ID NO: 29401 - DNA, 203 bp, Homo sapiens; identical to SEQ ID NO: 1852

SEQ ID NO: 29402 - DNA, 203 bp, Homo sapiens; identical to SEQ ID NO: 1854

SEQ ID NO: 29403 - DNA, 203 bp, Homo sapiens; identical to SEQ ID NO: 1855

SEQ ID NO: 29404 - DNA, 203 bp, Homo sapiens; identical to SEQ ID NO: 1869

SEQ ID NO: 29405 - DNA, 203 bp, Homo sapiens; identical to SEQ ID NO: 1870

SEQ ID NO: 29406 - DNA, 203 bp, Homo sapiens; identical to SEQ ID NO: 1879

SEQ ID NO: 29407 - DNA, 203 bp, Homo sapiens; identical to SEQ ID NO: 1880

SEQ ID NO: 29408 - DNA, 203 bp, Homo sapiens; identical to SEQ ID NO: 1886

SEQ ID NO: 29409 - DNA, 203 bp, Homo sapiens; identical to SEQ ID NO: 1888

SEQ ID NO: 29410 - DNA, 203 bp, Homo sapiens; identical to SEQ ID NO: 1890

SEQ ID NO: 29411 - DNA, 203 bp, Homo sapiens; identical to SEQ ID NO: 1893

SEQ ID NO: 29412 - DNA, 203 bp, Homo sapiens; identical to SEQ ID NO: 1896

SEQ ID NO: 29413 - DNA, 203 bp, Homo sapiens; identical to SEQ ID NO: 1897

SEQ ID NO: 29414 - DNA, 203 bp, Homo sapiens; identical to SEQ ID NO: 1898

SEQ ID NO: 29415 - DNA, 203 bp, Homo sapiens; identical to SEQ ID NO: 1899

SEQ ID NO: 29416 - DNA, 203 bp, Homo sapiens; identical to SEQ ID NO: 1900

SEQ ID NO: 29417 - DNA, 203 bp, Homo sapiens; identical to SEQ ID NO: 1904

SEQ ID NO: 29418 - DNA, 203 bp, Homo sapiens; identical to SEQ ID NO: 1905

SEQ ID NO: 29419 - DNA, 203 bp, Homo sapiens; identical to SEQ ID NO: 1920

SEQ ID NO: 29420 - DNA, 203 bp, Homo sapiens; identical to SEQ ID NO: 1922

SEQ ID NO: 29421 - DNA, 203 bp, Homo sapiens; identical to SEQ ID NO: 1926

SEQ ID NO: 29422 - DNA, 203 bp, Homo sapiens; identical to SEQ ID NO: 1929

SEQ ID NO: 29423 - DNA, 203 bp, Homo sapiens; identical to SEQ ID NO: 1934

SEQ ID NO: 29424 - DNA, 203 bp, Homo sapiens; identical to SEQ ID NO: 1935

SEQ ID NO: 29425 - DNA, 203 bp, Homo sapiens; identical to SEQ ID NO: 1940

SEQ ID NO: 29426 - DNA, 203 bp, Homo sapiens; identical to SEQ ID NO: 1943

SEQ ID NO: 29427 - DNA, 203 bp, Homo sapiens; identical to SEQ ID NO: 1945

SEQ ID NO: 29428 - DNA, 203 bp, Homo sapiens; identical to SEQ ID NO: 1946

SEQ ID NO: 29429 - DNA, 203 bp, Homo sapiens; identical to SEQ ID NO: 1948

SEQ ID NO: 29430 - DNA, 203 bp, Homo sapiens; identical to SEQ ID NO: 1949

SEQ ID NO: 29431 - DNA, 203 bp, Homo sapiens; identical to SEQ ID NO: 1950

SEQ ID NO: 29432 - DNA, 203 bp, Homo sapiens; identical to SEQ ID NO: 1951

SEQ ID NO: 29433 - DNA, 203 bp, Homo sapiens; identical to SEQ ID NO: 1952

SEQ ID NO: 29434 - DNA, 203 bp, Homo sapiens; identical to SEQ ID NO: 1953

SEQ ID NO: 29435 - DNA, 203 bp, Homo sapiens; identical to SEQ ID NO: 1954

SEQ ID NO: 29436 - DNA, 203 bp, Homo sapiens; identical to SEQ ID NO: 1955

SEQ ID NO: 29437 - DNA, 203 bp, Homo sapiens; identical to SEQ ID NO: 1956

SEQ ID NO: 29438 - DNA, 203 bp, Homo sapiens; identical to SEQ ID NO: 1965

SEQ ID NO: 29439 - DNA, 203 bp, Homo sapiens; identical to SEQ ID NO: 1970

SEQ ID NO: 29440 - DNA, 203 bp, Homo sapiens; identical to SEQ ID NO: 1973

SEQ ID NO: 29441 - DNA, 203 bp, Homo sapiens; identical to SEQ ID NO: 1978

SEQ ID NO: 29442 - DNA, 203 bp, Homo sapiens; identical to SEQ ID NO: 1979

SEQ ID NO: 29443 - DNA, 203 bp, Homo sapiens; identical to SEQ ID NO: 1984

SEQ ID NO: 29444 - DNA, 203 bp, Homo sapiens; identical to SEQ ID NO: 1987

SEQ ID NO: 29445 - DNA, 203 bp, Homo sapiens; identical to SEQ ID NO: 1990

SEQ ID NO: 29446 - DNA, 203 bp, Homo sapiens; identical to SEQ ID NO: 1992

SEQ ID NO: 29447 - DNA, 203 bp, Homo sapiens; identical to SEQ ID NO: 1993

SEQ ID NO: 29448 - DNA, 203 bp, Homo sapiens; identical to SEQ ID NO: 1999

SEQ ID NO: 29449 - DNA, 203 bp, Homo sapiens; identical to SEQ ID NO: 2004

SEQ ID NO: 29450 - DNA, 203 bp, Homo sapiens; identical to SEQ ID NO: 2006

SEQ ID NO: 29451 - DNA, 203 bp, Homo sapiens; identical to SEQ ID NO: 2035

SEQ ID NO: 29452 - DNA, 203 bp, Homo sapiens; identical to SEQ ID NO: 2038

SEQ ID NO: 29453 - DNA, 203 bp, Homo sapiens; identical to SEQ ID NO: 2039

SEQ ID NO: 29454 - DNA, 203 bp, Homo sapiens; identical to SEQ ID NO: 2040

SEQ ID NO: 29455 - DNA, 203 bp, Homo sapiens; identical to SEQ ID NO: 2041

SEQ ID NO: 29456 - DNA, 203 bp, Homo sapiens; identical to SEQ ID NO: 2042

SEQ ID NO: 29457 - DNA, 203 bp, Homo sapiens; identical to SEQ ID NO: 2043

SEQ ID NO: 29458 - DNA, 203 bp, Homo sapiens; identical to SEQ ID NO: 2044

SEQ ID NO: 29459 - DNA, 203 bp, Homo sapiens; identical to SEQ ID NO: 2045

SEQ ID NO: 29460 - DNA, 203 bp, Homo sapiens; identical to SEQ ID NO: 2046

SEQ ID NO: 29461 - DNA, 203 bp, Homo sapiens; identical to SEQ ID NO: 2047

SEQ ID NO: 29462 - DNA, 203 bp, Homo sapiens; identical to SEQ ID NO: 2048

SEQ ID NO: 29463 - DNA, 203 bp, Homo sapiens; identical to SEQ ID NO: 2049

SEQ ID NO: 29464 - DNA, 203 bp, Homo sapiens; identical to SEQ ID NO: 2050

SEQ ID NO: 29465 - DNA, 203 bp, Homo sapiens; identical to SEQ ID NO: 2053

SEQ ID NO: 29466 - DNA, 203 bp, Homo sapiens; identical to SEQ ID NO: 2055

SEQ ID NO: 29467 - DNA, 203 bp, Homo sapiens; identical to SEQ ID NO: 2062

SEQ ID NO: 29468 - DNA, 203 bp, Homo sapiens; identical to SEQ ID NO: 2065

SEQ ID NO: 29469 - DNA, 203 bp, Homo sapiens; identical to SEQ ID NO: 2068

SEQ ID NO: 29470 - DNA, 203 bp, Homo sapiens; identical to SEQ ID NO: 2069

SEQ ID NO: 29471 - DNA, 203 bp, Homo sapiens; identical to SEQ ID NO: 2070

SEQ ID NO: 29472 - DNA, 203 bp, Homo sapiens; identical to SEQ ID NO: 2071

SEQ ID NO: 29473 - DNA, 203 bp, Homo sapiens; identical to SEQ ID NO: 2073

SEQ ID NO: 29474 - DNA, 203 bp, Homo sapiens; identical to SEQ ID NO: 2074

SEQ ID NO: 29475 - DNA, 203 bp, Homo sapiens; identical to SEQ ID NO: 2075

SEQ ID NO: 29476 - DNA, 203 bp, Homo sapiens; identical to SEQ ID NO: 2076

SEQ ID NO: 29477 - DNA, 203 bp, Homo sapiens; identical to SEQ ID NO: 2077

SEQ ID NO: 29478 - DNA, 203 bp, Homo sapiens; identical to SEQ ID NO: 2087

SEQ ID NO: 29479 - DNA, 203 bp, Homo sapiens; identical to SEQ ID NO: 2092

SEQ ID NO: 29480 - DNA, 203 bp, Homo sapiens; identical to SEQ ID NO: 2096

SEQ ID NO: 29481 - DNA, 203 bp, Homo sapiens; identical to SEQ ID NO: 2103

SEQ ID NO: 29482 - DNA, 203 bp, Homo sapiens; identical to SEQ ID NO: 2108

SEQ ID NO: 29483 - DNA, 203 bp, Homo sapiens; identical to SEQ ID NO: 2109

SEQ ID NO: 29484 - DNA, 203 bp, Homo sapiens; identical to SEQ ID NO: 2110

SEQ ID NO: 29485 - DNA, 203 bp, Homo sapiens; identical to SEQ ID NO: 2111

SEQ ID NO: 29486 - DNA, 203 bp, Homo sapiens; identical to SEQ ID NO: 2119

SEQ ID NO: 29487 - DNA, 203 bp, Homo sapiens; identical to SEQ ID NO: 2122

SEQ ID NO: 29488 - DNA, 203 bp, Homo sapiens; identical to SEQ ID NO: 2138

SEQ ID NO: 29489 - DNA, 203 bp, Homo sapiens; identical to SEQ ID NO: 2139

SEQ ID NO: 29490 - DNA, 203 bp, Homo sapiens; identical to SEQ ID NO: 2142

SEQ ID NO: 29491 - DNA, 203 bp, Homo sapiens; identical to SEQ ID NO: 2144

SEQ ID NO: 29492 - DNA, 203 bp, Homo sapiens; identical to SEQ ID NO: 2152

SEQ ID NO: 29493 - DNA, 203 bp, Homo sapiens; identical to SEQ ID NO: 2165

SEQ ID NO: 29494 - DNA, 203 bp, Homo sapiens; identical to SEQ ID NO: 2171

SEQ ID NO: 29495 - DNA, 203 bp, Homo sapiens; identical to SEQ ID NO: 2172

SEQ ID NO: 29496 - DNA, 203 bp, Homo sapiens; identical to SEQ ID NO: 2176

SEQ ID NO: 29497 - DNA, 203 bp, Homo sapiens; identical to SEQ ID NO: 2177

SEQ ID NO: 29498 - DNA, 203 bp, Homo sapiens; identical to SEQ ID NO: 2183

SEQ ID NO: 29499 - DNA, 203 bp, Homo sapiens; identical to SEQ ID NO: 2184

SEQ ID NO: 29500 - DNA, 203 bp, Homo sapiens; identical to SEQ ID NO: 2186

SEQ ID NO: 29501 - DNA, 203 bp, Homo sapiens; identical to SEQ ID NO: 2189

SEQ ID NO: 29502 - DNA, 203 bp, Homo sapiens; identical to SEQ ID NO: 2190

SEQ ID NO: 29503 - DNA, 203 bp, Homo sapiens; identical to SEQ ID NO: 2191

SEQ ID NO: 29504 - DNA, 203 bp, Homo sapiens; identical to SEQ ID NO: 2193

SEQ ID NO: 29505 - DNA, 203 bp, Homo sapiens; identical to SEQ ID NO: 2198

SEQ ID NO: 29506 - DNA, 203 bp, Homo sapiens; identical to SEQ ID NO: 2200

SEQ ID NO: 29507 - DNA, 203 bp, Homo sapiens; identical to SEQ ID NO: 2201

SEQ ID NO: 29508 - DNA, 203 bp, Homo sapiens; identical to SEQ ID NO: 2202

SEQ ID NO: 29509 - DNA, 203 bp, Homo sapiens; identical to SEQ ID NO: 2203

SEQ ID NO: 29510 - DNA, 203 bp, Homo sapiens; identical to SEQ ID NO: 2204

SEQ ID NO: 29511 - DNA, 203 bp, Homo sapiens; identical to SEQ ID NO: 2212

SEQ ID NO: 29512 - DNA, 203 bp, Homo sapiens; identical to SEQ ID NO: 2220

SEQ ID NO: 29513 - DNA, 203 bp, Homo sapiens; identical to SEQ ID NO: 2221

SEQ ID NO: 29514 - DNA, 203 bp, Homo sapiens; identical to SEQ ID NO: 2222

SEQ ID NO: 29515 - DNA, 203 bp, Homo sapiens; identical to SEQ ID NO: 2223

SEQ ID NO: 29516 - DNA, 203 bp, Homo sapiens; identical to SEQ ID NO: 2228

SEQ ID NO: 29517 - DNA, 203 bp, Homo sapiens; identical to SEQ ID NO: 2229

SEQ ID NO: 29518 - DNA, 203 bp, Homo sapiens; identical to SEQ ID NO: 2230

SEQ ID NO: 29519 - DNA, 203 bp, Homo sapiens; identical to SEQ ID NO: 2234

SEQ ID NO: 29520 - DNA, 203 bp, Homo sapiens; identical to SEQ ID NO: 2235

SEQ ID NO: 29521 - DNA, 203 bp, Homo sapiens; identical to SEQ ID NO: 2236

SEQ ID NO: 29522 - DNA, 203 bp, Homo sapiens; identical to SEQ ID NO: 2241

SEQ ID NO: 29523 - DNA, 203 bp, Homo sapiens; identical to SEQ ID NO: 2242

SEQ ID NO: 29524 - DNA, 203 bp, Homo sapiens; identical to SEQ ID NO: 2246

SEQ ID NO: 29525 - DNA, 203 bp, Homo sapiens; identical to SEQ ID NO: 2253

SEQ ID NO: 29526 - DNA, 203 bp, Homo sapiens; identical to SEQ ID NO: 2254

SEQ ID NO: 29527 - DNA, 203 bp, Homo sapiens; identical to SEQ ID NO: 2255

SEQ ID NO: 29528 - DNA, 203 bp, Homo sapiens; identical to SEQ ID NO: 2261

SEQ ID NO: 29529 - DNA, 203 bp, Homo sapiens; identical to SEQ ID NO: 2290

SEQ ID NO: 29530 - DNA, 203 bp, Homo sapiens; identical to SEQ ID NO: 2294

SEQ ID NO: 29531 - DNA, 203 bp, Homo sapiens; identical to SEQ ID NO: 2298

SEQ ID NO: 29532 - DNA, 203 bp, Homo sapiens; identical to SEQ ID NO: 2300

SEQ ID NO: 29533 - DNA, 203 bp, Homo sapiens; identical to SEQ ID NO: 2301

SEQ ID NO: 29534 - DNA, 203 bp, Homo sapiens; identical to SEQ ID NO: 2309

SEQ ID NO: 29535 - DNA, 203 bp, Homo sapiens; identical to SEQ ID NO: 2320

SEQ ID NO: 29536 - DNA, 203 bp, Homo sapiens; identical to SEQ ID NO: 2330

SEQ ID NO: 29537 - DNA, 203 bp, Homo sapiens; identical to SEQ ID NO: 2336

SEQ ID NO: 29538 - DNA, 203 bp, Homo sapiens; identical to SEQ ID NO: 2340

SEQ ID NO: 29539 - DNA, 203 bp, Homo sapiens; identical to SEQ ID NO: 2341

SEQ ID NO: 29540 - DNA, 203 bp, Homo sapiens; identical to SEQ ID NO: 2342

SEQ ID NO: 29541 - DNA, 203 bp, Homo sapiens; identical to SEQ ID NO: 2343

SEQ ID NO: 29542 - DNA, 203 bp, Homo sapiens; identical to SEQ ID NO: 2344

SEQ ID NO: 29543 - DNA, 203 bp, Homo sapiens; identical to SEQ ID NO: 2345

SEQ ID NO: 29544 - DNA, 203 bp, Homo sapiens; identical to SEQ ID NO: 2346

SEQ ID NO: 29545 - DNA, 203 bp, Homo sapiens; identical to SEQ ID NO: 2347

SEQ ID NO: 29546 - DNA, 203 bp, Homo sapiens; identical to SEQ ID NO: 2348

SEQ ID NO: 29547 - DNA, 203 bp, Homo sapiens; identical to SEQ ID NO: 2350

SEQ ID NO: 29548 - DNA, 203 bp, Homo sapiens; identical to SEQ ID NO: 2351

SEQ ID NO: 29549 - DNA, 203 bp, Homo sapiens; identical to SEQ ID NO: 2352

SEQ ID NO: 29550 - DNA, 203 bp, Homo sapiens; identical to SEQ ID NO: 2353

SEQ ID NO: 29551 - DNA, 203 bp, Homo sapiens; identical to SEQ ID NO: 2354

SEQ ID NO: 29552 - DNA, 203 bp, Homo sapiens; identical to SEQ ID NO: 2357

SEQ ID NO: 29553 - DNA, 203 bp, Homo sapiens; identical to SEQ ID NO: 2358

SEQ ID NO: 29554 - DNA, 203 bp, Homo sapiens; identical to SEQ ID NO: 2363

SEQ ID NO: 29555 - DNA, 203 bp, Homo sapiens; identical to SEQ ID NO: 2366

SEQ ID NO: 29556 - DNA, 203 bp, Homo sapiens; identical to SEQ ID NO: 2368

SEQ ID NO: 29557 - DNA, 203 bp, Homo sapiens; identical to SEQ ID NO: 2370

SEQ ID NO: 29558 - DNA, 203 bp, Homo sapiens; identical to SEQ ID NO: 2371

SEQ ID NO: 29559 - DNA, 203 bp, Homo sapiens; identical to SEQ ID NO: 2372

SEQ ID NO: 29560 - DNA, 203 bp, Homo sapiens; identical to SEQ ID NO: 2373

SEQ ID NO: 29561 - DNA, 203 bp, Homo sapiens; identical to SEQ ID NO: 2374

SEQ ID NO: 29562 - DNA, 203 bp, Homo sapiens; identical to SEQ ID NO: 2375

SEQ ID NO: 29563 - DNA, 203 bp, Homo sapiens; identical to SEQ ID NO: 2377

SEQ ID NO: 29564 - DNA, 203 bp, Homo sapiens; identical to SEQ ID NO: 2393

SEQ ID NO: 29565 - DNA, 203 bp, Homo sapiens; identical to SEQ ID NO: 2394

SEQ ID NO: 29566 - DNA, 203 bp, Homo sapiens; identical to SEQ ID NO: 2395

SEQ ID NO: 29567 - DNA, 203 bp, Homo sapiens; identical to SEQ ID NO: 2396

SEQ ID NO: 29568 - DNA, 203 bp, Homo sapiens; identical to SEQ ID NO: 2397

SEQ ID NO: 29569 - DNA, 203 bp, Homo sapiens; identical to SEQ ID NO: 2409

SEQ ID NO: 29570 - DNA, 203 bp, Homo sapiens; identical to SEQ ID NO: 2414

SEQ ID NO: 29571 - DNA, 203 bp, Homo sapiens; identical to SEQ ID NO: 2419

SEQ ID NO: 29572 - DNA, 203 bp, Homo sapiens; identical to SEQ ID NO: 2420

SEQ ID NO: 29573 - DNA, 203 bp, Homo sapiens; identical to SEQ ID NO: 2421

SEQ ID NO: 29574 - DNA, 203 bp, Homo sapiens; identical to SEQ ID NO: 2422

SEQ ID NO: 29575 - DNA, 203 bp, Homo sapiens; identical to SEQ ID NO: 2423

SEQ ID NO: 29576 - DNA, 203 bp, Homo sapiens; identical to SEQ ID NO: 2424

SEQ ID NO: 29577 - DNA, 203 bp, Homo sapiens; identical to SEQ ID NO: 2430

SEQ ID NO: 29578 - DNA, 203 bp, Homo sapiens; identical to SEQ ID NO: 2433

SEQ ID NO: 29579 - DNA, 203 bp, Homo sapiens; identical to SEQ ID NO: 2440

SEQ ID NO: 29580 - DNA, 203 bp, Homo sapiens; identical to SEQ ID NO: 2459

SEQ ID NO: 29581 - DNA, 203 bp, Homo sapiens; identical to SEQ ID NO: 2464

SEQ ID NO: 29582 - DNA, 203 bp, Homo sapiens; identical to SEQ ID NO: 2475

SEQ ID NO: 29583 - DNA, 203 bp, Homo sapiens; identical to SEQ ID NO: 2479

SEQ ID NO: 29584 - DNA, 203 bp, Homo sapiens; identical to SEQ ID NO: 2481

SEQ ID NO: 29585 - DNA, 203 bp, Homo sapiens; identical to SEQ ID NO: 2482

SEQ ID NO: 29586 - DNA, 203 bp, Homo sapiens; identical to SEQ ID NO: 2483

SEQ ID NO: 29587 - DNA, 203 bp, Homo sapiens; identical to SEQ ID NO: 2486

SEQ ID NO: 29588 - DNA, 203 bp, Homo sapiens; identical to SEQ ID NO: 2489

SEQ ID NO: 29589 - DNA, 203 bp, Homo sapiens; identical to SEQ ID NO: 2497

SEQ ID NO: 29590 - DNA, 203 bp, Homo sapiens; identical to SEQ ID NO: 2499

SEQ ID NO: 29591 - DNA, 203 bp, Homo sapiens; identical to SEQ ID NO: 2511

SEQ ID NO: 29592 - DNA, 203 bp, Homo sapiens; identical to SEQ ID NO: 2517

SEQ ID NO: 29593 - DNA, 203 bp, Homo sapiens; identical to SEQ ID NO: 2521

SEQ ID NO: 29594 - DNA, 203 bp, Homo sapiens; identical to SEQ ID NO: 2522

SEQ ID NO: 29595 - DNA, 203 bp, Homo sapiens; identical to SEQ ID NO: 2523

SEQ ID NO: 29596 - DNA, 203 bp, Homo sapiens; identical to SEQ ID NO: 2529

SEQ ID NO: 29597 - DNA, 203 bp, Homo sapiens; identical to SEQ ID NO: 2533

SEQ ID NO: 29598 - DNA, 203 bp, Homo sapiens; identical to SEQ ID NO: 2534

SEQ ID NO: 29599 - DNA, 203 bp, Homo sapiens; identical to SEQ ID NO: 2543

SEQ ID NO: 29600 - DNA, 203 bp, Homo sapiens; identical to SEQ ID NO: 2544

SEQ ID NO: 29601 - DNA, 203 bp, Homo sapiens; identical to SEQ ID NO: 2545

SEQ ID NO: 29602 - DNA, 203 bp, Homo sapiens; identical to SEQ ID NO: 2549

SEQ ID NO: 29603 - DNA, 203 bp, Homo sapiens; identical to SEQ ID NO: 2557

SEQ ID NO: 29604 - DNA, 203 bp, Homo sapiens; identical to SEQ ID NO: 2567

SEQ ID NO: 29605 - DNA, 203 bp, Homo sapiens; identical to SEQ ID NO: 2573

SEQ ID NO: 29606 - DNA, 203 bp, Homo sapiens; identical to SEQ ID NO: 2579

SEQ ID NO: 29607 - DNA, 203 bp, Homo sapiens; identical to SEQ ID NO: 2595

SEQ ID NO: 29608 - DNA, 203 bp, Homo sapiens; identical to SEQ ID NO: 2596

SEQ ID NO: 29609 - DNA, 203 bp, Homo sapiens; identical to SEQ ID NO: 2597

SEQ ID NO: 29610 - DNA, 203 bp, Homo sapiens; identical to SEQ ID NO: 2598

SEQ ID NO: 29611 - DNA, 203 bp, Homo sapiens; identical to SEQ ID NO: 2599

SEQ ID NO: 29612 - DNA, 203 bp, Homo sapiens; identical to SEQ ID NO: 2600

SEQ ID NO: 29613 - DNA, 203 bp, Homo sapiens; identical to SEQ ID NO: 2601

SEQ ID NO: 29614 - DNA, 203 bp, Homo sapiens; identical to SEQ ID NO: 2602

SEQ ID NO: 29615 - DNA, 203 bp, Homo sapiens; identical to SEQ ID NO: 2603

SEQ ID NO: 29616 - DNA, 203 bp, Homo sapiens; identical to SEQ ID NO: 2604

SEQ ID NO: 29617 - DNA, 203 bp, Homo sapiens; identical to SEQ ID NO: 2605

SEQ ID NO: 29618 - DNA, 203 bp, Homo sapiens; identical to SEQ ID NO: 2606

SEQ ID NO: 29619 - DNA, 203 bp, Homo sapiens; identical to SEQ ID NO: 2615

SEQ ID NO: 29620 - DNA, 203 bp, Homo sapiens; identical to SEQ ID NO: 2617

SEQ ID NO: 29621 - DNA, 203 bp, Homo sapiens; identical to SEQ ID NO: 2620

SEQ ID NO: 29622 - DNA, 203 bp, Homo sapiens; identical to SEQ ID NO: 2626

SEQ ID NO: 29623 - DNA, 203 bp, Homo sapiens; identical to SEQ ID NO: 2633

SEQ ID NO: 29624 - DNA, 203 bp, Homo sapiens; identical to SEQ ID NO: 2634

SEQ ID NO: 29625 - DNA, 203 bp, Homo sapiens; identical to SEQ ID NO: 2635

SEQ ID NO: 29626 - DNA, 203 bp, Homo sapiens; identical to SEQ ID NO: 2636

SEQ ID NO: 29627 - DNA, 203 bp, Homo sapiens; identical to SEQ ID NO: 2637

SEQ ID NO: 29628 - DNA, 203 bp, Homo sapiens; identical to SEQ ID NO: 2638

SEQ ID NO: 29629 - DNA, 203 bp, Homo sapiens; identical to SEQ ID NO: 2639

SEQ ID NO: 29630 - DNA, 203 bp, Homo sapiens; identical to SEQ ID NO: 2640

SEQ ID NO: 29631 - DNA, 203 bp, Homo sapiens; identical to SEQ ID NO: 2642

SEQ ID NO: 29632 - DNA, 203 bp, Homo sapiens; identical to SEQ ID NO: 2643

SEQ ID NO: 29633 - DNA, 203 bp, Homo sapiens; identical to SEQ ID NO: 2644

SEQ ID NO: 29634 - DNA, 203 bp, Homo sapiens; identical to SEQ ID NO: 2645

SEQ ID NO: 29635 - DNA, 203 bp, Homo sapiens; identical to SEQ ID NO: 2646

SEQ ID NO: 29636 - DNA, 203 bp, Homo sapiens; identical to SEQ ID NO: 2647

SEQ ID NO: 29637 - DNA, 203 bp, Homo sapiens; identical to SEQ ID NO: 2648

SEQ ID NO: 29638 - DNA, 203 bp, Homo sapiens; identical to SEQ ID NO: 2650

SEQ ID NO: 29639 - DNA, 203 bp, Homo sapiens; identical to SEQ ID NO: 2651

SEQ ID NO: 29640 - DNA, 203 bp, Homo sapiens; identical to SEQ ID NO: 2652

SEQ ID NO: 29641 - DNA, 203 bp, Homo sapiens; identical to SEQ ID NO: 2656

SEQ ID NO: 29642 - DNA, 203 bp, Homo sapiens; identical to SEQ ID NO: 2657

SEQ ID NO: 29643 - DNA, 203 bp, Homo sapiens; identical to SEQ ID NO: 2658

SEQ ID NO: 29644 - DNA, 203 bp, Homo sapiens; identical to SEQ ID NO: 2659

SEQ ID NO: 29645 - DNA, 203 bp, Homo sapiens; identical to SEQ ID NO: 2660

SEQ ID NO: 29646 - DNA, 203 bp, Homo sapiens; identical to SEQ ID NO: 2661

SEQ ID NO: 29647 - DNA, 203 bp, Homo sapiens; identical to SEQ ID NO: 2662

SEQ ID NO: 29648 - DNA, 203 bp, Homo sapiens; identical to SEQ ID NO: 2663

SEQ ID NO: 29649 - DNA, 203 bp, Homo sapiens; identical to SEQ ID NO: 2664

SEQ ID NO: 29650 - DNA, 203 bp, Homo sapiens; identical to SEQ ID NO: 2665

SEQ ID NO: 29651 - DNA, 203 bp, Homo sapiens; identical to SEQ ID NO: 2666

SEQ ID NO: 29652 - DNA, 203 bp, Homo sapiens; identical to SEQ ID NO: 2667

SEQ ID NO: 29653 - DNA, 203 bp, Homo sapiens; identical to SEQ ID NO: 2668

SEQ ID NO: 29654 - DNA, 203 bp, Homo sapiens; identical to SEQ ID NO: 2669

SEQ ID NO: 29655 - DNA, 203 bp, Homo sapiens; identical to SEQ ID NO: 2670

SEQ ID NO: 29656 - DNA, 203 bp, Homo sapiens; identical to SEQ ID NO: 2671

SEQ ID NO: 29657 - DNA, 203 bp, Homo sapiens; identical to SEQ ID NO: 2672

SEQ ID NO: 29658 - DNA, 203 bp, Homo sapiens; identical to SEQ ID NO: 2673

SEQ ID NO: 29659 - DNA, 203 bp, Homo sapiens; identical to SEQ ID NO: 2674

SEQ ID NO: 29660 - DNA, 203 bp, Homo sapiens; identical to SEQ ID NO: 2675

SEQ ID NO: 29661 - DNA, 203 bp, Homo sapiens; identical to SEQ ID NO: 2676

SEQ ID NO: 29662 - DNA, 203 bp, Homo sapiens; identical to SEQ ID NO: 2677

SEQ ID NO: 29663 - DNA, 203 bp, Homo sapiens; identical to SEQ ID NO: 2678

SEQ ID NO: 29664 - DNA, 203 bp, Homo sapiens; identical to SEQ ID NO: 2685

SEQ ID NO: 29665 - DNA, 203 bp, Homo sapiens; identical to SEQ ID NO: 2704

SEQ ID NO: 29666 - DNA, 203 bp, Homo sapiens; identical to SEQ ID NO: 2715

SEQ ID NO: 29667 - DNA, 203 bp, Homo sapiens; identical to SEQ ID NO: 2716

SEQ ID NO: 29668 - DNA, 203 bp, Homo sapiens; identical to SEQ ID NO: 2720

SEQ ID NO: 29669 - DNA, 203 bp, Homo sapiens; identical to SEQ ID NO: 2728

SEQ ID NO: 29670 - DNA, 203 bp, Homo sapiens; identical to SEQ ID NO: 2735

SEQ ID NO: 29671 - DNA, 203 bp, Homo sapiens; identical to SEQ ID NO: 2736

SEQ ID NO: 29672 - DNA, 203 bp, Homo sapiens; identical to SEQ ID NO: 2737

SEQ ID NO: 29673 - DNA, 203 bp, Homo sapiens; identical to SEQ ID NO: 2738

SEQ ID NO: 29674 - DNA, 203 bp, Homo sapiens; identical to SEQ ID NO: 2739

SEQ ID NO: 29675 - DNA, 203 bp, Homo sapiens; identical to SEQ ID NO: 2741

SEQ ID NO: 29676 - DNA, 203 bp, Homo sapiens; identical to SEQ ID NO: 2751

SEQ ID NO: 29677 - DNA, 203 bp, Homo sapiens; identical to SEQ ID NO: 2753

SEQ ID NO: 29678 - DNA, 203 bp, Homo sapiens; identical to SEQ ID NO: 2754

SEQ ID NO: 29679 - DNA, 203 bp, Homo sapiens; identical to SEQ ID NO: 2755

SEQ ID NO: 29680 - DNA, 203 bp, Homo sapiens; identical to SEQ ID NO: 2756

SEQ ID NO: 29681 - DNA, 203 bp, Homo sapiens; identical to SEQ ID NO: 2757

SEQ ID NO: 29682 - DNA, 203 bp, Homo sapiens; identical to SEQ ID NO: 2758

SEQ ID NO: 29683 - DNA, 203 bp, Homo sapiens; identical to SEQ ID NO: 2764

SEQ ID NO: 29684 - DNA, 203 bp, Homo sapiens; identical to SEQ ID NO: 2771

SEQ ID NO: 29685 - DNA, 203 bp, Homo sapiens; identical to SEQ ID NO: 2777

SEQ ID NO: 29686 - DNA, 203 bp, Homo sapiens; identical to SEQ ID NO: 2778

SEQ ID NO: 29687 - DNA, 203 bp, Homo sapiens; identical to SEQ ID NO: 2783

SEQ ID NO: 29688 - DNA, 203 bp, Homo sapiens; identical to SEQ ID NO: 2787

SEQ ID NO: 29689 - DNA, 203 bp, Homo sapiens; identical to SEQ ID NO: 2800

SEQ ID NO: 29690 - DNA, 203 bp, Homo sapiens; identical to SEQ ID NO: 2801

SEQ ID NO: 29691 - DNA, 203 bp, Homo sapiens; identical to SEQ ID NO: 2813

SEQ ID NO: 29692 - DNA, 203 bp, Homo sapiens; identical to SEQ ID NO: 2814

SEQ ID NO: 29693 - DNA, 203 bp, Homo sapiens; identical to SEQ ID NO: 2815

SEQ ID NO: 29694 - DNA, 203 bp, Homo sapiens; identical to SEQ ID NO: 2816

SEQ ID NO: 29695 - DNA, 203 bp, Homo sapiens; identical to SEQ ID NO: 2822

SEQ ID NO: 29696 - DNA, 203 bp, Homo sapiens; identical to SEQ ID NO: 2825

SEQ ID NO: 29697 - DNA, 203 bp, Homo sapiens; identical to SEQ ID NO: 2828

SEQ ID NO: 29698 - DNA, 203 bp, Homo sapiens; identical to SEQ ID NO: 2835

SEQ ID NO: 29699 - DNA, 203 bp, Homo sapiens; identical to SEQ ID NO: 2836

SEQ ID NO: 29700 - DNA, 203 bp, Homo sapiens; identical to SEQ ID NO: 2837

SEQ ID NO: 29701 - DNA, 203 bp, Homo sapiens; identical to SEQ ID NO: 2847

SEQ ID NO: 29702 - DNA, 203 bp, Homo sapiens; identical to SEQ ID NO: 2848

SEQ ID NO: 29703 - DNA, 203 bp, Homo sapiens; identical to SEQ ID NO: 2849

SEQ ID NO: 29704 - DNA, 203 bp, Homo sapiens; identical to SEQ ID NO: 2853

SEQ ID NO: 29705 - DNA, 203 bp, Homo sapiens; identical to SEQ ID NO: 2876

SEQ ID NO: 29706 - DNA, 203 bp, Homo sapiens; identical to SEQ ID NO: 2879

SEQ ID NO: 29707 - DNA, 203 bp, Homo sapiens; identical to SEQ ID NO: 2882

SEQ ID NO: 29708 - DNA, 203 bp, Homo sapiens; identical to SEQ ID NO: 2883

SEQ ID NO: 29709 - DNA, 203 bp, Homo sapiens; identical to SEQ ID NO: 2886

SEQ ID NO: 29710 - DNA, 203 bp, Homo sapiens; identical to SEQ ID NO: 2887

SEQ ID NO: 29711 - DNA, 203 bp, Homo sapiens; identical to SEQ ID NO: 2890

SEQ ID NO: 29712 - DNA, 203 bp, Homo sapiens; identical to SEQ ID NO: 2891

SEQ ID NO: 29713 - DNA, 203 bp, Homo sapiens; identical to SEQ ID NO: 2899

SEQ ID NO: 29714 - DNA, 203 bp, Homo sapiens; identical to SEQ ID NO: 2900

SEQ ID NO: 29715 - DNA, 203 bp, Homo sapiens; identical to SEQ ID NO: 2908

SEQ ID NO: 29716 - DNA, 203 bp, Homo sapiens; identical to SEQ ID NO: 2911

SEQ ID NO: 29717 - DNA, 203 bp, Homo sapiens; identical to SEQ ID NO: 2914

SEQ ID NO: 29718 - DNA, 203 bp, Homo sapiens; identical to SEQ ID NO: 2921

SEQ ID NO: 29719 - DNA, 203 bp, Homo sapiens; identical to SEQ ID NO: 2923

SEQ ID NO: 29720 - DNA, 203 bp, Homo sapiens; identical to SEQ ID NO: 2924

SEQ ID NO: 29721 - DNA, 203 bp, Homo sapiens; identical to SEQ ID NO: 2927

SEQ ID NO: 29722 - DNA, 203 bp, Homo sapiens; identical to SEQ ID NO: 2929

SEQ ID NO: 29723 - DNA, 203 bp, Homo sapiens; identical to SEQ ID NO: 2935

SEQ ID NO: 29724 - DNA, 203 bp, Homo sapiens; identical to SEQ ID NO: 2938

SEQ ID NO: 29725 - DNA, 203 bp, Homo sapiens; identical to SEQ ID NO: 2949

SEQ ID NO: 29726 - DNA, 203 bp, Homo sapiens; identical to SEQ ID NO: 2950

SEQ ID NO: 29727 - DNA, 203 bp, Homo sapiens; identical to SEQ ID NO: 2956

SEQ ID NO: 29728 - DNA, 203 bp, Homo sapiens; identical to SEQ ID NO: 2957

SEQ ID NO: 29729 - DNA, 203 bp, Homo sapiens; identical to SEQ ID NO: 2962

SEQ ID NO: 29730 - DNA, 203 bp, Homo sapiens; identical to SEQ ID NO: 2963

SEQ ID NO: 29731 - DNA, 203 bp, Homo sapiens; identical to SEQ ID NO: 2970

SEQ ID NO: 29732 - DNA, 203 bp, Homo sapiens; identical to SEQ ID NO: 2971

SEQ ID NO: 29733 - DNA, 203 bp, Homo sapiens; identical to SEQ ID NO: 2975

SEQ ID NO: 29734 - DNA, 203 bp, Homo sapiens; identical to SEQ ID NO: 2976

SEQ ID NO: 29735 - DNA, 203 bp, Homo sapiens; identical to SEQ ID NO: 2980

SEQ ID NO: 29736 - DNA, 203 bp, Homo sapiens; identical to SEQ ID NO: 2981

SEQ ID NO: 29737 - DNA, 203 bp, Homo sapiens; identical to SEQ ID NO: 2985

SEQ ID NO: 29738 - DNA, 203 bp, Homo sapiens; identical to SEQ ID NO: 2988

SEQ ID NO: 29739 - DNA, 203 bp, Homo sapiens; identical to SEQ ID NO: 2989

SEQ ID NO: 29740 - DNA, 203 bp, Homo sapiens; identical to SEQ ID NO: 2991

SEQ ID NO: 29741 - DNA, 203 bp, Homo sapiens; identical to SEQ ID NO: 2994

SEQ ID NO: 29742 - DNA, 203 bp, Homo sapiens; identical to SEQ ID NO: 3003

SEQ ID NO: 29743 - DNA, 203 bp, Homo sapiens; identical to SEQ ID NO: 3005

SEQ ID NO: 29744 - DNA, 203 bp, Homo sapiens; identical to SEQ ID NO: 3006

SEQ ID NO: 29745 - DNA, 203 bp, Homo sapiens; identical to SEQ ID NO: 3007

SEQ ID NO: 29746 - DNA, 203 bp, Homo sapiens; identical to SEQ ID NO: 3013

SEQ ID NO: 29747 - DNA, 203 bp, Homo sapiens; identical to SEQ ID NO: 3016

SEQ ID NO: 29748 - DNA, 203 bp, Homo sapiens; identical to SEQ ID NO: 3017

SEQ ID NO: 29749 - DNA, 203 bp, Homo sapiens; identical to SEQ ID NO: 3021

SEQ ID NO: 29750 - DNA, 203 bp, Homo sapiens; identical to SEQ ID NO: 3022

SEQ ID NO: 29751 - DNA, 203 bp, Homo sapiens; identical to SEQ ID NO: 3028

SEQ ID NO: 29752 - DNA, 203 bp, Homo sapiens; identical to SEQ ID NO: 3032

SEQ ID NO: 29753 - DNA, 203 bp, Homo sapiens; identical to SEQ ID NO: 3033

SEQ ID NO: 29754 - DNA, 203 bp, Homo sapiens; identical to SEQ ID NO: 3038

SEQ ID NO: 29755 - DNA, 203 bp, Homo sapiens; identical to SEQ ID NO: 3039

SEQ ID NO: 29756 - DNA, 203 bp, Homo sapiens; identical to SEQ ID NO: 3046

SEQ ID NO: 29757 - DNA, 203 bp, Homo sapiens; identical to SEQ ID NO: 3050

SEQ ID NO: 29758 - DNA, 203 bp, Homo sapiens; identical to SEQ ID NO: 3052

SEQ ID NO: 29759 - DNA, 203 bp, Homo sapiens; identical to SEQ ID NO: 3063

SEQ ID NO: 29760 - DNA, 203 bp, Homo sapiens; identical to SEQ ID NO: 3068

SEQ ID NO: 29761 - DNA, 203 bp, Homo sapiens; identical to SEQ ID NO: 3069

SEQ ID NO: 29762 - DNA, 203 bp, Homo sapiens; identical to SEQ ID NO: 3071

SEQ ID NO: 29763 - DNA, 203 bp, Homo sapiens; identical to SEQ ID NO: 3077

SEQ ID NO: 29764 - DNA, 203 bp, Homo sapiens; identical to SEQ ID NO: 3083

SEQ ID NO: 29765 - DNA, 203 bp, Homo sapiens; identical to SEQ ID NO: 3084

SEQ ID NO: 29766 - DNA, 203 bp, Homo sapiens; identical to SEQ ID NO: 3088

SEQ ID NO: 29767 - DNA, 203 bp, Homo sapiens; identical to SEQ ID NO: 3094

SEQ ID NO: 29768 - DNA, 203 bp, Homo sapiens; identical to SEQ ID NO: 3095

SEQ ID NO: 29769 - DNA, 203 bp, Homo sapiens; identical to SEQ ID NO: 3097

SEQ ID NO: 29770 - DNA, 203 bp, Homo sapiens; identical to SEQ ID NO: 3100

SEQ ID NO: 29771 - DNA, 203 bp, Homo sapiens; identical to SEQ ID NO: 3101

SEQ ID NO: 29772 - DNA, 203 bp, Homo sapiens; identical to SEQ ID NO: 3106

SEQ ID NO: 29773 - DNA, 203 bp, Homo sapiens; identical to SEQ ID NO: 3107

SEQ ID NO: 29774 - DNA, 203 bp, Homo sapiens; identical to SEQ ID NO: 3108

SEQ ID NO: 29775 - DNA, 203 bp, Homo sapiens; identical to SEQ ID NO: 3111

SEQ ID NO: 29776 - DNA, 203 bp, Homo sapiens; identical to SEQ ID NO: 3113

SEQ ID NO: 29777 - DNA, 203 bp, Homo sapiens; identical to SEQ ID NO: 3116

SEQ ID NO: 29778 - DNA, 203 bp, Homo sapiens; identical to SEQ ID NO: 3118

SEQ ID NO: 29779 - DNA, 203 bp, Homo sapiens; identical to SEQ ID NO: 3121

SEQ ID NO: 29780 - DNA, 203 bp, Homo sapiens; identical to SEQ ID NO: 3123

SEQ ID NO: 29781 - DNA, 203 bp, Homo sapiens; identical to SEQ ID NO: 3125

SEQ ID NO: 29782 - DNA, 203 bp, Homo sapiens; identical to SEQ ID NO: 3130

SEQ ID NO: 29783 - DNA, 203 bp, Homo sapiens; identical to SEQ ID NO: 3134

SEQ ID NO: 29784 - DNA, 203 bp, Homo sapiens; identical to SEQ ID NO: 3140

SEQ ID NO: 29785 - DNA, 203 bp, Homo sapiens; identical to SEQ ID NO: 3141

SEQ ID NO: 29786 - DNA, 203 bp, Homo sapiens; identical to SEQ ID NO: 3145

SEQ ID NO: 29787 - DNA, 203 bp, Homo sapiens; identical to SEQ ID NO: 3163

SEQ ID NO: 29788 - DNA, 203 bp, Homo sapiens; identical to SEQ ID NO: 3165

SEQ ID NO: 29789 - DNA, 203 bp, Homo sapiens; identical to SEQ ID NO: 3168

SEQ ID NO: 29790 - DNA, 203 bp, Homo sapiens; identical to SEQ ID NO: 3169

SEQ ID NO: 29791 - DNA, 203 bp, Homo sapiens; identical to SEQ ID NO: 3172

SEQ ID NO: 29792 - DNA, 203 bp, Homo sapiens; identical to SEQ ID NO: 3173

SEQ ID NO: 29793 - DNA, 203 bp, Homo sapiens; identical to SEQ ID NO: 3175

SEQ ID NO: 29794 - DNA, 203 bp, Homo sapiens; identical to SEQ ID NO: 3176

SEQ ID NO: 29795 - DNA, 203 bp, Homo sapiens; identical to SEQ ID NO: 3185

SEQ ID NO: 29796 - DNA, 203 bp, Homo sapiens; identical to SEQ ID NO: 3186

SEQ ID NO: 29797 - DNA, 203 bp, Homo sapiens; identical to SEQ ID NO: 3187

SEQ ID NO: 29798 - DNA, 203 bp, Homo sapiens; identical to SEQ ID NO: 3188

SEQ ID NO: 29799 - DNA, 203 bp, Homo sapiens; identical to SEQ ID NO: 3197

SEQ ID NO: 29800 - DNA, 203 bp, Homo sapiens; identical to SEQ ID NO: 3199

SEQ ID NO: 29801 - DNA, 203 bp, Homo sapiens; identical to SEQ ID NO: 3203

SEQ ID NO: 29802 - DNA, 203 bp, Homo sapiens; identical to SEQ ID NO: 3208

SEQ ID NO: 29803 - DNA, 203 bp, Homo sapiens; identical to SEQ ID NO: 3211

SEQ ID NO: 29804 - DNA, 203 bp, Homo sapiens; identical to SEQ ID NO: 3213

SEQ ID NO: 29805 - DNA, 203 bp, Homo sapiens; identical to SEQ ID NO: 3216

SEQ ID NO: 29806 - DNA, 203 bp, Homo sapiens; identical to SEQ ID NO: 3218

SEQ ID NO: 29807 - DNA, 203 bp, Homo sapiens; identical to SEQ ID NO: 3219

SEQ ID NO: 29808 - DNA, 203 bp, Homo sapiens; identical to SEQ ID NO: 3224

SEQ ID NO: 29809 - DNA, 203 bp, Homo sapiens; identical to SEQ ID NO: 3230

SEQ ID NO: 29810 - DNA, 203 bp, Homo sapiens; identical to SEQ ID NO: 3231

SEQ ID NO: 29811 - DNA, 203 bp, Homo sapiens; identical to SEQ ID NO: 3233

SEQ ID NO: 29812 - DNA, 203 bp, Homo sapiens; identical to SEQ ID NO: 3235

SEQ ID NO: 29813 - DNA, 203 bp, Homo sapiens; identical to SEQ ID NO: 3252

SEQ ID NO: 29814 - DNA, 203 bp, Homo sapiens; identical to SEQ ID NO: 3265

SEQ ID NO: 29815 - DNA, 203 bp, Homo sapiens; identical to SEQ ID NO: 3269

SEQ ID NO: 29816 - DNA, 203 bp, Homo sapiens; identical to SEQ ID NO: 3270

SEQ ID NO: 29817 - DNA, 203 bp, Homo sapiens; identical to SEQ ID NO: 3271

SEQ ID NO: 29818 - DNA, 203 bp, Homo sapiens; identical to SEQ ID NO: 3272

SEQ ID NO: 29819 - DNA, 203 bp, Homo sapiens; identical to SEQ ID NO: 3279

SEQ ID NO: 29820 - DNA, 203 bp, Homo sapiens; identical to SEQ ID NO: 3282

SEQ ID NO: 29821 - DNA, 203 bp, Homo sapiens; identical to SEQ ID NO: 3284

SEQ ID NO: 29822 - DNA, 203 bp, Homo sapiens; identical to SEQ ID NO: 3286

SEQ ID NO: 29823 - DNA, 203 bp, Homo sapiens; identical to SEQ ID NO: 3287

SEQ ID NO: 29824 - DNA, 203 bp, Homo sapiens; identical to SEQ ID NO: 3291

SEQ ID NO: 29825 - DNA, 203 bp, Homo sapiens; identical to SEQ ID NO: 3292

SEQ ID NO: 29826 - DNA, 203 bp, Homo sapiens; identical to SEQ ID NO: 3294

SEQ ID NO: 29827 - DNA, 203 bp, Homo sapiens; identical to SEQ ID NO: 3299

SEQ ID NO: 29828 - DNA, 203 bp, Homo sapiens; identical to SEQ ID NO: 3302

SEQ ID NO: 29829 - DNA, 203 bp, Homo sapiens; identical to SEQ ID NO: 3303

SEQ ID NO: 29830 - DNA, 203 bp, Homo sapiens; identical to SEQ ID NO: 3310

SEQ ID NO: 29831 - DNA, 203 bp, Homo sapiens; identical to SEQ ID NO: 3311

SEQ ID NO: 29832 - DNA, 203 bp, Homo sapiens; identical to SEQ ID NO: 3315

SEQ ID NO: 29833 - DNA, 203 bp, Homo sapiens; identical to SEQ ID NO: 3318

SEQ ID NO: 29834 - DNA, 203 bp, Homo sapiens; identical to SEQ ID NO: 3320

SEQ ID NO: 29835 - DNA, 203 bp, Homo sapiens; identical to SEQ ID NO: 3323

SEQ ID NO: 29836 - DNA, 203 bp, Homo sapiens; identical to SEQ ID NO: 3325

SEQ ID NO: 29837 - DNA, 203 bp, Homo sapiens; identical to SEQ ID NO: 3328

SEQ ID NO: 29838 - DNA, 203 bp, Homo sapiens; identical to SEQ ID NO: 3336

SEQ ID NO: 29839 - DNA, 203 bp, Homo sapiens; identical to SEQ ID NO: 3338

SEQ ID NO: 29840 - DNA, 203 bp, Homo sapiens; identical to SEQ ID NO: 3341

SEQ ID NO: 29841 - DNA, 203 bp, Homo sapiens; identical to SEQ ID NO: 3345

SEQ ID NO: 29842 - DNA, 203 bp, Homo sapiens; identical to SEQ ID NO: 3352

SEQ ID NO: 29843 - DNA, 203 bp, Homo sapiens; identical to SEQ ID NO: 3358

SEQ ID NO: 29844 - DNA, 203 bp, Homo sapiens; identical to SEQ ID NO: 3359

SEQ ID NO: 29845 - DNA, 203 bp, Homo sapiens; identical to SEQ ID NO: 3360

SEQ ID NO: 29846 - DNA, 203 bp, Homo sapiens; identical to SEQ ID NO: 3369

SEQ ID NO: 29847 - DNA, 203 bp, Homo sapiens; identical to SEQ ID NO: 3370

SEQ ID NO: 29848 - DNA, 203 bp, Homo sapiens; identical to SEQ ID NO: 3373

SEQ ID NO: 29849 - DNA, 203 bp, Homo sapiens; identical to SEQ ID NO: 3377

SEQ ID NO: 29850 - DNA, 203 bp, Homo sapiens; identical to SEQ ID NO: 3396

SEQ ID NO: 29851 - DNA, 203 bp, Homo sapiens; identical to SEQ ID NO: 3404

SEQ ID NO: 29852 - DNA, 203 bp, Homo sapiens; identical to SEQ ID NO: 3420

SEQ ID NO: 29853 - DNA, 203 bp, Homo sapiens; identical to SEQ ID NO: 3428

SEQ ID NO: 29854 - DNA, 203 bp, Homo sapiens; identical to SEQ ID NO: 3429

SEQ ID NO: 29855 - DNA, 203 bp, Homo sapiens; identical to SEQ ID NO: 3466

SEQ ID NO: 29856 - DNA, 203 bp, Homo sapiens; identical to SEQ ID NO: 3486

SEQ ID NO: 29857 - DNA, 203 bp, Homo sapiens; identical to SEQ ID NO: 3488

SEQ ID NO: 29858 - DNA, 203 bp, Homo sapiens; identical to SEQ ID NO: 3491

SEQ ID NO: 29859 - DNA, 203 bp, Homo sapiens; identical to SEQ ID NO: 3493

SEQ ID NO: 29860 - DNA, 203 bp, Homo sapiens; identical to SEQ ID NO: 3496

SEQ ID NO: 29861 - DNA, 203 bp, Homo sapiens; identical to SEQ ID NO: 3502

SEQ ID NO: 29862 - DNA, 203 bp, Homo sapiens; identical to SEQ ID NO: 3503

SEQ ID NO: 29863 - DNA, 203 bp, Homo sapiens; identical to SEQ ID NO: 3509

SEQ ID NO: 29864 - DNA, 203 bp, Homo sapiens; identical to SEQ ID NO: 3513

SEQ ID NO: 29865 - DNA, 203 bp, Homo sapiens; identical to SEQ ID NO: 3525

SEQ ID NO: 29866 - DNA, 203 bp, Homo sapiens; identical to SEQ ID NO: 3538

SEQ ID NO: 29867 - DNA, 203 bp, Homo sapiens; identical to SEQ ID NO: 3540

SEQ ID NO: 29868 - DNA, 203 bp, Homo sapiens; identical to SEQ ID NO: 3541

SEQ ID NO: 29869 - DNA, 203 bp, Homo sapiens; identical to SEQ ID NO: 3542

SEQ ID NO: 29870 - DNA, 203 bp, Homo sapiens; identical to SEQ ID NO: 3548

SEQ ID NO: 29871 - DNA, 203 bp, Homo sapiens; identical to SEQ ID NO: 3551

SEQ ID NO: 29872 - DNA, 203 bp, Homo sapiens; identical to SEQ ID NO: 3553

SEQ ID NO: 29873 - DNA, 203 bp, Homo sapiens; identical to SEQ ID NO: 3555

SEQ ID NO: 29874 - DNA, 203 bp, Homo sapiens; identical to SEQ ID NO: 3557

SEQ ID NO: 29875 - DNA, 203 bp, Homo sapiens; identical to SEQ ID NO: 3569

SEQ ID NO: 29876 - DNA, 203 bp, Homo sapiens; identical to SEQ ID NO: 3576

SEQ ID NO: 29877 - DNA, 203 bp, Homo sapiens; identical to SEQ ID NO: 3586

SEQ ID NO: 29878 - DNA, 203 bp, Homo sapiens; identical to SEQ ID NO: 3591

SEQ ID NO: 29879 - DNA, 203 bp, Homo sapiens; identical to SEQ ID NO: 3597

SEQ ID NO: 29880 - DNA, 203 bp, Homo sapiens; identical to SEQ ID NO: 3605

SEQ ID NO: 29881 - DNA, 203 bp, Homo sapiens; identical to SEQ ID NO: 3611

SEQ ID NO: 29882 - DNA, 203 bp, Homo sapiens; identical to SEQ ID NO: 3615

SEQ ID NO: 29883 - DNA, 203 bp, Homo sapiens; identical to SEQ ID NO: 3618

SEQ ID NO: 29884 - DNA, 203 bp, Homo sapiens; identical to SEQ ID NO: 3627

SEQ ID NO: 29885 - DNA, 203 bp, Homo sapiens; identical to SEQ ID NO: 3628

SEQ ID NO: 29886 - DNA, 203 bp, Homo sapiens; identical to SEQ ID NO: 3629

SEQ ID NO: 29887 - DNA, 203 bp, Homo sapiens; identical to SEQ ID NO: 3633

SEQ ID NO: 29888 - DNA, 203 bp, Homo sapiens; identical to SEQ ID NO: 3634

SEQ ID NO: 29889 - DNA, 203 bp, Homo sapiens; identical to SEQ ID NO: 3637

SEQ ID NO: 29890 - DNA, 203 bp, Homo sapiens; identical to SEQ ID NO: 3639

SEQ ID NO: 29891 - DNA, 203 bp, Homo sapiens; identical to SEQ ID NO: 3641

SEQ ID NO: 29892 - DNA, 203 bp, Homo sapiens; identical to SEQ ID NO: 3655

SEQ ID NO: 29893 - DNA, 203 bp, Homo sapiens; identical to SEQ ID NO: 3662

SEQ ID NO: 29894 - DNA, 203 bp, Homo sapiens; identical to SEQ ID NO: 3663

SEQ ID NO: 29895 - DNA, 203 bp, Homo sapiens; identical to SEQ ID NO: 3673

SEQ ID NO: 29896 - DNA, 203 bp, Homo sapiens; identical to SEQ ID NO: 3674

SEQ ID NO: 29897 - DNA, 203 bp, Homo sapiens; identical to SEQ ID NO: 3676

SEQ ID NO: 29898 - DNA, 203 bp, Homo sapiens; identical to SEQ ID NO: 3677

SEQ ID NO: 29899 - DNA, 203 bp, Homo sapiens; identical to SEQ ID NO: 3701

SEQ ID NO: 29900 - DNA, 203 bp, Homo sapiens; identical to SEQ ID NO: 3702

SEQ ID NO: 29901 - DNA, 203 bp, Homo sapiens; identical to SEQ ID NO: 3703

SEQ ID NO: 29902 - DNA, 203 bp, Homo sapiens; identical to SEQ ID NO: 3706

SEQ ID NO: 29903 - DNA, 203 bp, Homo sapiens; identical to SEQ ID NO: 3710

SEQ ID NO: 29904 - DNA, 203 bp, Homo sapiens; identical to SEQ ID NO: 3720

SEQ ID NO: 29905 - DNA, 203 bp, Homo sapiens; identical to SEQ ID NO: 3727

SEQ ID NO: 29906 - DNA, 203 bp, Homo sapiens; identical to SEQ ID NO: 3733

SEQ ID NO: 29907 - DNA, 203 bp, Homo sapiens; identical to SEQ ID NO: 3744

SEQ ID NO: 29908 - DNA, 203 bp, Homo sapiens; identical to SEQ ID NO: 3758

SEQ ID NO: 29909 - DNA, 203 bp, Homo sapiens; identical to SEQ ID NO: 3771

SEQ ID NO: 29910 - DNA, 203 bp, Homo sapiens; identical to SEQ ID NO: 3773

SEQ ID NO: 29911 - DNA, 203 bp, Homo sapiens; identical to SEQ ID NO: 3774

SEQ ID NO: 29912 - DNA, 203 bp, Homo sapiens; identical to SEQ ID NO: 3775

SEQ ID NO: 29913 - DNA, 203 bp, Homo sapiens; identical to SEQ ID NO: 3777

SEQ ID NO: 29914 - DNA, 203 bp, Homo sapiens; identical to SEQ ID NO: 3781

SEQ ID NO: 29915 - DNA, 203 bp, Homo sapiens; identical to SEQ ID NO: 3782

SEQ ID NO: 29916 - DNA, 203 bp, Homo sapiens; identical to SEQ ID NO: 3785

SEQ ID NO: 29917 - DNA, 203 bp, Homo sapiens; identical to SEQ ID NO: 3790

SEQ ID NO: 29918 - DNA, 203 bp, Homo sapiens; identical to SEQ ID NO: 3792

SEQ ID NO: 29919 - DNA, 203 bp, Homo sapiens; identical to SEQ ID NO: 3793

SEQ ID NO: 29920 - DNA, 203 bp, Homo sapiens; identical to SEQ ID NO: 3796

SEQ ID NO: 29921 - DNA, 203 bp, Homo sapiens; identical to SEQ ID NO: 3797

SEQ ID NO: 29922 - DNA, 203 bp, Homo sapiens; identical to SEQ ID NO: 3798

SEQ ID NO: 29923 - DNA, 203 bp, Homo sapiens; identical to SEQ ID NO: 3799

SEQ ID NO: 29924 - DNA, 203 bp, Homo sapiens; identical to SEQ ID NO: 3800

SEQ ID NO: 29925 - DNA, 203 bp, Homo sapiens; identical to SEQ ID NO: 3801

SEQ ID NO: 29926 - DNA, 203 bp, Homo sapiens; identical to SEQ ID NO: 3804

SEQ ID NO: 29927 - DNA, 203 bp, Homo sapiens; identical to SEQ ID NO: 3806

SEQ ID NO: 29928 - DNA, 203 bp, Homo sapiens; identical to SEQ ID NO: 3807

SEQ ID NO: 29929 - DNA, 203 bp, Homo sapiens; identical to SEQ ID NO: 3808

SEQ ID NO: 29930 - DNA, 203 bp, Homo sapiens; identical to SEQ ID NO: 3809

SEQ ID NO: 29931 - DNA, 203 bp, Homo sapiens; identical to SEQ ID NO: 3811

SEQ ID NO: 29932 - DNA, 203 bp, Homo sapiens; identical to SEQ ID NO: 3812

SEQ ID NO: 29933 - DNA, 203 bp, Homo sapiens; identical to SEQ ID NO: 3813

SEQ ID NO: 29934 - DNA, 203 bp, Homo sapiens; identical to SEQ ID NO: 3814

SEQ ID NO: 29935 - DNA, 203 bp, Homo sapiens; identical to SEQ ID NO: 3826

SEQ ID NO: 29936 - DNA, 203 bp, Homo sapiens; identical to SEQ ID NO: 3827

SEQ ID NO: 29937 - DNA, 203 bp, Homo sapiens; identical to SEQ ID NO: 3828

SEQ ID NO: 29938 - DNA, 203 bp, Homo sapiens; identical to SEQ ID NO: 3831

SEQ ID NO: 29939 - DNA, 203 bp, Homo sapiens; identical to SEQ ID NO: 3836

SEQ ID NO: 29940 - DNA, 203 bp, Homo sapiens; identical to SEQ ID NO: 3837

SEQ ID NO: 29941 - DNA, 203 bp, Homo sapiens; identical to SEQ ID NO: 3839

SEQ ID NO: 29942 - DNA, 203 bp, Homo sapiens; identical to SEQ ID NO: 3846

SEQ ID NO: 29943 - DNA, 203 bp, Homo sapiens; identical to SEQ ID NO: 3847

SEQ ID NO: 29944 - DNA, 203 bp, Homo sapiens; identical to SEQ ID NO: 3851

SEQ ID NO: 29945 - DNA, 203 bp, Homo sapiens; identical to SEQ ID NO: 3852

SEQ ID NO: 29946 - DNA, 203 bp, Homo sapiens; identical to SEQ ID NO: 3853

SEQ ID NO: 29947 - DNA, 203 bp, Homo sapiens; identical to SEQ ID NO: 3856

SEQ ID NO: 29948 - DNA, 203 bp, Homo sapiens; identical to SEQ ID NO: 3861

SEQ ID NO: 29949 - DNA, 203 bp, Homo sapiens; identical to SEQ ID NO: 3862

SEQ ID NO: 29950 - DNA, 203 bp, Homo sapiens; identical to SEQ ID NO: 3871

SEQ ID NO: 29951 - DNA, 203 bp, Homo sapiens; identical to SEQ ID NO: 3872

SEQ ID NO: 29952 - DNA, 203 bp, Homo sapiens; identical to SEQ ID NO: 3874

SEQ ID NO: 29953 - DNA, 203 bp, Homo sapiens; identical to SEQ ID NO: 3875

SEQ ID NO: 29954 - DNA, 203 bp, Homo sapiens; identical to SEQ ID NO: 3876

SEQ ID NO: 29955 - DNA, 203 bp, Homo sapiens; identical to SEQ ID NO: 3877

SEQ ID NO: 29956 - DNA, 203 bp, Homo sapiens; identical to SEQ ID NO: 3880

SEQ ID NO: 29957 - DNA, 203 bp, Homo sapiens; identical to SEQ ID NO: 3881

SEQ ID NO: 29958 - DNA, 203 bp, Homo sapiens; identical to SEQ ID NO: 3883

SEQ ID NO: 29959 - DNA, 203 bp, Homo sapiens; identical to SEQ ID NO: 3886

SEQ ID NO: 29960 - DNA, 203 bp, Homo sapiens; identical to SEQ ID NO: 3887

SEQ ID NO: 29961 - DNA, 203 bp, Homo sapiens; identical to SEQ ID NO: 3888

SEQ ID NO: 29962 - DNA, 203 bp, Homo sapiens; identical to SEQ ID NO: 3889

SEQ ID NO: 29963 - DNA, 203 bp, Homo sapiens; identical to SEQ ID NO: 3894

SEQ ID NO: 29964 - DNA, 203 bp, Homo sapiens; identical to SEQ ID NO: 3896

SEQ ID NO: 29965 - DNA, 203 bp, Homo sapiens; identical to SEQ ID NO: 3897

SEQ ID NO: 29966 - DNA, 203 bp, Homo sapiens; identical to SEQ ID NO: 3908

SEQ ID NO: 29967 - DNA, 203 bp, Homo sapiens; identical to SEQ ID NO: 3909

SEQ ID NO: 29968 - DNA, 203 bp, Homo sapiens; identical to SEQ ID NO: 3914

SEQ ID NO: 29969 - DNA, 203 bp, Homo sapiens; identical to SEQ ID NO: 3915

SEQ ID NO: 29970 - DNA, 203 bp, Homo sapiens; identical to SEQ ID NO: 3926

SEQ ID NO: 29971 - DNA, 203 bp, Homo sapiens; identical to SEQ ID NO: 3929

SEQ ID NO: 29972 - DNA, 203 bp, Homo sapiens; identical to SEQ ID NO: 3931

SEQ ID NO: 29973 - DNA, 203 bp, Homo sapiens; identical to SEQ ID NO: 3933

SEQ ID NO: 29974 - DNA, 203 bp, Homo sapiens; identical to SEQ ID NO: 3934

SEQ ID NO: 29975 - DNA, 203 bp, Homo sapiens; identical to SEQ ID NO: 3937

SEQ ID NO: 29976 - DNA, 203 bp, Homo sapiens; identical to SEQ ID NO: 3949

SEQ ID NO: 29977 - DNA, 203 bp, Homo sapiens; identical to SEQ ID NO: 3958

SEQ ID NO: 29978 - DNA, 203 bp, Homo sapiens; identical to SEQ ID NO: 3967

SEQ ID NO: 29979 - DNA, 203 bp, Homo sapiens; identical to SEQ ID NO: 3969

SEQ ID NO: 29980 - DNA, 203 bp, Homo sapiens; identical to SEQ ID NO: 3970

SEQ ID NO: 29981 - DNA, 203 bp, Homo sapiens; identical to SEQ ID NO: 3972

SEQ ID NO: 29982 - DNA, 203 bp, Homo sapiens; identical to SEQ ID NO: 3976

SEQ ID NO: 29983 - DNA, 203 bp, Homo sapiens; identical to SEQ ID NO: 3977

SEQ ID NO: 29984 - DNA, 203 bp, Homo sapiens; identical to SEQ ID NO: 3980

SEQ ID NO: 29985 - DNA, 203 bp, Homo sapiens; identical to SEQ ID NO: 3989

SEQ ID NO: 29986 - DNA, 203 bp, Homo sapiens; identical to SEQ ID NO: 3990

SEQ ID NO: 29987 - DNA, 203 bp, Homo sapiens; identical to SEQ ID NO: 3992

SEQ ID NO: 29988 - DNA, 203 bp, Homo sapiens; identical to SEQ ID NO: 3993

SEQ ID NO: 29989 - DNA, 203 bp, Homo sapiens; identical to SEQ ID NO: 4006

SEQ ID NO: 29990 - DNA, 203 bp, Homo sapiens; identical to SEQ ID NO: 4008

SEQ ID NO: 29991 - DNA, 203 bp, Homo sapiens; identical to SEQ ID NO: 4017

SEQ ID NO: 29992 - DNA, 203 bp, Homo sapiens; identical to SEQ ID NO: 4021

SEQ ID NO: 29993 - DNA, 203 bp, Homo sapiens; identical to SEQ ID NO: 4022

SEQ ID NO: 29994 - DNA, 203 bp, Homo sapiens; identical to SEQ ID NO: 4023

SEQ ID NO: 29995 - DNA, 203 bp, Homo sapiens; identical to SEQ ID NO: 4030

SEQ ID NO: 29996 - DNA, 203 bp, Homo sapiens; identical to SEQ ID NO: 4041

SEQ ID NO: 29997 - DNA, 203 bp, Homo sapiens; identical to SEQ ID NO: 4057

SEQ ID NO: 29998 - DNA, 203 bp, Homo sapiens; identical to SEQ ID NO: 4059

SEQ ID NO: 29999 - DNA, 203 bp, Homo sapiens; identical to SEQ ID NO: 4065

SEQ ID NO: 30000 - DNA, 203 bp, Homo sapiens; identical to SEQ ID NO: 4068

SEQ ID NO: 30001 - DNA, 203 bp, Homo sapiens; identical to SEQ ID NO: 4069

SEQ ID NO: 30002 - DNA, 203 bp, Homo sapiens; identical to SEQ ID NO: 4087

SEQ ID NO: 30003 - DNA, 203 bp, Homo sapiens; identical to SEQ ID NO: 4093

SEQ ID NO: 30004 - DNA, 203 bp, Homo sapiens; identical to SEQ ID NO: 4097

SEQ ID NO: 30005 - DNA, 203 bp, Homo sapiens; identical to SEQ ID NO: 4101

SEQ ID NO: 30006 - DNA, 203 bp, Homo sapiens; identical to SEQ ID NO: 4108

SEQ ID NO: 30007 - DNA, 203 bp, Homo sapiens; identical to SEQ ID NO: 4109

SEQ ID NO: 30008 - DNA, 203 bp, Homo sapiens; identical to SEQ ID NO: 4113

SEQ ID NO: 30009 - DNA, 203 bp, Homo sapiens; identical to SEQ ID NO: 4115

SEQ ID NO: 30010 - DNA, 203 bp, Homo sapiens; identical to SEQ ID NO: 4116

SEQ ID NO: 30011 - DNA, 203 bp, Homo sapiens; identical to SEQ ID NO: 4127

SEQ ID NO: 30012 - DNA, 203 bp, Homo sapiens; identical to SEQ ID NO: 4131

SEQ ID NO: 30013 - DNA, 203 bp, Homo sapiens; identical to SEQ ID NO: 4149

SEQ ID NO: 30014 - DNA, 203 bp, Homo sapiens; identical to SEQ ID NO: 4151

SEQ ID NO: 30015 - DNA, 203 bp, Homo sapiens; identical to SEQ ID NO: 4152

SEQ ID NO: 30016 - DNA, 203 bp, Homo sapiens; identical to SEQ ID NO: 4155

SEQ ID NO: 30017 - DNA, 203 bp, Homo sapiens; identical to SEQ ID NO: 4156

SEQ ID NO: 30018 - DNA, 203 bp, Homo sapiens; identical to SEQ ID NO: 4157

SEQ ID NO: 30019 - DNA, 203 bp, Homo sapiens; identical to SEQ ID NO: 4164

SEQ ID NO: 30020 - DNA, 203 bp, Homo sapiens; identical to SEQ ID NO: 4169

SEQ ID NO: 30021 - DNA, 203 bp, Homo sapiens; identical to SEQ ID NO: 4171

SEQ ID NO: 30022 - DNA, 203 bp, Homo sapiens; identical to SEQ ID NO: 4172

SEQ ID NO: 30023 - DNA, 203 bp, Homo sapiens; identical to SEQ ID NO: 4176

SEQ ID NO: 30024 - DNA, 203 bp, Homo sapiens; identical to SEQ ID NO: 4179

SEQ ID NO: 30025 - DNA, 203 bp, Homo sapiens; identical to SEQ ID NO: 4189

SEQ ID NO: 30026 - DNA, 203 bp, Homo sapiens; identical to SEQ ID NO: 4190

SEQ ID NO: 30027 - DNA, 203 bp, Homo sapiens; identical to SEQ ID NO: 4205

SEQ ID NO: 30028 - DNA, 203 bp, Homo sapiens; identical to SEQ ID NO: 4210

SEQ ID NO: 30029 - DNA, 203 bp, Homo sapiens; identical to SEQ ID NO: 4211

SEQ ID NO: 30030 - DNA, 203 bp, Homo sapiens; identical to SEQ ID NO: 4234

SEQ ID NO: 30031 - DNA, 203 bp, Homo sapiens; identical to SEQ ID NO: 4237

SEQ ID NO: 30032 - DNA, 203 bp, Homo sapiens; identical to SEQ ID NO: 4245

SEQ ID NO: 30033 - DNA, 203 bp, Homo sapiens; identical to SEQ ID NO: 4262

SEQ ID NO: 30034 - DNA, 203 bp, Homo sapiens; identical to SEQ ID NO: 4264

SEQ ID NO: 30035 - DNA, 203 bp, Homo sapiens; identical to SEQ ID NO: 4265

SEQ ID NO: 30036 - DNA, 203 bp, Homo sapiens; identical to SEQ ID NO: 4269

SEQ ID NO: 30037 - DNA, 203 bp, Homo sapiens; identical to SEQ ID NO: 4272

SEQ ID NO: 30038 - DNA, 203 bp, Homo sapiens; identical to SEQ ID NO: 4306

SEQ ID NO: 30039 - DNA, 203 bp, Homo sapiens; identical to SEQ ID NO: 4311

SEQ ID NO: 30040 - DNA, 203 bp, Homo sapiens; identical to SEQ ID NO: 4315

SEQ ID NO: 30041 - DNA, 203 bp, Homo sapiens; identical to SEQ ID NO: 4325

SEQ ID NO: 30042 - DNA, 203 bp, Homo sapiens; identical to SEQ ID NO: 4328

SEQ ID NO: 30043 - DNA, 203 bp, Homo sapiens; identical to SEQ ID NO: 4329

SEQ ID NO: 30044 - DNA, 203 bp, Homo sapiens; identical to SEQ ID NO: 4333

SEQ ID NO: 30045 - DNA, 203 bp, Homo sapiens; identical to SEQ ID NO: 4334

SEQ ID NO: 30046 - DNA, 203 bp, Homo sapiens; identical to SEQ ID NO: 4337

SEQ ID NO: 30047 - DNA, 203 bp, Homo sapiens; identical to SEQ ID NO: 4348

SEQ ID NO: 30048 - DNA, 203 bp, Homo sapiens; identical to SEQ ID NO: 4351

SEQ ID NO: 30049 - DNA, 203 bp, Homo sapiens; identical to SEQ ID NO: 4352

SEQ ID NO: 30050 - DNA, 203 bp, Homo sapiens; identical to SEQ ID NO: 4363

SEQ ID NO: 30051 - DNA, 203 bp, Homo sapiens; identical to SEQ ID NO: 4366

SEQ ID NO: 30052 - DNA, 203 bp, Homo sapiens; identical to SEQ ID NO: 4373

SEQ ID NO: 30053 - DNA, 203 bp, Homo sapiens; identical to SEQ ID NO: 4377

SEQ ID NO: 30054 - DNA, 203 bp, Homo sapiens; identical to SEQ ID NO: 4379

SEQ ID NO: 30055 - DNA, 203 bp, Homo sapiens; identical to SEQ ID NO: 4385

SEQ ID NO: 30056 - DNA, 203 bp, Homo sapiens; identical to SEQ ID NO: 4390

SEQ ID NO: 30057 - DNA, 203 bp, Homo sapiens; identical to SEQ ID NO: 4405

SEQ ID NO: 30058 - DNA, 203 bp, Homo sapiens; identical to SEQ ID NO: 4411

SEQ ID NO: 30059 - DNA, 203 bp, Homo sapiens; identical to SEQ ID NO: 4412

SEQ ID NO: 30060 - DNA, 203 bp, Homo sapiens; identical to SEQ ID NO: 4418

SEQ ID NO: 30061 - DNA, 203 bp, Homo sapiens; identical to SEQ ID NO: 4422

SEQ ID NO: 30062 - DNA, 203 bp, Homo sapiens; identical to SEQ ID NO: 4425

SEQ ID NO: 30063 - DNA, 203 bp, Homo sapiens; identical to SEQ ID NO: 4454

SEQ ID NO: 30064 - DNA, 203 bp, Homo sapiens; identical to SEQ ID NO: 4461

SEQ ID NO: 30065 - DNA, 203 bp, Homo sapiens; identical to SEQ ID NO: 4473

SEQ ID NO: 30066 - DNA, 203 bp, Homo sapiens; identical to SEQ ID NO: 4476

SEQ ID NO: 30067 - DNA, 203 bp, Homo sapiens; identical to SEQ ID NO: 4477

SEQ ID NO: 30068 - DNA, 203 bp, Homo sapiens; identical to SEQ ID NO: 4482

SEQ ID NO: 30069 - DNA, 203 bp, Homo sapiens; identical to SEQ ID NO: 4491

SEQ ID NO: 30070 - DNA, 203 bp, Homo sapiens; identical to SEQ ID NO: 4492

SEQ ID NO: 30071 - DNA, 203 bp, Homo sapiens; identical to SEQ ID NO: 4496

SEQ ID NO: 30072 - DNA, 203 bp, Homo sapiens; identical to SEQ ID NO: 4502

SEQ ID NO: 30073 - DNA, 203 bp, Homo sapiens; identical to SEQ ID NO: 4514

SEQ ID NO: 30074 - DNA, 203 bp, Homo sapiens; identical to SEQ ID NO: 4517

SEQ ID NO: 30075 - DNA, 203 bp, Homo sapiens; identical to SEQ ID NO: 4518

SEQ ID NO: 30076 - DNA, 203 bp, Homo sapiens; identical to SEQ ID NO: 4519

SEQ ID NO: 30077 - DNA, 203 bp, Homo sapiens; identical to SEQ ID NO: 4520

SEQ ID NO: 30078 - DNA, 203 bp, Homo sapiens; identical to SEQ ID NO: 4521

SEQ ID NO: 30079 - DNA, 203 bp, Homo sapiens; identical to SEQ ID NO: 4522

SEQ ID NO: 30080 - DNA, 203 bp, Homo sapiens; identical to SEQ ID NO: 4523

SEQ ID NO: 30081 - DNA, 203 bp, Homo sapiens; identical to SEQ ID NO: 4524

SEQ ID NO: 30082 - DNA, 203 bp, Homo sapiens; identical to SEQ ID NO: 4525

SEQ ID NO: 30083 - DNA, 203 bp, Homo sapiens; identical to SEQ ID NO: 4526

SEQ ID NO: 30084 - DNA, 203 bp, Homo sapiens; identical to SEQ ID NO: 4527

SEQ ID NO: 30085 - DNA, 203 bp, Homo sapiens; identical to SEQ ID NO: 4528

SEQ ID NO: 30086 - DNA, 203 bp, Homo sapiens; identical to SEQ ID NO: 4529

SEQ ID NO: 30087 - DNA, 203 bp, Homo sapiens; identical to SEQ ID NO: 4530

SEQ ID NO: 30088 - DNA, 203 bp, Homo sapiens; identical to SEQ ID NO: 4531

SEQ ID NO: 30089 - DNA, 203 bp, Homo sapiens; identical to SEQ ID NO: 4532

SEQ ID NO: 30090 - DNA, 203 bp, Homo sapiens; identical to SEQ ID NO: 4533

SEQ ID NO: 30091 - DNA, 203 bp, Homo sapiens; identical to SEQ ID NO: 4534

SEQ ID NO: 30092 - DNA, 203 bp, Homo sapiens; identical to SEQ ID NO: 4572

SEQ ID NO: 30093 - DNA, 203 bp, Homo sapiens; identical to SEQ ID NO: 4628

SEQ ID NO: 30094 - DNA, 203 bp, Homo sapiens; identical to SEQ ID NO: 4629

SEQ ID NO: 30095 - DNA, 203 bp, Homo sapiens; identical to SEQ ID NO: 4634

SEQ ID NO: 30096 - DNA, 203 bp, Homo sapiens; identical to SEQ ID NO: 4637

SEQ ID NO: 30097 - DNA, 203 bp, Homo sapiens; identical to SEQ ID NO: 4644

SEQ ID NO: 30098 - DNA, 203 bp, Homo sapiens; identical to SEQ ID NO: 4650

SEQ ID NO: 30099 - DNA, 203 bp, Homo sapiens; identical to SEQ ID NO: 4655

SEQ ID NO: 30100 - DNA, 203 bp, Homo sapiens; identical to SEQ ID NO: 4659

SEQ ID NO: 30101 - DNA, 203 bp, Homo sapiens; identical to SEQ ID NO: 4690

SEQ ID NO: 30102 - DNA, 203 bp, Homo sapiens; identical to SEQ ID NO: 4691

SEQ ID NO: 30103 - DNA, 203 bp, Homo sapiens; identical to SEQ ID NO: 4692

SEQ ID NO: 30104 - DNA, 203 bp, Homo sapiens; identical to SEQ ID NO: 4693

SEQ ID NO: 30105 - DNA, 203 bp, Homo sapiens; identical to SEQ ID NO: 4694

SEQ ID NO: 30106 - DNA, 203 bp, Homo sapiens; identical to SEQ ID NO: 4695

SEQ ID NO: 30107 - DNA, 203 bp, Homo sapiens; identical to SEQ ID NO: 4696

SEQ ID NO: 30108 - DNA, 203 bp, Homo sapiens; identical to SEQ ID NO: 4697

SEQ ID NO: 30109 - DNA, 203 bp, Homo sapiens; identical to SEQ ID NO: 4698

SEQ ID NO: 30110 - DNA, 203 bp, Homo sapiens; identical to SEQ ID NO: 4699

SEQ ID NO: 30111 - DNA, 203 bp, Homo sapiens; identical to SEQ ID NO: 4700

SEQ ID NO: 30112 - DNA, 203 bp, Homo sapiens; identical to SEQ ID NO: 4707

SEQ ID NO: 30113 - DNA, 203 bp, Homo sapiens; identical to SEQ ID NO: 4708

SEQ ID NO: 30114 - DNA, 203 bp, Homo sapiens; identical to SEQ ID NO: 4709

SEQ ID NO: 30115 - DNA, 203 bp, Homo sapiens; identical to SEQ ID NO: 4710

SEQ ID NO: 30116 - DNA, 203 bp, Homo sapiens; identical to SEQ ID NO: 4711

SEQ ID NO: 30117 - DNA, 203 bp, Homo sapiens; identical to SEQ ID NO: 4712

SEQ ID NO: 30118 - DNA, 203 bp, Homo sapiens; identical to SEQ ID NO: 4719

SEQ ID NO: 30119 - DNA, 203 bp, Homo sapiens; identical to SEQ ID NO: 4720

SEQ ID NO: 30120 - DNA, 203 bp, Homo sapiens; identical to SEQ ID NO: 4721

SEQ ID NO: 30121 - DNA, 203 bp, Homo sapiens; identical to SEQ ID NO: 4722

SEQ ID NO: 30122 - DNA, 203 bp, Homo sapiens; identical to SEQ ID NO: 4732

SEQ ID NO: 30123 - DNA, 203 bp, Homo sapiens; identical to SEQ ID NO: 4741

SEQ ID NO: 30124 - DNA, 203 bp, Homo sapiens; identical to SEQ ID NO: 4743

SEQ ID NO: 30125 - DNA, 203 bp, Homo sapiens; identical to SEQ ID NO: 4749

SEQ ID NO: 30126 - DNA, 203 bp, Homo sapiens; identical to SEQ ID NO: 4750

SEQ ID NO: 30127 - DNA, 203 bp, Homo sapiens; identical to SEQ ID NO: 4751

SEQ ID NO: 30128 - DNA, 203 bp, Homo sapiens; identical to SEQ ID NO: 4752

SEQ ID NO: 30129 - DNA, 203 bp, Homo sapiens; identical to SEQ ID NO: 4758

SEQ ID NO: 30130 - DNA, 203 bp, Homo sapiens; identical to SEQ ID NO: 4759

SEQ ID NO: 30131 - DNA, 203 bp, Homo sapiens; identical to SEQ ID NO: 4760

SEQ ID NO: 30132 - DNA, 203 bp, Homo sapiens; identical to SEQ ID NO: 4761

SEQ ID NO: 30133 - DNA, 203 bp, Homo sapiens; identical to SEQ ID NO: 4762

SEQ ID NO: 30134 - DNA, 203 bp, Homo sapiens; identical to SEQ ID NO: 4763

SEQ ID NO: 30135 - DNA, 203 bp, Homo sapiens; identical to SEQ ID NO: 4771

SEQ ID NO: 30136 - DNA, 203 bp, Homo sapiens; identical to SEQ ID NO: 4772

SEQ ID NO: 30137 - DNA, 203 bp, Homo sapiens; identical to SEQ ID NO: 4773

SEQ ID NO: 30138 - DNA, 203 bp, Homo sapiens; identical to SEQ ID NO: 4774

SEQ ID NO: 30139 - DNA, 203 bp, Homo sapiens; identical to SEQ ID NO: 4775

SEQ ID NO: 30140 - DNA, 203 bp, Homo sapiens; identical to SEQ ID NO: 4778

SEQ ID NO: 30141 - DNA, 203 bp, Homo sapiens; identical to SEQ ID NO: 4789

SEQ ID NO: 30142 - DNA, 203 bp, Homo sapiens; identical to SEQ ID NO: 4790

SEQ ID NO: 30143 - DNA, 203 bp, Homo sapiens; identical to SEQ ID NO: 4803

SEQ ID NO: 30144 - DNA, 203 bp, Homo sapiens; identical to SEQ ID NO: 4804

SEQ ID NO: 30145 - DNA, 203 bp, Homo sapiens; identical to SEQ ID NO: 4813

SEQ ID NO: 30146 - DNA, 203 bp, Homo sapiens; identical to SEQ ID NO: 4814

SEQ ID NO: 30147 - DNA, 203 bp, Homo sapiens; identical to SEQ ID NO: 4815

SEQ ID NO: 30148 - DNA, 203 bp, Homo sapiens; identical to SEQ ID NO: 4816

SEQ ID NO: 30149 - DNA, 203 bp, Homo sapiens; identical to SEQ ID NO: 4817

SEQ ID NO: 30150 - DNA, 203 bp, Homo sapiens; identical to SEQ ID NO: 4819

SEQ ID NO: 30151 - DNA, 203 bp, Homo sapiens; identical to SEQ ID NO: 4828

SEQ ID NO: 30152 - DNA, 203 bp, Homo sapiens; identical to SEQ ID NO: 4829

SEQ ID NO: 30153 - DNA, 203 bp, Homo sapiens; identical to SEQ ID NO: 4830

SEQ ID NO: 30154 - DNA, 203 bp, Homo sapiens; identical to SEQ ID NO: 4831

SEQ ID NO: 30155 - DNA, 203 bp, Homo sapiens; identical to SEQ ID NO: 4832

SEQ ID NO: 30156 - DNA, 203 bp, Homo sapiens; identical to SEQ ID NO: 4833

SEQ ID NO: 30157 - DNA, 203 bp, Homo sapiens; identical to SEQ ID NO: 4834

SEQ ID NO: 30158 - DNA, 203 bp, Homo sapiens; identical to SEQ ID NO: 4835

SEQ ID NO: 30159 - DNA, 203 bp, Homo sapiens; identical to SEQ ID NO: 4836

SEQ ID NO: 30160 - DNA, 203 bp, Homo sapiens; identical to SEQ ID NO: 4837

SEQ ID NO: 30161 - DNA, 203 bp, Homo sapiens; identical to SEQ ID NO: 4838

SEQ ID NO: 30162 - DNA, 203 bp, Homo sapiens; identical to SEQ ID NO: 4839

SEQ ID NO: 30163 - DNA, 203 bp, Homo sapiens; identical to SEQ ID NO: 4840

SEQ ID NO: 30164 - DNA, 203 bp, Homo sapiens; identical to SEQ ID NO: 4841

SEQ ID NO: 30165 - DNA, 203 bp, Homo sapiens; identical to SEQ ID NO: 4842

SEQ ID NO: 30166 - DNA, 203 bp, Homo sapiens; identical to SEQ ID NO: 4843

SEQ ID NO: 30167 - DNA, 203 bp, Homo sapiens; identical to SEQ ID NO: 4844

SEQ ID NO: 30168 - DNA, 203 bp, Homo sapiens; identical to SEQ ID NO: 4845

SEQ ID NO: 30169 - DNA, 203 bp, Homo sapiens; identical to SEQ ID NO: 4846

SEQ ID NO: 30170 - DNA, 203 bp, Homo sapiens; identical to SEQ ID NO: 4847

SEQ ID NO: 30171 - DNA, 203 bp, Homo sapiens; identical to SEQ ID NO: 4848

SEQ ID NO: 30172 - DNA, 203 bp, Homo sapiens; identical to SEQ ID NO: 4849

SEQ ID NO: 30173 - DNA, 203 bp, Homo sapiens; identical to SEQ ID NO: 4850

SEQ ID NO: 30174 - DNA, 203 bp, Homo sapiens; identical to SEQ ID NO: 4851

SEQ ID NO: 30175 - DNA, 203 bp, Homo sapiens; identical to SEQ ID NO: 4852

SEQ ID NO: 30176 - DNA, 203 bp, Homo sapiens; identical to SEQ ID NO: 4862

SEQ ID NO: 30177 - DNA, 203 bp, Homo sapiens; identical to SEQ ID NO: 4893

SEQ ID NO: 30178 - DNA, 203 bp, Homo sapiens; identical to SEQ ID NO: 4903

SEQ ID NO: 30179 - DNA, 203 bp, Homo sapiens; identical to SEQ ID NO: 4904

SEQ ID NO: 30180 - DNA, 203 bp, Homo sapiens; identical to SEQ ID NO: 4905

SEQ ID NO: 30181 - DNA, 203 bp, Homo sapiens; identical to SEQ ID NO: 4906

SEQ ID NO: 30182 - DNA, 203 bp, Homo sapiens; identical to SEQ ID NO: 4907

SEQ ID NO: 30183 - DNA, 203 bp, Homo sapiens; identical to SEQ ID NO: 4917

SEQ ID NO: 30184 - DNA, 203 bp, Homo sapiens; identical to SEQ ID NO: 4932

SEQ ID NO: 30185 - DNA, 203 bp, Homo sapiens; identical to SEQ ID NO: 4933

SEQ ID NO: 30186 - DNA, 203 bp, Homo sapiens; identical to SEQ ID NO: 4934

SEQ ID NO: 30187 - DNA, 203 bp, Homo sapiens; identical to SEQ ID NO: 4935

SEQ ID NO: 30188 - DNA, 203 bp, Homo sapiens; identical to SEQ ID NO: 4937

SEQ ID NO: 30189 - DNA, 203 bp, Homo sapiens; identical to SEQ ID NO: 4948

SEQ ID NO: 30190 - DNA, 203 bp, Homo sapiens; identical to SEQ ID NO: 4949

SEQ ID NO: 30191 - DNA, 203 bp, Homo sapiens; identical to SEQ ID NO: 4950

SEQ ID NO: 30192 - DNA, 203 bp, Homo sapiens; identical to SEQ ID NO: 4951

SEQ ID NO: 30193 - DNA, 203 bp, Homo sapiens; identical to SEQ ID NO: 4952

SEQ ID NO: 30194 - DNA, 203 bp, Homo sapiens; identical to SEQ ID NO: 4953

SEQ ID NO: 30195 - DNA, 203 bp, Homo sapiens; identical to SEQ ID NO: 4954

SEQ ID NO: 30196 - DNA, 203 bp, Homo sapiens; identical to SEQ ID NO: 4955

SEQ ID NO: 30197 - DNA, 203 bp, Homo sapiens; identical to SEQ ID NO: 4956

SEQ ID NO: 30198 - DNA, 203 bp, Homo sapiens; identical to SEQ ID NO: 4957

SEQ ID NO: 30199 - DNA, 203 bp, Homo sapiens; identical to SEQ ID NO: 4958

SEQ ID NO: 30200 - DNA, 203 bp, Homo sapiens; identical to SEQ ID NO: 4959

SEQ ID NO: 30201 - DNA, 203 bp, Homo sapiens; identical to SEQ ID NO: 4960

SEQ ID NO: 30202 - DNA, 203 bp, Homo sapiens; identical to SEQ ID NO: 4961

SEQ ID NO: 30203 - DNA, 203 bp, Homo sapiens; identical to SEQ ID NO: 4963

SEQ ID NO: 30204 - DNA, 203 bp, Homo sapiens; identical to SEQ ID NO: 4964

SEQ ID NO: 30205 - DNA, 203 bp, Homo sapiens; identical to SEQ ID NO: 4965

SEQ ID NO: 30206 - DNA, 203 bp, Homo sapiens; identical to SEQ ID NO: 4966

SEQ ID NO: 30207 - DNA, 203 bp, Homo sapiens; identical to SEQ ID NO: 4967

SEQ ID NO: 30208 - DNA, 203 bp, Homo sapiens; identical to SEQ ID NO: 4968

SEQ ID NO: 30209 - DNA, 203 bp, Homo sapiens; identical to SEQ ID NO: 4969

SEQ ID NO: 30210 - DNA, 203 bp, Homo sapiens; identical to SEQ ID NO: 4970

SEQ ID NO: 30211 - DNA, 203 bp, Homo sapiens; identical to SEQ ID NO: 4971

SEQ ID NO: 30212 - DNA, 203 bp, Homo sapiens; identical to SEQ ID NO: 4972

SEQ ID NO: 30213 - DNA, 203 bp, Homo sapiens; identical to SEQ ID NO: 4973

SEQ ID NO: 30214 - DNA, 203 bp, Homo sapiens; identical to SEQ ID NO: 4974

SEQ ID NO: 30215 - DNA, 203 bp, Homo sapiens; identical to SEQ ID NO: 4975

SEQ ID NO: 30216 - DNA, 203 bp, Homo sapiens; identical to SEQ ID NO: 4976

SEQ ID NO: 30217 - DNA, 203 bp, Homo sapiens; identical to SEQ ID NO: 4977

SEQ ID NO: 30218 - DNA, 203 bp, Homo sapiens; identical to SEQ ID NO: 4978

SEQ ID NO: 30219 - DNA, 203 bp, Homo sapiens; identical to SEQ ID NO: 4979

SEQ ID NO: 30220 - DNA, 203 bp, Homo sapiens; identical to SEQ ID NO: 4980

SEQ ID NO: 30221 - DNA, 203 bp, Homo sapiens; identical to SEQ ID NO: 4981

SEQ ID NO: 30222 - DNA, 203 bp, Homo sapiens; identical to SEQ ID NO: 5012

SEQ ID NO: 30223 - DNA, 203 bp, Homo sapiens; identical to SEQ ID NO: 5037

SEQ ID NO: 30224 - DNA, 203 bp, Homo sapiens; identical to SEQ ID NO: 5048

SEQ ID NO: 30225 - DNA, 203 bp, Homo sapiens; identical to SEQ ID NO: 5052

SEQ ID NO: 30226 - DNA, 203 bp, Homo sapiens; identical to SEQ ID NO: 5053

SEQ ID NO: 30227 - DNA, 203 bp, Homo sapiens; identical to SEQ ID NO: 5054

SEQ ID NO: 30228 - DNA, 203 bp, Homo sapiens; identical to SEQ ID NO: 5055

SEQ ID NO: 30229 - DNA, 203 bp, Homo sapiens; identical to SEQ ID NO: 5056

SEQ ID NO: 30230 - DNA, 203 bp, Homo sapiens; identical to SEQ ID NO: 5057

SEQ ID NO: 30231 - DNA, 203 bp, Homo sapiens; identical to SEQ ID NO: 5058

SEQ ID NO: 30232 - DNA, 203 bp, Homo sapiens; identical to SEQ ID NO: 5059

SEQ ID NO: 30233 - DNA, 203 bp, Homo sapiens; identical to SEQ ID NO: 5060

SEQ ID NO: 30234 - DNA, 203 bp, Homo sapiens; identical to SEQ ID NO: 5066

SEQ ID NO: 30235 - DNA, 203 bp, Homo sapiens; identical to SEQ ID NO: 5067

SEQ ID NO: 30236 - DNA, 203 bp, Homo sapiens; identical to SEQ ID NO: 5068

SEQ ID NO: 30237 - DNA, 203 bp, Homo sapiens; identical to SEQ ID NO: 5069

SEQ ID NO: 30238 - DNA, 203 bp, Homo sapiens; identical to SEQ ID NO: 5084

SEQ ID NO: 30239 - DNA, 203 bp, Homo sapiens; identical to SEQ ID NO: 5092

SEQ ID NO: 30240 - DNA, 203 bp, Homo sapiens; identical to SEQ ID NO: 5093

SEQ ID NO: 30241 - DNA, 203 bp, Homo sapiens; identical to SEQ ID NO: 5094

SEQ ID NO: 30242 - DNA, 203 bp, Homo sapiens; identical to SEQ ID NO: 5095

SEQ ID NO: 30243 - DNA, 203 bp, Homo sapiens; identical to SEQ ID NO: 5101

SEQ ID NO: 30244 - DNA, 203 bp, Homo sapiens; identical to SEQ ID NO: 5102

SEQ ID NO: 30245 - DNA, 203 bp, Homo sapiens; identical to SEQ ID NO: 5103

SEQ ID NO: 30246 - DNA, 203 bp, Homo sapiens; identical to SEQ ID NO: 5106

SEQ ID NO: 30247 - DNA, 203 bp, Homo sapiens; identical to SEQ ID NO: 5107

SEQ ID NO: 30248 - DNA, 203 bp, Homo sapiens; identical to SEQ ID NO: 5108

SEQ ID NO: 30249 - DNA, 203 bp, Homo sapiens; identical to SEQ ID NO: 5109

SEQ ID NO: 30250 - DNA, 203 bp, Homo sapiens; identical to SEQ ID NO: 5110

SEQ ID NO: 30251 - DNA, 203 bp, Homo sapiens; identical to SEQ ID NO: 5111

SEQ ID NO: 30252 - DNA, 203 bp, Homo sapiens; identical to SEQ ID NO: 5133

SEQ ID NO: 30253 - DNA, 203 bp, Homo sapiens; identical to SEQ ID NO: 5135

SEQ ID NO: 30254 - DNA, 203 bp, Homo sapiens; identical to SEQ ID NO: 5139

SEQ ID NO: 30255 - DNA, 203 bp, Homo sapiens; identical to SEQ ID NO: 5143

SEQ ID NO: 30256 - DNA, 203 bp, Homo sapiens; identical to SEQ ID NO: 5156

SEQ ID NO: 30257 - DNA, 203 bp, Homo sapiens; identical to SEQ ID NO: 5157

SEQ ID NO: 30258 - DNA, 203 bp, Homo sapiens; identical to SEQ ID NO: 5158

SEQ ID NO: 30259 - DNA, 203 bp, Homo sapiens; identical to SEQ ID NO: 5159

SEQ ID NO: 30260 - DNA, 203 bp, Homo sapiens; identical to SEQ ID NO: 5160

SEQ ID NO: 30261 - DNA, 203 bp, Homo sapiens; identical to SEQ ID NO: 5199

SEQ ID NO: 30262 - DNA, 203 bp, Homo sapiens; identical to SEQ ID NO: 5200

SEQ ID NO: 30263 - DNA, 203 bp, Homo sapiens; identical to SEQ ID NO: 5211

SEQ ID NO: 30264 - DNA, 203 bp, Homo sapiens; identical to SEQ ID NO: 5234

SEQ ID NO: 30265 - DNA, 203 bp, Homo sapiens; identical to SEQ ID NO: 5254

SEQ ID NO: 30266 - DNA, 203 bp, Homo sapiens; identical to SEQ ID NO: 5260

SEQ ID NO: 30267 - DNA, 203 bp, Homo sapiens; identical to SEQ ID NO: 5262

SEQ ID NO: 30268 - DNA, 203 bp, Homo sapiens; identical to SEQ ID NO: 5263

SEQ ID NO: 30269 - DNA, 203 bp, Homo sapiens; identical to SEQ ID NO: 5266

SEQ ID NO: 30270 - DNA, 203 bp, Homo sapiens; identical to SEQ ID NO: 5271

SEQ ID NO: 30271 - DNA, 203 bp, Homo sapiens; identical to SEQ ID NO: 5272

SEQ ID NO: 30272 - DNA, 203 bp, Homo sapiens; identical to SEQ ID NO: 5273

SEQ ID NO: 30273 - DNA, 203 bp, Homo sapiens; identical to SEQ ID NO: 5283

SEQ ID NO: 30274 - DNA, 203 bp, Homo sapiens; identical to SEQ ID NO: 5284

SEQ ID NO: 30275 - DNA, 203 bp, Homo sapiens; identical to SEQ ID NO: 5285

SEQ ID NO: 30276 - DNA, 203 bp, Homo sapiens; identical to SEQ ID NO: 5286

SEQ ID NO: 30277 - DNA, 203 bp, Homo sapiens; identical to SEQ ID NO: 5287

SEQ ID NO: 30278 - DNA, 203 bp, Homo sapiens; identical to SEQ ID NO: 5288

SEQ ID NO: 30279 - DNA, 203 bp, Homo sapiens; identical to SEQ ID NO: 5293

SEQ ID NO: 30280 - DNA, 203 bp, Homo sapiens; identical to SEQ ID NO: 5294

SEQ ID NO: 30281 - DNA, 203 bp, Homo sapiens; identical to SEQ ID NO: 5306

SEQ ID NO: 30282 - DNA, 203 bp, Homo sapiens; identical to SEQ ID NO: 5307

SEQ ID NO: 30283 - DNA, 203 bp, Homo sapiens; identical to SEQ ID NO: 5308

SEQ ID NO: 30284 - DNA, 203 bp, Homo sapiens; identical to SEQ ID NO: 5309

SEQ ID NO: 30285 - DNA, 203 bp, Homo sapiens; identical to SEQ ID NO: 5310

SEQ ID NO: 30286 - DNA, 203 bp, Homo sapiens; identical to SEQ ID NO: 5311

SEQ ID NO: 30287 - DNA, 203 bp, Homo sapiens; identical to SEQ ID NO: 5312

SEQ ID NO: 30288 - DNA, 203 bp, Homo sapiens; identical to SEQ ID NO: 5313

SEQ ID NO: 30289 - DNA, 203 bp, Homo sapiens; identical to SEQ ID NO: 5314

SEQ ID NO: 30290 - DNA, 203 bp, Homo sapiens; identical to SEQ ID NO: 5315

SEQ ID NO: 30291 - DNA, 203 bp, Homo sapiens; identical to SEQ ID NO: 5316

SEQ ID NO: 30292 - DNA, 203 bp, Homo sapiens; identical to SEQ ID NO: 5317

SEQ ID NO: 30293 - DNA, 203 bp, Homo sapiens; identical to SEQ ID NO: 5318

SEQ ID NO: 30294 - DNA, 203 bp, Homo sapiens; identical to SEQ ID NO: 5319

SEQ ID NO: 30295 - DNA, 203 bp, Homo sapiens; identical to SEQ ID NO: 5320

SEQ ID NO: 30296 - DNA, 203 bp, Homo sapiens; identical to SEQ ID NO: 5321

SEQ ID NO: 30297 - DNA, 203 bp, Homo sapiens; identical to SEQ ID NO: 5322

SEQ ID NO: 30298 - DNA, 203 bp, Homo sapiens; identical to SEQ ID NO: 5323

SEQ ID NO: 30299 - DNA, 203 bp, Homo sapiens; identical to SEQ ID NO: 5324

SEQ ID NO: 30300 - DNA, 203 bp, Homo sapiens; identical to SEQ ID NO: 5325

SEQ ID NO: 30301 - DNA, 203 bp, Homo sapiens; identical to SEQ ID NO: 5326

SEQ ID NO: 30302 - DNA, 203 bp, Homo sapiens; identical to SEQ ID NO: 5327

SEQ ID NO: 30303 - DNA, 203 bp, Homo sapiens; identical to SEQ ID NO: 5328

SEQ ID NO: 30304 - DNA, 203 bp, Homo sapiens; identical to SEQ ID NO: 5329

SEQ ID NO: 30305 - DNA, 203 bp, Homo sapiens; identical to SEQ ID NO: 5330

SEQ ID NO: 30306 - DNA, 203 bp, Homo sapiens; identical to SEQ ID NO: 5331

SEQ ID NO: 30307 - DNA, 203 bp, Homo sapiens; identical to SEQ ID NO: 5334

SEQ ID NO: 30308 - DNA, 203 bp, Homo sapiens; identical to SEQ ID NO: 5365

SEQ ID NO: 30309 - DNA, 203 bp, Homo sapiens; identical to SEQ ID NO: 5366

SEQ ID NO: 30310 - DNA, 203 bp, Homo sapiens; identical to SEQ ID NO: 5367

SEQ ID NO: 30311 - DNA, 203 bp, Homo sapiens; identical to SEQ ID NO: 5368

SEQ ID NO: 30312 - DNA, 203 bp, Homo sapiens; identical to SEQ ID NO: 5371

SEQ ID NO: 30313 - DNA, 203 bp, Homo sapiens; identical to SEQ ID NO: 5381

SEQ ID NO: 30314 - DNA, 203 bp, Homo sapiens; identical to SEQ ID NO: 5382

SEQ ID NO: 30315 - DNA, 203 bp, Homo sapiens; identical to SEQ ID NO: 5383

SEQ ID NO: 30316 - DNA, 203 bp, Homo sapiens; identical to SEQ ID NO: 5384

SEQ ID NO: 30317 - DNA, 203 bp, Homo sapiens; identical to SEQ ID NO: 5385

SEQ ID NO: 30318 - DNA, 203 bp, Homo sapiens; identical to SEQ ID NO: 5386

SEQ ID NO: 30319 - DNA, 203 bp, Homo sapiens; identical to SEQ ID NO: 5387

SEQ ID NO: 30320 - DNA, 203 bp, Homo sapiens; identical to SEQ ID NO: 5388

SEQ ID NO: 30321 - DNA, 203 bp, Homo sapiens; identical to SEQ ID NO: 5389

SEQ ID NO: 30322 - DNA, 203 bp, Homo sapiens; identical to SEQ ID NO: 5390

SEQ ID NO: 30323 - DNA, 203 bp, Homo sapiens; identical to SEQ ID NO: 5391

SEQ ID NO: 30324 - DNA, 203 bp, Homo sapiens; identical to SEQ ID NO: 5395

SEQ ID NO: 30325 - DNA, 203 bp, Homo sapiens; identical to SEQ ID NO: 5396

SEQ ID NO: 30326 - DNA, 203 bp, Homo sapiens; identical to SEQ ID NO: 5397

SEQ ID NO: 30327 - DNA, 203 bp, Homo sapiens; identical to SEQ ID NO: 5398

SEQ ID NO: 30328 - DNA, 203 bp, Homo sapiens; identical to SEQ ID NO: 5399

SEQ ID NO: 30329 - DNA, 203 bp, Homo sapiens; identical to SEQ ID NO: 5400

SEQ ID NO: 30330 - DNA, 203 bp, Homo sapiens; identical to SEQ ID NO: 5401

SEQ ID NO: 30331 - DNA, 203 bp, Homo sapiens; identical to SEQ ID NO: 5402

SEQ ID NO: 30332 - DNA, 203 bp, Homo sapiens; identical to SEQ ID NO: 5403

SEQ ID NO: 30333 - DNA, 203 bp, Homo sapiens; identical to SEQ ID NO: 5404

SEQ ID NO: 30334 - DNA, 203 bp, Homo sapiens; identical to SEQ ID NO: 5405

SEQ ID NO: 30335 - DNA, 203 bp, Homo sapiens; identical to SEQ ID NO: 5412

SEQ ID NO: 30336 - DNA, 203 bp, Homo sapiens; identical to SEQ ID NO: 5413

SEQ ID NO: 30337 - DNA, 203 bp, Homo sapiens; identical to SEQ ID NO: 5414

SEQ ID NO: 30338 - DNA, 203 bp, Homo sapiens; identical to SEQ ID NO: 5415

SEQ ID NO: 30339 - DNA, 203 bp, Homo sapiens; identical to SEQ ID NO: 5416

SEQ ID NO: 30340 - DNA, 203 bp, Homo sapiens; identical to SEQ ID NO: 5417

SEQ ID NO: 30341 - DNA, 203 bp, Homo sapiens; identical to SEQ ID NO: 5418

SEQ ID NO: 30342 - DNA, 203 bp, Homo sapiens; identical to SEQ ID NO: 5419

SEQ ID NO: 30343 - DNA, 203 bp, Homo sapiens; identical to SEQ ID NO: 5420

SEQ ID NO: 30344 - DNA, 203 bp, Homo sapiens; identical to SEQ ID NO: 5421

SEQ ID NO: 30345 - DNA, 203 bp, Homo sapiens; identical to SEQ ID NO: 5422

SEQ ID NO: 30346 - DNA, 203 bp, Homo sapiens; identical to SEQ ID NO: 5423

SEQ ID NO: 30347 - DNA, 203 bp, Homo sapiens; identical to SEQ ID NO: 5424

SEQ ID NO: 30348 - DNA, 203 bp, Homo sapiens; identical to SEQ ID NO: 5425

SEQ ID NO: 30349 - DNA, 203 bp, Homo sapiens; identical to SEQ ID NO: 5426

SEQ ID NO: 30350 - DNA, 203 bp, Homo sapiens; identical to SEQ ID NO: 5427

SEQ ID NO: 30351 - DNA, 203 bp, Homo sapiens; identical to SEQ ID NO: 5428

SEQ ID NO: 30352 - DNA, 203 bp, Homo sapiens; identical to SEQ ID NO: 5429

SEQ ID NO: 30353 - DNA, 203 bp, Homo sapiens; identical to SEQ ID NO: 5430

SEQ ID NO: 30354 - DNA, 203 bp, Homo sapiens; identical to SEQ ID NO: 5431

SEQ ID NO: 30355 - DNA, 203 bp, Homo sapiens; identical to SEQ ID NO: 5432

SEQ ID NO: 30356 - DNA, 203 bp, Homo sapiens; identical to SEQ ID NO: 5433

SEQ ID NO: 30357 - DNA, 203 bp, Homo sapiens; identical to SEQ ID NO: 5434

SEQ ID NO: 30358 - DNA, 203 bp, Homo sapiens; identical to SEQ ID NO: 5449

SEQ ID NO: 30359 - DNA, 203 bp, Homo sapiens; identical to SEQ ID NO: 5458

SEQ ID NO: 30360 - DNA, 203 bp, Homo sapiens; identical to SEQ ID NO: 5466

SEQ ID NO: 30361 - DNA, 203 bp, Homo sapiens; identical to SEQ ID NO: 5467

SEQ ID NO: 30362 - DNA, 203 bp, Homo sapiens; identical to SEQ ID NO: 5468

SEQ ID NO: 30363 - DNA, 203 bp, Homo sapiens; identical to SEQ ID NO: 5469

SEQ ID NO: 30364 - DNA, 203 bp, Homo sapiens; identical to SEQ ID NO: 5470

SEQ ID NO: 30365 - DNA, 203 bp, Homo sapiens; identical to SEQ ID NO: 5471

SEQ ID NO: 30366 - DNA, 203 bp, Homo sapiens; identical to SEQ ID NO: 5481

SEQ ID NO: 30367 - DNA, 203 bp, Homo sapiens; identical to SEQ ID NO: 5482

SEQ ID NO: 30368 - DNA, 203 bp, Homo sapiens; identical to SEQ ID NO: 5483

SEQ ID NO: 30369 - DNA, 203 bp, Homo sapiens; identical to SEQ ID NO: 5484

SEQ ID NO: 30370 - DNA, 203 bp, Homo sapiens; identical to SEQ ID NO: 5485

SEQ ID NO: 30371 - DNA, 203 bp, Homo sapiens; identical to SEQ ID NO: 5486

SEQ ID NO: 30372 - DNA, 203 bp, Homo sapiens; identical to SEQ ID NO: 5487

SEQ ID NO: 30373 - DNA, 203 bp, Homo sapiens; identical to SEQ ID NO: 5488

SEQ ID NO: 30374 - DNA, 203 bp, Homo sapiens; identical to SEQ ID NO: 5489

SEQ ID NO: 30375 - DNA, 203 bp, Homo sapiens; identical to SEQ ID NO: 5490

SEQ ID NO: 30376 - DNA, 203 bp, Homo sapiens; identical to SEQ ID NO: 5491

SEQ ID NO: 30377 - DNA, 203 bp, Homo sapiens; identical to SEQ ID NO: 5492

SEQ ID NO: 30378 - DNA, 203 bp, Homo sapiens; identical to SEQ ID NO: 5493

SEQ ID NO: 30379 - DNA, 203 bp, Homo sapiens; identical to SEQ ID NO: 5510

SEQ ID NO: 30380 - DNA, 203 bp, Homo sapiens; identical to SEQ ID NO: 5511

SEQ ID NO: 30381 - DNA, 203 bp, Homo sapiens; identical to SEQ ID NO: 5512

SEQ ID NO: 30382 - DNA, 203 bp, Homo sapiens; identical to SEQ ID NO: 5515

SEQ ID NO: 30383 - DNA, 203 bp, Homo sapiens; identical to SEQ ID NO: 5516

SEQ ID NO: 30384 - DNA, 203 bp, Homo sapiens; identical to SEQ ID NO: 5517

SEQ ID NO: 30385 - DNA, 203 bp, Homo sapiens; identical to SEQ ID NO: 5518

SEQ ID NO: 30386 - DNA, 203 bp, Homo sapiens; identical to SEQ ID NO: 5519

SEQ ID NO: 30387 - DNA, 203 bp, Homo sapiens; identical to SEQ ID NO: 5544

SEQ ID NO: 30388 - DNA, 203 bp, Homo sapiens; identical to SEQ ID NO: 5550

SEQ ID NO: 30389 - DNA, 203 bp, Homo sapiens; identical to SEQ ID NO: 5552

SEQ ID NO: 30390 - DNA, 203 bp, Homo sapiens; identical to SEQ ID NO: 5556

SEQ ID NO: 30391 - DNA, 203 bp, Homo sapiens; identical to SEQ ID NO: 5557

SEQ ID NO: 30392 - DNA, 203 bp, Homo sapiens; identical to SEQ ID NO: 5558

SEQ ID NO: 30393 - DNA, 203 bp, Homo sapiens; identical to SEQ ID NO: 5568

SEQ ID NO: 30394 - DNA, 203 bp, Homo sapiens; identical to SEQ ID NO: 5569

SEQ ID NO: 30395 - DNA, 203 bp, Homo sapiens; identical to SEQ ID NO: 5570

SEQ ID NO: 30396 - DNA, 203 bp, Homo sapiens; identical to SEQ ID NO: 5571

SEQ ID NO: 30397 - DNA, 203 bp, Homo sapiens; identical to SEQ ID NO: 5572

SEQ ID NO: 30398 - DNA, 203 bp, Homo sapiens; identical to SEQ ID NO: 5573

SEQ ID NO: 30399 - DNA, 203 bp, Homo sapiens; identical to SEQ ID NO: 5574

SEQ ID NO: 30400 - DNA, 203 bp, Homo sapiens; identical to SEQ ID NO: 5575

SEQ ID NO: 30401 - DNA, 203 bp, Homo sapiens; identical to SEQ ID NO: 5576

SEQ ID NO: 30402 - DNA, 203 bp, Homo sapiens; identical to SEQ ID NO: 5577

SEQ ID NO: 30403 - DNA, 203 bp, Homo sapiens; identical to SEQ ID NO: 5578

SEQ ID NO: 30404 - DNA, 203 bp, Homo sapiens; identical to SEQ ID NO: 5579

SEQ ID NO: 30405 - DNA, 203 bp, Homo sapiens; identical to SEQ ID NO: 5580

SEQ ID NO: 30406 - DNA, 203 bp, Homo sapiens; identical to SEQ ID NO: 5581

SEQ ID NO: 30407 - DNA, 203 bp, Homo sapiens; identical to SEQ ID NO: 5582

SEQ ID NO: 30408 - DNA, 203 bp, Homo sapiens; identical to SEQ ID NO: 5583

SEQ ID NO: 30409 - DNA, 203 bp, Homo sapiens; identical to SEQ ID NO: 5584

SEQ ID NO: 30410 - DNA, 203 bp, Homo sapiens; identical to SEQ ID NO: 5592

SEQ ID NO: 30411 - DNA, 203 bp, Homo sapiens; identical to SEQ ID NO: 5593

SEQ ID NO: 30412 - DNA, 203 bp, Homo sapiens; identical to SEQ ID NO: 5594

SEQ ID NO: 30413 - DNA, 203 bp, Homo sapiens; identical to SEQ ID NO: 5595

SEQ ID NO: 30414 - DNA, 203 bp, Homo sapiens; identical to SEQ ID NO: 5596

SEQ ID NO: 30415 - DNA, 203 bp, Homo sapiens; identical to SEQ ID NO: 5597

SEQ ID NO: 30416 - DNA, 203 bp, Homo sapiens; identical to SEQ ID NO: 5598

SEQ ID NO: 30417 - DNA, 203 bp, Homo sapiens; identical to SEQ ID NO: 5599

SEQ ID NO: 30418 - DNA, 203 bp, Homo sapiens; identical to SEQ ID NO: 5603

SEQ ID NO: 30419 - DNA, 203 bp, Homo sapiens; identical to SEQ ID NO: 5607

SEQ ID NO: 30420 - DNA, 203 bp, Homo sapiens; identical to SEQ ID NO: 5608

SEQ ID NO: 30421 - DNA, 203 bp, Homo sapiens; identical to SEQ ID NO: 5613

SEQ ID NO: 30422 - DNA, 203 bp, Homo sapiens; identical to SEQ ID NO: 5614

SEQ ID NO: 30423 - DNA, 203 bp, Homo sapiens; identical to SEQ ID NO: 5615

SEQ ID NO: 30424 - DNA, 203 bp, Homo sapiens; identical to SEQ ID NO: 5616

SEQ ID NO: 30425 - DNA, 203 bp, Homo sapiens; identical to SEQ ID NO: 5617

SEQ ID NO: 30426 - DNA, 203 bp, Homo sapiens; identical to SEQ ID NO: 5618

SEQ ID NO: 30427 - DNA, 203 bp, Homo sapiens; identical to SEQ ID NO: 5619

SEQ ID NO: 30428 - DNA, 203 bp, Homo sapiens; identical to SEQ ID NO: 5620

SEQ ID NO: 30429 - DNA, 203 bp, Homo sapiens; identical to SEQ ID NO: 5621

SEQ ID NO: 30430 - DNA, 203 bp, Homo sapiens; identical to SEQ ID NO: 5622

SEQ ID NO: 30431 - DNA, 203 bp, Homo sapiens; identical to SEQ ID NO: 5627

SEQ ID NO: 30432 - DNA, 203 bp, Homo sapiens; identical to SEQ ID NO: 5628

SEQ ID NO: 30433 - DNA, 203 bp, Homo sapiens; identical to SEQ ID NO: 5629

SEQ ID NO: 30434 - DNA, 203 bp, Homo sapiens; identical to SEQ ID NO: 5630

SEQ ID NO: 30435 - DNA, 203 bp, Homo sapiens; identical to SEQ ID NO: 5631

SEQ ID NO: 30436 - DNA, 203 bp, Homo sapiens; identical to SEQ ID NO: 5632

SEQ ID NO: 30437 - DNA, 203 bp, Homo sapiens; identical to SEQ ID NO: 5633

SEQ ID NO: 30438 - DNA, 203 bp, Homo sapiens; identical to SEQ ID NO: 5634

SEQ ID NO: 30439 - DNA, 203 bp, Homo sapiens; identical to SEQ ID NO: 5635

SEQ ID NO: 30440 - DNA, 203 bp, Homo sapiens; identical to SEQ ID NO: 5636

SEQ ID NO: 30441 - DNA, 203 bp, Homo sapiens; identical to SEQ ID NO: 5637

SEQ ID NO: 30442 - DNA, 203 bp, Homo sapiens; identical to SEQ ID NO: 5638

SEQ ID NO: 30443 - DNA, 203 bp, Homo sapiens; identical to SEQ ID NO: 5639

SEQ ID NO: 30444 - DNA, 203 bp, Homo sapiens; identical to SEQ ID NO: 5640

SEQ ID NO: 30445 - DNA, 203 bp, Homo sapiens; identical to SEQ ID NO: 5641

SEQ ID NO: 30446 - DNA, 203 bp, Homo sapiens; identical to SEQ ID NO: 5642

SEQ ID NO: 30447 - DNA, 203 bp, Homo sapiens; identical to SEQ ID NO: 5643

SEQ ID NO: 30448 - DNA, 203 bp, Homo sapiens; identical to SEQ ID NO: 5644

SEQ ID NO: 30449 - DNA, 203 bp, Homo sapiens; identical to SEQ ID NO: 5645

SEQ ID NO: 30450 - DNA, 203 bp, Homo sapiens; identical to SEQ ID NO: 5676

SEQ ID NO: 30451 - DNA, 203 bp, Homo sapiens; identical to SEQ ID NO: 5677

SEQ ID NO: 30452 - DNA, 203 bp, Homo sapiens; identical to SEQ ID NO: 5678

SEQ ID NO: 30453 - DNA, 203 bp, Homo sapiens; identical to SEQ ID NO: 5679

SEQ ID NO: 30454 - DNA, 203 bp, Homo sapiens; identical to SEQ ID NO: 5682

SEQ ID NO: 30455 - DNA, 203 bp, Homo sapiens; identical to SEQ ID NO: 5687

SEQ ID NO: 30456 - DNA, 203 bp, Homo sapiens; identical to SEQ ID NO: 5688

SEQ ID NO: 30457 - DNA, 203 bp, Homo sapiens; identical to SEQ ID NO: 5689

SEQ ID NO: 30458 - DNA, 203 bp, Homo sapiens; identical to SEQ ID NO: 5691

SEQ ID NO: 30459 - DNA, 203 bp, Homo sapiens; identical to SEQ ID NO: 5692

SEQ ID NO: 30460 - DNA, 203 bp, Homo sapiens; identical to SEQ ID NO: 5693

SEQ ID NO: 30461 - DNA, 203 bp, Homo sapiens; identical to SEQ ID NO: 5694

SEQ ID NO: 30462 - DNA, 203 bp, Homo sapiens; identical to SEQ ID NO: 5695

SEQ ID NO: 30463 - DNA, 203 bp, Homo sapiens; identical to SEQ ID NO: 5696

SEQ ID NO: 30464 - DNA, 203 bp, Homo sapiens; identical to SEQ ID NO: 5697

SEQ ID NO: 30465 - DNA, 203 bp, Homo sapiens; identical to SEQ ID NO: 5706

SEQ ID NO: 30466 - DNA, 203 bp, Homo sapiens; identical to SEQ ID NO: 5707

SEQ ID NO: 30467 - DNA, 203 bp, Homo sapiens; identical to SEQ ID NO: 5708

SEQ ID NO: 30468 - DNA, 203 bp, Homo sapiens; identical to SEQ ID NO: 5709

SEQ ID NO: 30469 - DNA, 203 bp, Homo sapiens; identical to SEQ ID NO: 5711

SEQ ID NO: 30470 - DNA, 203 bp, Homo sapiens; identical to SEQ ID NO: 5712

SEQ ID NO: 30471 - DNA, 203 bp, Homo sapiens; identical to SEQ ID NO: 5713

SEQ ID NO: 30472 - DNA, 203 bp, Homo sapiens; identical to SEQ ID NO: 5714

SEQ ID NO: 30473 - DNA, 203 bp, Homo sapiens; identical to SEQ ID NO: 5715

SEQ ID NO: 30474 - DNA, 203 bp, Homo sapiens; identical to SEQ ID NO: 5716

SEQ ID NO: 30475 - DNA, 203 bp, Homo sapiens; identical to SEQ ID NO: 5717

SEQ ID NO: 30476 - DNA, 203 bp, Homo sapiens; identical to SEQ ID NO: 5718

SEQ ID NO: 30477 - DNA, 203 bp, Homo sapiens; identical to SEQ ID NO: 5724

SEQ ID NO: 30478 - DNA, 203 bp, Homo sapiens; identical to SEQ ID NO: 5725

SEQ ID NO: 30479 - DNA, 203 bp, Homo sapiens; identical to SEQ ID NO: 5726

SEQ ID NO: 30480 - DNA, 203 bp, Homo sapiens; identical to SEQ ID NO: 5727

SEQ ID NO: 30481 - DNA, 203 bp, Homo sapiens; identical to SEQ ID NO: 5728

SEQ ID NO: 30482 - DNA, 203 bp, Homo sapiens; identical to SEQ ID NO: 5729

SEQ ID NO: 30483 - DNA, 203 bp, Homo sapiens; identical to SEQ ID NO: 5730

SEQ ID NO: 30484 - DNA, 203 bp, Homo sapiens; identical to SEQ ID NO: 5731

SEQ ID NO: 30485 - DNA, 203 bp, Homo sapiens; identical to SEQ ID NO: 5732

SEQ ID NO: 30486 - DNA, 203 bp, Homo sapiens; identical to SEQ ID NO: 5740

SEQ ID NO: 30487 - DNA, 203 bp, Homo sapiens; identical to SEQ ID NO: 5741

SEQ ID NO: 30488 - DNA, 203 bp, Homo sapiens; identical to SEQ ID NO: 5742

SEQ ID NO: 30489 - DNA, 203 bp, Homo sapiens; identical to SEQ ID NO: 5746

SEQ ID NO: 30490 - DNA, 203 bp, Homo sapiens; identical to SEQ ID NO: 5781

SEQ ID NO: 30491 - DNA, 203 bp, Homo sapiens; identical to SEQ ID NO: 5783

SEQ ID NO: 30492 - DNA, 203 bp, Homo sapiens; identical to SEQ ID NO: 5798

SEQ ID NO: 30493 - DNA, 203 bp, Homo sapiens; identical to SEQ ID NO: 5799

SEQ ID NO: 30494 - DNA, 203 bp, Homo sapiens; identical to SEQ ID NO: 5800

SEQ ID NO: 30495 - DNA, 203 bp, Homo sapiens; identical to SEQ ID NO: 5801

SEQ ID NO: 30496 - DNA, 203 bp, Homo sapiens; identical to SEQ ID NO: 5802

SEQ ID NO: 30497 - DNA, 203 bp, Homo sapiens; identical to SEQ ID NO: 5803

SEQ ID NO: 30498 - DNA, 203 bp, Homo sapiens; identical to SEQ ID NO: 5804

SEQ ID NO: 30499 - DNA, 203 bp, Homo sapiens; identical to SEQ ID NO: 5842

SEQ ID NO: 30500 - DNA, 203 bp, Homo sapiens; identical to SEQ ID NO: 5843

SEQ ID NO: 30501 - DNA, 203 bp, Homo sapiens; identical to SEQ ID NO: 5844

SEQ ID NO: 30502 - DNA, 203 bp, Homo sapiens; identical to SEQ ID NO: 5845

SEQ ID NO: 30503 - DNA, 203 bp, Homo sapiens; identical to SEQ ID NO: 5846

SEQ ID NO: 30504 - DNA, 203 bp, Homo sapiens; identical to SEQ ID NO: 5847

SEQ ID NO: 30505 - DNA, 203 bp, Homo sapiens; identical to SEQ ID NO: 5848

SEQ ID NO: 30506 - DNA, 203 bp, Homo sapiens; identical to SEQ ID NO: 5849

SEQ ID NO: 30507 - DNA, 203 bp, Homo sapiens; identical to SEQ ID NO: 5850

SEQ ID NO: 30508 - DNA, 203 bp, Homo sapiens; identical to SEQ ID NO: 5851

SEQ ID NO: 30509 - DNA, 203 bp, Homo sapiens; identical to SEQ ID NO: 5852

SEQ ID NO: 30510 - DNA, 203 bp, Homo sapiens; identical to SEQ ID NO: 5853

SEQ ID NO: 30511 - DNA, 203 bp, Homo sapiens; identical to SEQ ID NO: 5870

SEQ ID NO: 30512 - DNA, 203 bp, Homo sapiens; identical to SEQ ID NO: 5921

SEQ ID NO: 30513 - DNA, 203 bp, Homo sapiens; identical to SEQ ID NO: 5922

SEQ ID NO: 30514 - DNA, 203 bp, Homo sapiens; identical to SEQ ID NO: 5923

SEQ ID NO: 30515 - DNA, 203 bp, Homo sapiens; identical to SEQ ID NO: 5942

SEQ ID NO: 30516 - DNA, 203 bp, Homo sapiens; identical to SEQ ID NO: 5943

SEQ ID NO: 30517 - DNA, 203 bp, Homo sapiens; identical to SEQ ID NO: 5944

SEQ ID NO: 30518 - DNA, 203 bp, Homo sapiens; identical to SEQ ID NO: 5945

SEQ ID NO: 30519 - DNA, 203 bp, Homo sapiens; identical to SEQ ID NO: 5958

SEQ ID NO: 30520 - DNA, 203 bp, Homo sapiens; identical to SEQ ID NO: 5959

SEQ ID NO: 30521 - DNA, 203 bp, Homo sapiens; identical to SEQ ID NO: 5960

SEQ ID NO: 30522 - DNA, 203 bp, Homo sapiens; identical to SEQ ID NO: 5961

SEQ ID NO: 30523 - DNA, 203 bp, Homo sapiens; identical to SEQ ID NO: 5962

SEQ ID NO: 30524 - DNA, 203 bp, Homo sapiens; identical to SEQ ID NO: 5963

SEQ ID NO: 30525 - DNA, 203 bp, Homo sapiens; identical to SEQ ID NO: 5964

SEQ ID NO: 30526 - DNA, 203 bp, Homo sapiens; identical to SEQ ID NO: 5969

SEQ ID NO: 30527 - DNA, 203 bp, Homo sapiens; identical to SEQ ID NO: 5971

SEQ ID NO: 30528 - DNA, 203 bp, Homo sapiens; identical to SEQ ID NO: 5989

SEQ ID NO: 30529 - DNA, 203 bp, Homo sapiens; identical to SEQ ID NO: 5997

SEQ ID NO: 30530 - DNA, 203 bp, Homo sapiens; identical to SEQ ID NO: 5998

SEQ ID NO: 30531 - DNA, 203 bp, Homo sapiens; identical to SEQ ID NO: 5999

SEQ ID NO: 30532 - DNA, 203 bp, Homo sapiens; identical to SEQ ID NO: 6000

SEQ ID NO: 30533 - DNA, 203 bp, Homo sapiens; identical to SEQ ID NO: 6001

SEQ ID NO: 30534 - DNA, 203 bp, Homo sapiens; identical to SEQ ID NO: 6002

SEQ ID NO: 30535 - DNA, 203 bp, Homo sapiens; identical to SEQ ID NO: 6003

SEQ ID NO: 30536 - DNA, 203 bp, Homo sapiens; identical to SEQ ID NO: 6004

SEQ ID NO: 30537 - DNA, 203 bp, Homo sapiens; identical to SEQ ID NO: 6005

SEQ ID NO: 30538 - DNA, 203 bp, Homo sapiens; identical to SEQ ID NO: 6006

SEQ ID NO: 30539 - DNA, 203 bp, Homo sapiens; identical to SEQ ID NO: 6007

SEQ ID NO: 30540 - DNA, 203 bp, Homo sapiens; identical to SEQ ID NO: 6053

SEQ ID NO: 30541 - DNA, 203 bp, Homo sapiens; identical to SEQ ID NO: 6054

SEQ ID NO: 30542 - DNA, 203 bp, Homo sapiens; identical to SEQ ID NO: 6055

SEQ ID NO: 30543 - DNA, 203 bp, Homo sapiens; identical to SEQ ID NO: 6056

SEQ ID NO: 30544 - DNA, 203 bp, Homo sapiens; identical to SEQ ID NO: 6057

SEQ ID NO: 30545 - DNA, 203 bp, Homo sapiens; identical to SEQ ID NO: 6058

SEQ ID NO: 30546 - DNA, 203 bp, Homo sapiens; identical to SEQ ID NO: 6059

SEQ ID NO: 30547 - DNA, 203 bp, Homo sapiens; identical to SEQ ID NO: 6060

SEQ ID NO: 30548 - DNA, 203 bp, Homo sapiens; identical to SEQ ID NO: 6061

SEQ ID NO: 30549 - DNA, 203 bp, Homo sapiens; identical to SEQ ID NO: 6062

SEQ ID NO: 30550 - DNA, 203 bp, Homo sapiens; identical to SEQ ID NO: 6063

SEQ ID NO: 30551 - DNA, 203 bp, Homo sapiens; identical to SEQ ID NO: 6064

SEQ ID NO: 30552 - DNA, 203 bp, Homo sapiens; identical to SEQ ID NO: 6065

SEQ ID NO: 30553 - DNA, 203 bp, Homo sapiens; identical to SEQ ID NO: 6089

SEQ ID NO: 30554 - DNA, 203 bp, Homo sapiens; identical to SEQ ID NO: 6150

SEQ ID NO: 30555 - DNA, 203 bp, Homo sapiens; identical to SEQ ID NO: 6164

SEQ ID NO: 30556 - DNA, 203 bp, Homo sapiens; identical to SEQ ID NO: 6166

SEQ ID NO: 30557 - DNA, 203 bp, Homo sapiens; identical to SEQ ID NO: 6168

SEQ ID NO: 30558 - DNA, 203 bp, Homo sapiens; identical to SEQ ID NO: 6169

SEQ ID NO: 30559 - DNA, 203 bp, Homo sapiens; identical to SEQ ID NO: 6170

SEQ ID NO: 30560 - DNA, 203 bp, Homo sapiens; identical to SEQ ID NO: 6171

SEQ ID NO: 30561 - DNA, 203 bp, Homo sapiens; identical to SEQ ID NO: 6172

SEQ ID NO: 30562 - DNA, 203 bp, Homo sapiens; identical to SEQ ID NO: 6173

SEQ ID NO: 30563 - DNA, 203 bp, Homo sapiens; identical to SEQ ID NO: 6174

SEQ ID NO: 30564 - DNA, 203 bp, Homo sapiens; identical to SEQ ID NO: 6225

SEQ ID NO: 30565 - DNA, 203 bp, Homo sapiens; identical to SEQ ID NO: 6227

SEQ ID NO: 30566 - DNA, 203 bp, Homo sapiens; identical to SEQ ID NO: 6228

SEQ ID NO: 30567 - DNA, 203 bp, Homo sapiens; identical to SEQ ID NO: 6229

SEQ ID NO: 30568 - DNA, 203 bp, Homo sapiens; identical to SEQ ID NO: 6230

SEQ ID NO: 30569 - DNA, 203 bp, Homo sapiens; identical to SEQ ID NO: 6231

SEQ ID NO: 30570 - DNA, 203 bp, Homo sapiens; identical to SEQ ID NO: 6232

SEQ ID NO: 30571 - DNA, 203 bp, Homo sapiens; identical to SEQ ID NO: 6233

SEQ ID NO: 30572 - DNA, 203 bp, Homo sapiens; identical to SEQ ID NO: 6234

SEQ ID NO: 30573 - DNA, 203 bp, Homo sapiens; identical to SEQ ID NO: 6235

SEQ ID NO: 30574 - DNA, 203 bp, Homo sapiens; identical to SEQ ID NO: 6236

SEQ ID NO: 30575 - DNA, 203 bp, Homo sapiens; identical to SEQ ID NO: 6237

SEQ ID NO: 30576 - DNA, 203 bp, Homo sapiens; identical to SEQ ID NO: 6238

SEQ ID NO: 30577 - DNA, 203 bp, Homo sapiens; identical to SEQ ID NO: 6239

SEQ ID NO: 30578 - DNA, 203 bp, Homo sapiens; identical to SEQ ID NO: 6240

SEQ ID NO: 30579 - DNA, 203 bp, Homo sapiens; identical to SEQ ID NO: 6241

SEQ ID NO: 30580 - DNA, 203 bp, Homo sapiens; identical to SEQ ID NO: 6242

SEQ ID NO: 30581 - DNA, 203 bp, Homo sapiens; identical to SEQ ID NO: 6243

SEQ ID NO: 30582 - DNA, 203 bp, Homo sapiens; identical to SEQ ID NO: 6244

SEQ ID NO: 30583 - DNA, 203 bp, Homo sapiens; identical to SEQ ID NO: 6245

SEQ ID NO: 30584 - DNA, 203 bp, Homo sapiens; identical to SEQ ID NO: 6246

SEQ ID NO: 30585 - DNA, 203 bp, Homo sapiens; identical to SEQ ID NO: 6248

SEQ ID NO: 30586 - DNA, 203 bp, Homo sapiens; identical to SEQ ID NO: 6249

SEQ ID NO: 30587 - DNA, 203 bp, Homo sapiens; identical to SEQ ID NO: 6250

SEQ ID NO: 30588 - DNA, 203 bp, Homo sapiens; identical to SEQ ID NO: 6251

SEQ ID NO: 30589 - DNA, 203 bp, Homo sapiens; identical to SEQ ID NO: 6252

SEQ ID NO: 30590 - DNA, 203 bp, Homo sapiens; identical to SEQ ID NO: 6253

SEQ ID NO: 30591 - DNA, 203 bp, Homo sapiens; identical to SEQ ID NO: 6254

SEQ ID NO: 30592 - DNA, 203 bp, Homo sapiens; identical to SEQ ID NO: 6255

SEQ ID NO: 30593 - DNA, 203 bp, Homo sapiens; identical to SEQ ID NO: 6256

SEQ ID NO: 30594 - DNA, 203 bp, Homo sapiens; identical to SEQ ID NO: 6257

SEQ ID NO: 30595 - DNA, 203 bp, Homo sapiens; identical to SEQ ID NO: 6258

SEQ ID NO: 30596 - DNA, 203 bp, Homo sapiens; identical to SEQ ID NO: 6259

SEQ ID NO: 30597 - DNA, 203 bp, Homo sapiens; identical to SEQ ID NO: 6260

SEQ ID NO: 30598 - DNA, 203 bp, Homo sapiens; identical to SEQ ID NO: 6261

SEQ ID NO: 30599 - DNA, 203 bp, Homo sapiens; identical to SEQ ID NO: 6262

SEQ ID NO: 30600 - DNA, 203 bp, Homo sapiens; identical to SEQ ID NO: 6263

SEQ ID NO: 30601 - DNA, 203 bp, Homo sapiens; identical to SEQ ID NO: 6264

SEQ ID NO: 30602 - DNA, 203 bp, Homo sapiens; identical to SEQ ID NO: 6265

SEQ ID NO: 30603 - DNA, 203 bp, Homo sapiens; identical to SEQ ID NO: 6266

SEQ ID NO: 30604 - DNA, 203 bp, Homo sapiens; identical to SEQ ID NO: 6291

SEQ ID NO: 30605 - DNA, 203 bp, Homo sapiens; identical to SEQ ID NO: 6301

SEQ ID NO: 30606 - DNA, 203 bp, Homo sapiens; identical to SEQ ID NO: 6302

SEQ ID NO: 30607 - DNA, 203 bp, Homo sapiens; identical to SEQ ID NO: 6303

SEQ ID NO: 30608 - DNA, 203 bp, Homo sapiens; identical to SEQ ID NO: 6304

SEQ ID NO: 30609 - DNA, 203 bp, Homo sapiens; identical to SEQ ID NO: 6305

SEQ ID NO: 30610 - DNA, 203 bp, Homo sapiens; identical to SEQ ID NO: 6306

SEQ ID NO: 30611 - DNA, 203 bp, Homo sapiens; identical to SEQ ID NO: 6307

SEQ ID NO: 30612 - DNA, 203 bp, Homo sapiens; identical to SEQ ID NO: 6308

SEQ ID NO: 30613 - DNA, 203 bp, Homo sapiens; identical to SEQ ID NO: 6309

SEQ ID NO: 30614 - DNA, 203 bp, Homo sapiens; identical to SEQ ID NO: 6310

SEQ ID NO: 30615 - DNA, 203 bp, Homo sapiens; identical to SEQ ID NO: 6311

SEQ ID NO: 30616 - DNA, 203 bp, Homo sapiens; identical to SEQ ID NO: 6312

SEQ ID NO: 30617 - DNA, 203 bp, Homo sapiens; identical to SEQ ID NO: 6313

SEQ ID NO: 30618 - DNA, 203 bp, Homo sapiens; identical to SEQ ID NO: 6314

SEQ ID NO: 30619 - DNA, 203 bp, Homo sapiens; identical to SEQ ID NO: 6315

SEQ ID NO: 30620 - DNA, 203 bp, Homo sapiens; identical to SEQ ID NO: 6316

SEQ ID NO: 30621 - DNA, 203 bp, Homo sapiens; identical to SEQ ID NO: 6317

SEQ ID NO: 30622 - DNA, 203 bp, Homo sapiens; identical to SEQ ID NO: 6318

SEQ ID NO: 30623 - DNA, 203 bp, Homo sapiens; identical to SEQ ID NO: 6319

SEQ ID NO: 30624 - DNA, 203 bp, Homo sapiens; identical to SEQ ID NO: 6320

SEQ ID NO: 30625 - DNA, 203 bp, Homo sapiens; identical to SEQ ID NO: 6321

SEQ ID NO: 30626 - DNA, 203 bp, Homo sapiens; identical to SEQ ID NO: 6322

SEQ ID NO: 30627 - DNA, 203 bp, Homo sapiens; identical to SEQ ID NO: 6323

SEQ ID NO: 30628 - DNA, 203 bp, Homo sapiens; identical to SEQ ID NO: 6324

SEQ ID NO: 30629 - DNA, 203 bp, Homo sapiens; identical to SEQ ID NO: 6325

SEQ ID NO: 30630 - DNA, 203 bp, Homo sapiens; identical to SEQ ID NO: 6326

SEQ ID NO: 30631 - DNA, 203 bp, Homo sapiens; identical to SEQ ID NO: 6327

SEQ ID NO: 30632 - DNA, 203 bp, Homo sapiens; identical to SEQ ID NO: 6328

SEQ ID NO: 30633 - DNA, 203 bp, Homo sapiens; identical to SEQ ID NO: 6329

SEQ ID NO: 30634 - DNA, 203 bp, Homo sapiens; identical to SEQ ID NO: 6330

SEQ ID NO: 30635 - DNA, 203 bp, Homo sapiens; identical to SEQ ID NO: 6331

SEQ ID NO: 30636 - DNA, 203 bp, Homo sapiens; identical to SEQ ID NO: 6332

SEQ ID NO: 30637 - DNA, 203 bp, Homo sapiens; identical to SEQ ID NO: 6333

SEQ ID NO: 30638 - DNA, 203 bp, Homo sapiens; identical to SEQ ID NO: 6334

SEQ ID NO: 30639 - DNA, 203 bp, Homo sapiens; identical to SEQ ID NO: 6335

SEQ ID NO: 30640 - DNA, 203 bp, Homo sapiens; identical to SEQ ID NO: 6336

SEQ ID NO: 30641 - DNA, 203 bp, Homo sapiens; identical to SEQ ID NO: 6337

SEQ ID NO: 30642 - DNA, 203 bp, Homo sapiens; identical to SEQ ID NO: 6338

SEQ ID NO: 30643 - DNA, 203 bp, Homo sapiens; identical to SEQ ID NO: 6339

SEQ ID NO: 30644 - DNA, 203 bp, Homo sapiens; identical to SEQ ID NO: 6340

SEQ ID NO: 30645 - DNA, 203 bp, Homo sapiens; identical to SEQ ID NO: 6341

SEQ ID NO: 30646 - DNA, 203 bp, Homo sapiens; identical to SEQ ID NO: 6342

SEQ ID NO: 30647 - DNA, 203 bp, Homo sapiens; identical to SEQ ID NO: 6343

SEQ ID NO: 30648 - DNA, 203 bp, Homo sapiens; identical to SEQ ID NO: 6344

SEQ ID NO: 30649 - DNA, 203 bp, Homo sapiens; identical to SEQ ID NO: 6345

SEQ ID NO: 30650 - DNA, 203 bp, Homo sapiens; identical to SEQ ID NO: 6346

SEQ ID NO: 30651 - DNA, 203 bp, Homo sapiens; identical to SEQ ID NO: 6347

SEQ ID NO: 30652 - DNA, 203 bp, Homo sapiens; identical to SEQ ID NO: 6348

SEQ ID NO: 30653 - DNA, 203 bp, Homo sapiens; identical to SEQ ID NO: 6351

SEQ ID NO: 30654 - DNA, 203 bp, Homo sapiens; identical to SEQ ID NO: 6373

SEQ ID NO: 30655 - DNA, 203 bp, Homo sapiens; identical to SEQ ID NO: 6377

SEQ ID NO: 30656 - DNA, 203 bp, Homo sapiens; identical to SEQ ID NO: 6378

SEQ ID NO: 30657 - DNA, 203 bp, Homo sapiens; identical to SEQ ID NO: 6379

SEQ ID NO: 30658 - DNA, 203 bp, Homo sapiens; identical to SEQ ID NO: 6380

SEQ ID NO: 30659 - DNA, 203 bp, Homo sapiens; identical to SEQ ID NO: 6381

SEQ ID NO: 30660 - DNA, 203 bp, Homo sapiens; identical to SEQ ID NO: 6382

SEQ ID NO: 30661 - DNA, 203 bp, Homo sapiens; identical to SEQ ID NO: 6383

SEQ ID NO: 30662 - DNA, 203 bp, Homo sapiens; identical to SEQ ID NO: 6384

SEQ ID NO: 30663 - DNA, 203 bp, Homo sapiens; identical to SEQ ID NO: 6385

SEQ ID NO: 30664 - DNA, 203 bp, Homo sapiens; identical to SEQ ID NO: 6388

SEQ ID NO: 30665 - DNA, 203 bp, Homo sapiens; identical to SEQ ID NO: 6389

SEQ ID NO: 30666 - DNA, 203 bp, Homo sapiens; identical to SEQ ID NO: 6390

SEQ ID NO: 30667 - DNA, 203 bp, Homo sapiens; identical to SEQ ID NO: 6391

SEQ ID NO: 30668 - DNA, 203 bp, Homo sapiens; identical to SEQ ID NO: 6406

SEQ ID NO: 30669 - DNA, 203 bp, Homo sapiens; identical to SEQ ID NO: 6407

SEQ ID NO: 30670 - DNA, 203 bp, Homo sapiens; identical to SEQ ID NO: 6409

SEQ ID NO: 30671 - DNA, 203 bp, Homo sapiens; identical to SEQ ID NO: 6410

SEQ ID NO: 30672 - DNA, 203 bp, Homo sapiens; identical to SEQ ID NO: 6411

SEQ ID NO: 30673 - DNA, 203 bp, Homo sapiens; identical to SEQ ID NO: 6412

SEQ ID NO: 30674 - DNA, 203 bp, Homo sapiens; identical to SEQ ID NO: 6413

SEQ ID NO: 30675 - DNA, 203 bp, Homo sapiens; identical to SEQ ID NO: 6414

SEQ ID NO: 30676 - DNA, 203 bp, Homo sapiens; identical to SEQ ID NO: 6415

SEQ ID NO: 30677 - DNA, 203 bp, Homo sapiens; identical to SEQ ID NO: 6416

SEQ ID NO: 30678 - DNA, 203 bp, Homo sapiens; identical to SEQ ID NO: 6417

SEQ ID NO: 30679 - DNA, 203 bp, Homo sapiens; identical to SEQ ID NO: 6418

SEQ ID NO: 30680 - DNA, 203 bp, Homo sapiens; identical to SEQ ID NO: 6425

SEQ ID NO: 30681 - DNA, 203 bp, Homo sapiens; identical to SEQ ID NO: 6426

SEQ ID NO: 30682 - DNA, 203 bp, Homo sapiens; identical to SEQ ID NO: 6427

SEQ ID NO: 30683 - DNA, 203 bp, Homo sapiens; identical to SEQ ID NO: 6428

SEQ ID NO: 30684 - DNA, 203 bp, Homo sapiens; identical to SEQ ID NO: 6429

SEQ ID NO: 30685 - DNA, 203 bp, Homo sapiens; identical to SEQ ID NO: 6430

SEQ ID NO: 30686 - DNA, 203 bp, Homo sapiens; identical to SEQ ID NO: 6431

SEQ ID NO: 30687 - DNA, 203 bp, Homo sapiens; identical to SEQ ID NO: 6432

SEQ ID NO: 30688 - DNA, 203 bp, Homo sapiens; identical to SEQ ID NO: 6433

SEQ ID NO: 30689 - DNA, 203 bp, Homo sapiens; identical to SEQ ID NO: 6434

SEQ ID NO: 30690 - DNA, 203 bp, Homo sapiens; identical to SEQ ID NO: 6437

SEQ ID NO: 30691 - DNA, 203 bp, Homo sapiens; identical to SEQ ID NO: 6438

SEQ ID NO: 30692 - DNA, 203 bp, Homo sapiens; identical to SEQ ID NO: 6439

SEQ ID NO: 30693 - DNA, 203 bp, Homo sapiens; identical to SEQ ID NO: 6440

SEQ ID NO: 30694 - DNA, 203 bp, Homo sapiens; identical to SEQ ID NO: 6441

SEQ ID NO: 30695 - DNA, 203 bp, Homo sapiens; identical to SEQ ID NO: 6442

SEQ ID NO: 30696 - DNA, 203 bp, Homo sapiens; identical to SEQ ID NO: 6443

SEQ ID NO: 30697 - DNA, 203 bp, Homo sapiens; identical to SEQ ID NO: 6444

SEQ ID NO: 30698 - DNA, 203 bp, Homo sapiens; identical to SEQ ID NO: 6445

SEQ ID NO: 30699 - DNA, 203 bp, Homo sapiens; identical to SEQ ID NO: 6446

SEQ ID NO: 30700 - DNA, 203 bp, Homo sapiens; identical to SEQ ID NO: 6447

SEQ ID NO: 30701 - DNA, 203 bp, Homo sapiens; identical to SEQ ID NO: 6448

SEQ ID NO: 30702 - DNA, 203 bp, Homo sapiens; identical to SEQ ID NO: 6449

SEQ ID NO: 30703 - DNA, 203 bp, Homo sapiens; identical to SEQ ID NO: 6469

SEQ ID NO: 30704 - DNA, 203 bp, Homo sapiens; identical to SEQ ID NO: 6470

SEQ ID NO: 30705 - DNA, 203 bp, Homo sapiens; identical to SEQ ID NO: 6471

SEQ ID NO: 30706 - DNA, 203 bp, Homo sapiens; identical to SEQ ID NO: 6472

SEQ ID NO: 30707 - DNA, 203 bp, Homo sapiens; identical to SEQ ID NO: 6473

SEQ ID NO: 30708 - DNA, 203 bp, Homo sapiens; identical to SEQ ID NO: 6474

SEQ ID NO: 30709 - DNA, 203 bp, Homo sapiens; identical to SEQ ID NO: 6475

SEQ ID NO: 30710 - DNA, 203 bp, Homo sapiens; identical to SEQ ID NO: 6476

SEQ ID NO: 30711 - DNA, 203 bp, Homo sapiens; identical to SEQ ID NO: 6477

SEQ ID NO: 30712 - DNA, 203 bp, Homo sapiens; identical to SEQ ID NO: 6478

SEQ ID NO: 30713 - DNA, 203 bp, Homo sapiens; identical to SEQ ID NO: 6479

SEQ ID NO: 30714 - DNA, 203 bp, Homo sapiens; identical to SEQ ID NO: 6480

SEQ ID NO: 30715 - DNA, 203 bp, Homo sapiens; identical to SEQ ID NO: 6481

SEQ ID NO: 30716 - DNA, 203 bp, Homo sapiens; identical to SEQ ID NO: 6537

SEQ ID NO: 30717 - DNA, 203 bp, Homo sapiens; identical to SEQ ID NO: 6545

SEQ ID NO: 30718 - DNA, 203 bp, Homo sapiens; identical to SEQ ID NO: 6553

SEQ ID NO: 30719 - DNA, 203 bp, Homo sapiens; identical to SEQ ID NO: 6554

SEQ ID NO: 30720 - DNA, 203 bp, Homo sapiens; identical to SEQ ID NO: 6555

SEQ ID NO: 30721 - DNA, 203 bp, Homo sapiens; identical to SEQ ID NO: 6556

SEQ ID NO: 30722 - DNA, 203 bp, Homo sapiens; identical to SEQ ID NO: 6557

SEQ ID NO: 30723 - DNA, 203 bp, Homo sapiens; identical to SEQ ID NO: 6558

SEQ ID NO: 30724 - DNA, 203 bp, Homo sapiens; identical to SEQ ID NO: 6559

SEQ ID NO: 30725 - DNA, 203 bp, Homo sapiens; identical to SEQ ID NO: 6560

SEQ ID NO: 30726 - DNA, 203 bp, Homo sapiens; identical to SEQ ID NO: 6561

SEQ ID NO: 30727 - DNA, 203 bp, Homo sapiens; identical to SEQ ID NO: 6562

SEQ ID NO: 30728 - DNA, 203 bp, Homo sapiens; identical to SEQ ID NO: 6563

SEQ ID NO: 30729 - DNA, 203 bp, Homo sapiens; identical to SEQ ID NO: 6564

SEQ ID NO: 30730 - DNA, 203 bp, Homo sapiens; identical to SEQ ID NO: 6565

SEQ ID NO: 30731 - DNA, 203 bp, Homo sapiens; identical to SEQ ID NO: 6566

SEQ ID NO: 30732 - DNA, 203 bp, Homo sapiens; identical to SEQ ID NO: 6568

SEQ ID NO: 30733 - DNA, 203 bp, Homo sapiens; identical to SEQ ID NO: 6573

SEQ ID NO: 30734 - DNA, 203 bp, Homo sapiens; identical to SEQ ID NO: 6574

SEQ ID NO: 30735 - DNA, 203 bp, Homo sapiens; identical to SEQ ID NO: 6592

SEQ ID NO: 30736 - DNA, 203 bp, Homo sapiens; identical to SEQ ID NO: 6595

SEQ ID NO: 30737 - DNA, 203 bp, Homo sapiens; identical to SEQ ID NO: 6596

SEQ ID NO: 30738 - DNA, 203 bp, Homo sapiens; identical to SEQ ID NO: 6597

SEQ ID NO: 30739 - DNA, 203 bp, Homo sapiens; identical to SEQ ID NO: 6598

SEQ ID NO: 30740 - DNA, 203 bp, Homo sapiens; identical to SEQ ID NO: 6599

SEQ ID NO: 30741 - DNA, 203 bp, Homo sapiens; identical to SEQ ID NO: 6600

SEQ ID NO: 30742 - DNA, 203 bp, Homo sapiens; identical to SEQ ID NO: 6601

SEQ ID NO: 30743 - DNA, 203 bp, Homo sapiens; identical to SEQ ID NO: 6602

SEQ ID NO: 30744 - DNA, 203 bp, Homo sapiens; identical to SEQ ID NO: 6603

SEQ ID NO: 30745 - DNA, 203 bp, Homo sapiens; identical to SEQ ID NO: 6604

SEQ ID NO: 30746 - DNA, 203 bp, Homo sapiens; identical to SEQ ID NO: 6605

SEQ ID NO: 30747 - DNA, 203 bp, Homo sapiens; identical to SEQ ID NO: 6606

SEQ ID NO: 30748 - DNA, 203 bp, Homo sapiens; identical to SEQ ID NO: 6607

SEQ ID NO: 30749 - DNA, 203 bp, Homo sapiens; identical to SEQ ID NO: 6608

SEQ ID NO: 30750 - DNA, 203 bp, Homo sapiens; identical to SEQ ID NO: 6609

SEQ ID NO: 30751 - DNA, 203 bp, Homo sapiens; identical to SEQ ID NO: 6610

SEQ ID NO: 30752 - DNA, 203 bp, Homo sapiens; identical to SEQ ID NO: 6611

SEQ ID NO: 30753 - DNA, 203 bp, Homo sapiens; identical to SEQ ID NO: 6612

SEQ ID NO: 30754 - DNA, 203 bp, Homo sapiens; identical to SEQ ID NO: 6613

SEQ ID NO: 30755 - DNA, 203 bp, Homo sapiens; identical to SEQ ID NO: 6614

SEQ ID NO: 30756 - DNA, 203 bp, Homo sapiens; identical to SEQ ID NO: 6617

SEQ ID NO: 30757 - DNA, 203 bp, Homo sapiens; identical to SEQ ID NO: 6618

SEQ ID NO: 30758 - DNA, 203 bp, Homo sapiens; identical to SEQ ID NO: 6620

SEQ ID NO: 30759 - DNA, 203 bp, Homo sapiens; identical to SEQ ID NO: 6621

SEQ ID NO: 30760 - DNA, 203 bp, Homo sapiens; identical to SEQ ID NO: 6622

SEQ ID NO: 30761 - DNA, 203 bp, Homo sapiens; identical to SEQ ID NO: 6639

SEQ ID NO: 30762 - DNA, 203 bp, Homo sapiens; identical to SEQ ID NO: 6642

SEQ ID NO: 30763 - DNA, 203 bp, Homo sapiens; identical to SEQ ID NO: 6645

SEQ ID NO: 30764 - DNA, 203 bp, Homo sapiens; identical to SEQ ID NO: 6662

SEQ ID NO: 30765 - DNA, 203 bp, Homo sapiens; identical to SEQ ID NO: 6671

SEQ ID NO: 30766 - DNA, 203 bp, Homo sapiens; identical to SEQ ID NO: 6672

SEQ ID NO: 30767 - DNA, 203 bp, Homo sapiens; identical to SEQ ID NO: 6673

SEQ ID NO: 30768 - DNA, 203 bp, Homo sapiens; identical to SEQ ID NO: 6674

SEQ ID NO: 30769 - DNA, 203 bp, Homo sapiens; identical to SEQ ID NO: 6675

SEQ ID NO: 30770 - DNA, 203 bp, Homo sapiens; identical to SEQ ID NO: 6687

SEQ ID NO: 30771 - DNA, 203 bp, Homo sapiens; identical to SEQ ID NO: 6689

SEQ ID NO: 30772 - DNA, 203 bp, Homo sapiens; identical to SEQ ID NO: 6690

SEQ ID NO: 30773 - DNA, 203 bp, Homo sapiens; identical to SEQ ID NO: 6691

SEQ ID NO: 30774 - DNA, 203 bp, Homo sapiens; identical to SEQ ID NO: 6692

SEQ ID NO: 30775 - DNA, 203 bp, Homo sapiens; identical to SEQ ID NO: 6693

SEQ ID NO: 30776 - DNA, 203 bp, Homo sapiens; identical to SEQ ID NO: 6694

SEQ ID NO: 30777 - DNA, 203 bp, Homo sapiens; identical to SEQ ID NO: 6695

SEQ ID NO: 30778 - DNA, 203 bp, Homo sapiens; identical to SEQ ID NO: 6696

SEQ ID NO: 30779 - DNA, 203 bp, Homo sapiens; identical to SEQ ID NO: 6697

SEQ ID NO: 30780 - DNA, 203 bp, Homo sapiens; identical to SEQ ID NO: 6698

SEQ ID NO: 30781 - DNA, 203 bp, Homo sapiens; identical to SEQ ID NO: 6699

SEQ ID NO: 30782 - DNA, 203 bp, Homo sapiens; identical to SEQ ID NO: 6700

SEQ ID NO: 30783 - DNA, 203 bp, Homo sapiens; identical to SEQ ID NO: 6701

SEQ ID NO: 30784 - DNA, 203 bp, Homo sapiens; identical to SEQ ID NO: 6702

SEQ ID NO: 30785 - DNA, 203 bp, Homo sapiens; identical to SEQ ID NO: 6703

SEQ ID NO: 30786 - DNA, 203 bp, Homo sapiens; identical to SEQ ID NO: 6704

SEQ ID NO: 30787 - DNA, 203 bp, Homo sapiens; identical to SEQ ID NO: 6705

SEQ ID NO: 30788 - DNA, 203 bp, Homo sapiens; identical to SEQ ID NO: 6706

SEQ ID NO: 30789 - DNA, 203 bp, Homo sapiens; identical to SEQ ID NO: 6707

SEQ ID NO: 30790 - DNA, 203 bp, Homo sapiens; identical to SEQ ID NO: 6708

SEQ ID NO: 30791 - DNA, 203 bp, Homo sapiens; identical to SEQ ID NO: 6709

SEQ ID NO: 30792 - DNA, 203 bp, Homo sapiens; identical to SEQ ID NO: 6710

SEQ ID NO: 30793 - DNA, 203 bp, Homo sapiens; identical to SEQ ID NO: 6711

SEQ ID NO: 30794 - DNA, 203 bp, Homo sapiens; identical to SEQ ID NO: 6712

SEQ ID NO: 30795 - DNA, 203 bp, Homo sapiens; identical to SEQ ID NO: 6713

SEQ ID NO: 30796 - DNA, 203 bp, Homo sapiens; identical to SEQ ID NO: 6714

SEQ ID NO: 30797 - DNA, 203 bp, Homo sapiens; identical to SEQ ID NO: 6715

SEQ ID NO: 30798 - DNA, 203 bp, Homo sapiens; identical to SEQ ID NO: 6716

SEQ ID NO: 30799 - DNA, 203 bp, Homo sapiens; identical to SEQ ID NO: 6717

SEQ ID NO: 30800 - DNA, 203 bp, Homo sapiens; identical to SEQ ID NO: 6718

SEQ ID NO: 30801 - DNA, 203 bp, Homo sapiens; identical to SEQ ID NO: 6719

SEQ ID NO: 30802 - DNA, 203 bp, Homo sapiens; identical to SEQ ID NO: 6728

SEQ ID NO: 30803 - DNA, 203 bp, Homo sapiens; identical to SEQ ID NO: 6729

SEQ ID NO: 30804 - DNA, 203 bp, Homo sapiens; identical to SEQ ID NO: 6730

SEQ ID NO: 30805 - DNA, 203 bp, Homo sapiens; identical to SEQ ID NO: 6731

SEQ ID NO: 30806 - DNA, 203 bp, Homo sapiens; identical to SEQ ID NO: 6732

SEQ ID NO: 30807 - DNA, 203 bp, Homo sapiens; identical to SEQ ID NO: 6738

SEQ ID NO: 30808 - DNA, 203 bp, Homo sapiens; identical to SEQ ID NO: 6740

SEQ ID NO: 30809 - DNA, 203 bp, Homo sapiens; identical to SEQ ID NO: 6746

SEQ ID NO: 30810 - DNA, 203 bp, Homo sapiens; identical to SEQ ID NO: 6747

SEQ ID NO: 30811 - DNA, 203 bp, Homo sapiens; identical to SEQ ID NO: 6773

SEQ ID NO: 30812 - DNA, 203 bp, Homo sapiens; identical to SEQ ID NO: 6774

SEQ ID NO: 30813 - DNA, 203 bp, Homo sapiens; identical to SEQ ID NO: 6775

SEQ ID NO: 30814 - DNA, 203 bp, Homo sapiens; identical to SEQ ID NO: 6776

SEQ ID NO: 30815 - DNA, 203 bp, Homo sapiens; identical to SEQ ID NO: 6777

SEQ ID NO: 30816 - DNA, 203 bp, Homo sapiens; identical to SEQ ID NO: 6778

SEQ ID NO: 30817 - DNA, 203 bp, Homo sapiens; identical to SEQ ID NO: 6779

SEQ ID NO: 30818 - DNA, 203 bp, Homo sapiens; identical to SEQ ID NO: 6780

SEQ ID NO: 30819 - DNA, 203 bp, Homo sapiens; identical to SEQ ID NO: 6781

SEQ ID NO: 30820 - DNA, 203 bp, Homo sapiens; identical to SEQ ID NO: 6782

SEQ ID NO: 30821 - DNA, 203 bp, Homo sapiens; identical to SEQ ID NO: 6783

SEQ ID NO: 30822 - DNA, 203 bp, Homo sapiens; identical to SEQ ID NO: 6784

SEQ ID NO: 30823 - DNA, 203 bp, Homo sapiens; identical to SEQ ID NO: 6785

SEQ ID NO: 30824 - DNA, 203 bp, Homo sapiens; identical to SEQ ID NO: 6786

SEQ ID NO: 30825 - DNA, 203 bp, Homo sapiens; identical to SEQ ID NO: 6794

SEQ ID NO: 30826 - DNA, 203 bp, Homo sapiens; identical to SEQ ID NO: 6799

SEQ ID NO: 30827 - DNA, 203 bp, Homo sapiens; identical to SEQ ID NO: 6800

SEQ ID NO: 30828 - DNA, 203 bp, Homo sapiens; identical to SEQ ID NO: 6801

SEQ ID NO: 30829 - DNA, 203 bp, Homo sapiens; identical to SEQ ID NO: 6802

SEQ ID NO: 30830 - DNA, 203 bp, Homo sapiens; identical to SEQ ID NO: 6803

SEQ ID NO: 30831 - DNA, 203 bp, Homo sapiens; identical to SEQ ID NO: 6809

SEQ ID NO: 30832 - DNA, 203 bp, Homo sapiens; identical to SEQ ID NO: 6810

SEQ ID NO: 30833 - DNA, 203 bp, Homo sapiens; identical to SEQ ID NO: 6823

SEQ ID NO: 30834 - DNA, 203 bp, Homo sapiens; identical to SEQ ID NO: 6827

SEQ ID NO: 30835 - DNA, 203 bp, Homo sapiens; identical to SEQ ID NO: 6839

SEQ ID NO: 30836 - DNA, 203 bp, Homo sapiens; identical to SEQ ID NO: 6841

SEQ ID NO: 30837 - DNA, 203 bp, Homo sapiens; identical to SEQ ID NO: 6842

SEQ ID NO: 30838 - DNA, 203 bp, Homo sapiens; identical to SEQ ID NO: 6843

SEQ ID NO: 30839 - DNA, 203 bp, Homo sapiens; identical to SEQ ID NO: 6844

SEQ ID NO: 30840 - DNA, 203 bp, Homo sapiens; identical to SEQ ID NO: 6845

SEQ ID NO: 30841 - DNA, 203 bp, Homo sapiens; identical to SEQ ID NO: 6846

SEQ ID NO: 30842 - DNA, 203 bp, Homo sapiens; identical to SEQ ID NO: 6847

SEQ ID NO: 30843 - DNA, 203 bp, Homo sapiens; identical to SEQ ID NO: 6848

SEQ ID NO: 30844 - DNA, 203 bp, Homo sapiens; identical to SEQ ID NO: 6849

SEQ ID NO: 30845 - DNA, 203 bp, Homo sapiens; identical to SEQ ID NO: 6850

SEQ ID NO: 30846 - DNA, 203 bp, Homo sapiens; identical to SEQ ID NO: 6851

SEQ ID NO: 30847 - DNA, 203 bp, Homo sapiens; identical to SEQ ID NO: 6852

SEQ ID NO: 30848 - DNA, 203 bp, Homo sapiens; identical to SEQ ID NO: 6853

SEQ ID NO: 30849 - DNA, 203 bp, Homo sapiens; identical to SEQ ID NO: 6854

SEQ ID NO: 30850 - DNA, 203 bp, Homo sapiens; identical to SEQ ID NO: 6855

SEQ ID NO: 30851 - DNA, 203 bp, Homo sapiens; identical to SEQ ID NO: 6856

SEQ ID NO: 30852 - DNA, 203 bp, Homo sapiens; identical to SEQ ID NO: 6857

SEQ ID NO: 30853 - DNA, 203 bp, Homo sapiens; identical to SEQ ID NO: 6858

SEQ ID NO: 30854 - DNA, 203 bp, Homo sapiens; identical to SEQ ID NO: 6863

SEQ ID NO: 30855 - DNA, 203 bp, Homo sapiens; identical to SEQ ID NO: 6864

SEQ ID NO: 30856 - DNA, 203 bp, Homo sapiens; identical to SEQ ID NO: 6865

SEQ ID NO: 30857 - DNA, 203 bp, Homo sapiens; identical to SEQ ID NO: 6866

SEQ ID NO: 30858 - DNA, 203 bp, Homo sapiens; identical to SEQ ID NO: 6867

SEQ ID NO: 30859 - DNA, 203 bp, Homo sapiens; identical to SEQ ID NO: 6868

SEQ ID NO: 30860 - DNA, 203 bp, Homo sapiens; identical to SEQ ID NO: 6869

SEQ ID NO: 30861 - DNA, 203 bp, Homo sapiens; identical to SEQ ID NO: 6870

SEQ ID NO: 30862 - DNA, 203 bp, Homo sapiens; identical to SEQ ID NO: 6871

SEQ ID NO: 30863 - DNA, 203 bp, Homo sapiens; identical to SEQ ID NO: 6872

SEQ ID NO: 30864 - DNA, 203 bp, Homo sapiens; identical to SEQ ID NO: 6873

SEQ ID NO: 30865 - DNA, 203 bp, Homo sapiens; identical to SEQ ID NO: 6874

SEQ ID NO: 30866 - DNA, 203 bp, Homo sapiens; identical to SEQ ID NO: 6875

SEQ ID NO: 30867 - DNA, 203 bp, Homo sapiens; identical to SEQ ID NO: 6876

SEQ ID NO: 30868 - DNA, 203 bp, Homo sapiens; identical to SEQ ID NO: 6877

SEQ ID NO: 30869 - DNA, 203 bp, Homo sapiens; identical to SEQ ID NO: 6878

SEQ ID NO: 30870 - DNA, 203 bp, Homo sapiens; identical to SEQ ID NO: 6879

SEQ ID NO: 30871 - DNA, 203 bp, Homo sapiens; identical to SEQ ID NO: 6880

SEQ ID NO: 30872 - DNA, 203 bp, Homo sapiens; identical to SEQ ID NO: 6881

SEQ ID NO: 30873 - DNA, 203 bp, Homo sapiens; identical to SEQ ID NO: 6882

SEQ ID NO: 30874 - DNA, 203 bp, Homo sapiens; identical to SEQ ID NO: 6884

SEQ ID NO: 30875 - DNA, 203 bp, Homo sapiens; identical to SEQ ID NO: 6885

SEQ ID NO: 30876 - DNA, 203 bp, Homo sapiens; identical to SEQ ID NO: 6886

SEQ ID NO: 30877 - DNA, 203 bp, Homo sapiens; identical to SEQ ID NO: 6887

SEQ ID NO: 30878 - DNA, 203 bp, Homo sapiens; identical to SEQ ID NO: 6888

SEQ ID NO: 30879 - DNA, 203 bp, Homo sapiens; identical to SEQ ID NO: 6889

SEQ ID NO: 30880 - DNA, 203 bp, Homo sapiens; identical to SEQ ID NO: 6890

SEQ ID NO: 30881 - DNA, 203 bp, Homo sapiens; identical to SEQ ID NO: 6891

SEQ ID NO: 30882 - DNA, 203 bp, Homo sapiens; identical to SEQ ID NO: 6892

SEQ ID NO: 30883 - DNA, 203 bp, Homo sapiens; identical to SEQ ID NO: 6893

SEQ ID NO: 30884 - DNA, 203 bp, Homo sapiens; identical to SEQ ID NO: 6894

SEQ ID NO: 30885 - DNA, 203 bp, Homo sapiens; identical to SEQ ID NO: 6895

SEQ ID NO: 30886 - DNA, 203 bp, Homo sapiens; identical to SEQ ID NO: 6896

SEQ ID NO: 30887 - DNA, 203 bp, Homo sapiens; identical to SEQ ID NO: 6897

SEQ ID NO: 30888 - DNA, 203 bp, Homo sapiens; identical to SEQ ID NO: 6898

SEQ ID NO: 30889 - DNA, 203 bp, Homo sapiens; identical to SEQ ID NO: 6899

SEQ ID NO: 30890 - DNA, 203 bp, Homo sapiens; identical to SEQ ID NO: 6900

SEQ ID NO: 30891 - DNA, 203 bp, Homo sapiens; identical to SEQ ID NO: 6901

SEQ ID NO: 30892 - DNA, 203 bp, Homo sapiens; identical to SEQ ID NO: 6902

SEQ ID NO: 30893 - DNA, 203 bp, Homo sapiens; identical to SEQ ID NO: 6903

SEQ ID NO: 30894 - DNA, 203 bp, Homo sapiens; identical to SEQ ID NO: 6904

SEQ ID NO: 30895 - DNA, 203 bp, Homo sapiens; identical to SEQ ID NO: 6905

SEQ ID NO: 30896 - DNA, 203 bp, Homo sapiens; identical to SEQ ID NO: 6906

SEQ ID NO: 30897 - DNA, 203 bp, Homo sapiens; identical to SEQ ID NO: 6907

SEQ ID NO: 30898 - DNA, 203 bp, Homo sapiens; identical to SEQ ID NO: 6908

SEQ ID NO: 30899 - DNA, 203 bp, Homo sapiens; identical to SEQ ID NO: 6909

SEQ ID NO: 30900 - DNA, 203 bp, Homo sapiens; identical to SEQ ID NO: 6913

SEQ ID NO: 30901 - DNA, 203 bp, Homo sapiens; identical to SEQ ID NO: 6914

SEQ ID NO: 30902 - DNA, 203 bp, Homo sapiens; identical to SEQ ID NO: 6915

SEQ ID NO: 30903 - DNA, 203 bp, Homo sapiens; identical to SEQ ID NO: 6916

SEQ ID NO: 30904 - DNA, 203 bp, Homo sapiens; identical to SEQ ID NO: 6917

SEQ ID NO: 30905 - DNA, 203 bp, Homo sapiens; identical to SEQ ID NO: 6918

SEQ ID NO: 30906 - DNA, 203 bp, Homo sapiens; identical to SEQ ID NO: 6919

SEQ ID NO: 30907 - DNA, 203 bp, Homo sapiens; identical to SEQ ID NO: 6920

SEQ ID NO: 30908 - DNA, 203 bp, Homo sapiens; identical to SEQ ID NO: 6921

SEQ ID NO: 30909 - DNA, 203 bp, Homo sapiens; identical to SEQ ID NO: 6922

SEQ ID NO: 30910 - DNA, 203 bp, Homo sapiens; identical to SEQ ID NO: 6923

SEQ ID NO: 30911 - DNA, 203 bp, Homo sapiens; identical to SEQ ID NO: 6924

SEQ ID NO: 30912 - DNA, 203 bp, Homo sapiens; identical to SEQ ID NO: 6925

SEQ ID NO: 30913 - DNA, 203 bp, Homo sapiens; identical to SEQ ID NO: 6926

SEQ ID NO: 30914 - DNA, 203 bp, Homo sapiens; identical to SEQ ID NO: 6927

SEQ ID NO: 30915 - DNA, 203 bp, Homo sapiens; identical to SEQ ID NO: 6943

SEQ ID NO: 30916 - DNA, 203 bp, Homo sapiens; identical to SEQ ID NO: 6944

SEQ ID NO: 30917 - DNA, 203 bp, Homo sapiens; identical to SEQ ID NO: 6945

SEQ ID NO: 30918 - DNA, 203 bp, Homo sapiens; identical to SEQ ID NO: 6946

SEQ ID NO: 30919 - DNA, 203 bp, Homo sapiens; identical to SEQ ID NO: 6947

SEQ ID NO: 30920 - DNA, 203 bp, Homo sapiens; identical to SEQ ID NO: 6948

SEQ ID NO: 30921 - DNA, 203 bp, Homo sapiens; identical to SEQ ID NO: 6949

SEQ ID NO: 30922 - DNA, 203 bp, Homo sapiens; identical to SEQ ID NO: 6950

SEQ ID NO: 30923 - DNA, 203 bp, Homo sapiens; identical to SEQ ID NO: 6976

SEQ ID NO: 30924 - DNA, 203 bp, Homo sapiens; identical to SEQ ID NO: 6977

SEQ ID NO: 30925 - DNA, 203 bp, Homo sapiens; identical to SEQ ID NO: 6978

SEQ ID NO: 30926 - DNA, 203 bp, Homo sapiens; identical to SEQ ID NO: 6979

SEQ ID NO: 30927 - DNA, 203 bp, Homo sapiens; identical to SEQ ID NO: 6980

SEQ ID NO: 30928 - DNA, 203 bp, Homo sapiens; identical to SEQ ID NO: 6981

SEQ ID NO: 30929 - DNA, 203 bp, Homo sapiens; identical to SEQ ID NO: 6982

SEQ ID NO: 30930 - DNA, 203 bp, Homo sapiens; identical to SEQ ID NO: 6983

SEQ ID NO: 30931 - DNA, 203 bp, Homo sapiens; identical to SEQ ID NO: 6984

SEQ ID NO: 30932 - DNA, 203 bp, Homo sapiens; identical to SEQ ID NO: 6985

SEQ ID NO: 30933 - DNA, 203 bp, Homo sapiens; identical to SEQ ID NO: 6986

SEQ ID NO: 30934 - DNA, 203 bp, Homo sapiens; identical to SEQ ID NO: 6987

SEQ ID NO: 30935 - DNA, 203 bp, Homo sapiens; identical to SEQ ID NO: 6999

SEQ ID NO: 30936 - DNA, 203 bp, Homo sapiens; identical to SEQ ID NO: 7000

SEQ ID NO: 30937 - DNA, 203 bp, Homo sapiens; identical to SEQ ID NO: 7001

SEQ ID NO: 30938 - DNA, 203 bp, Homo sapiens; identical to SEQ ID NO: 7002

SEQ ID NO: 30939 - DNA, 203 bp, Homo sapiens; identical to SEQ ID NO: 7003

SEQ ID NO: 30940 - DNA, 203 bp, Homo sapiens; identical to SEQ ID NO: 7004

SEQ ID NO: 30941 - DNA, 203 bp, Homo sapiens; identical to SEQ ID NO: 7005

SEQ ID NO: 30942 - DNA, 203 bp, Homo sapiens; identical to SEQ ID NO: 7006

SEQ ID NO: 30943 - DNA, 203 bp, Homo sapiens; identical to SEQ ID NO: 7007

SEQ ID NO: 30944 - DNA, 203 bp, Homo sapiens; identical to SEQ ID NO: 7008

SEQ ID NO: 30945 - DNA, 203 bp, Homo sapiens; identical to SEQ ID NO: 7012

SEQ ID NO: 30946 - DNA, 203 bp, Homo sapiens; identical to SEQ ID NO: 7056

SEQ ID NO: 30947 - DNA, 203 bp, Homo sapiens; identical to SEQ ID NO: 7074

SEQ ID NO: 30948 - DNA, 203 bp, Homo sapiens; identical to SEQ ID NO: 7075

SEQ ID NO: 30949 - DNA, 203 bp, Homo sapiens; identical to SEQ ID NO: 7076

SEQ ID NO: 30950 - DNA, 203 bp, Homo sapiens; identical to SEQ ID NO: 7077

SEQ ID NO: 30951 - DNA, 203 bp, Homo sapiens; identical to SEQ ID NO: 7078

SEQ ID NO: 30952 - DNA, 203 bp, Homo sapiens; identical to SEQ ID NO: 7079

SEQ ID NO: 30953 - DNA, 203 bp, Homo sapiens; identical to SEQ ID NO: 7080

SEQ ID NO: 30954 - DNA, 203 bp, Homo sapiens; identical to SEQ ID NO: 7081

SEQ ID NO: 30955 - DNA, 203 bp, Homo sapiens; identical to SEQ ID NO: 7082

SEQ ID NO: 30956 - DNA, 203 bp, Homo sapiens; identical to SEQ ID NO: 7083

SEQ ID NO: 30957 - DNA, 203 bp, Homo sapiens; identical to SEQ ID NO: 7084

SEQ ID NO: 30958 - DNA, 203 bp, Homo sapiens; identical to SEQ ID NO: 7085

SEQ ID NO: 30959 - DNA, 203 bp, Homo sapiens; identical to SEQ ID NO: 7086

SEQ ID NO: 30960 - DNA, 203 bp, Homo sapiens; identical to SEQ ID NO: 7087

SEQ ID NO: 30961 - DNA, 203 bp, Homo sapiens; identical to SEQ ID NO: 7088

SEQ ID NO: 30962 - DNA, 203 bp, Homo sapiens; identical to SEQ ID NO: 7089

SEQ ID NO: 30963 - DNA, 203 bp, Homo sapiens; identical to SEQ ID NO: 7090

SEQ ID NO: 30964 - DNA, 203 bp, Homo sapiens; identical to SEQ ID NO: 7091

SEQ ID NO: 30965 - DNA, 203 bp, Homo sapiens; identical to SEQ ID NO: 7092

SEQ ID NO: 30966 - DNA, 203 bp, Homo sapiens; identical to SEQ ID NO: 7093

SEQ ID NO: 30967 - DNA, 203 bp, Homo sapiens; identical to SEQ ID NO: 7094

SEQ ID NO: 30968 - DNA, 203 bp, Homo sapiens; identical to SEQ ID NO: 7095

SEQ ID NO: 30969 - DNA, 203 bp, Homo sapiens; identical to SEQ ID NO: 7096

SEQ ID NO: 30970 - DNA, 203 bp, Homo sapiens; identical to SEQ ID NO: 7097

SEQ ID NO: 30971 - DNA, 203 bp, Homo sapiens; identical to SEQ ID NO: 7098

SEQ ID NO: 30972 - DNA, 203 bp, Homo sapiens; identical to SEQ ID NO: 7099

SEQ ID NO: 30973 - DNA, 203 bp, Homo sapiens; identical to SEQ ID NO: 7100

SEQ ID NO: 30974 - DNA, 203 bp, Homo sapiens; identical to SEQ ID NO: 7101

SEQ ID NO: 30975 - DNA, 203 bp, Homo sapiens; identical to SEQ ID NO: 7118

SEQ ID NO: 30976 - DNA, 203 bp, Homo sapiens; identical to SEQ ID NO: 7119

SEQ ID NO: 30977 - DNA, 203 bp, Homo sapiens; identical to SEQ ID NO: 7120

SEQ ID NO: 30978 - DNA, 203 bp, Homo sapiens; identical to SEQ ID NO: 7121

SEQ ID NO: 30979 - DNA, 203 bp, Homo sapiens; identical to SEQ ID NO: 7123

SEQ ID NO: 30980 - DNA, 203 bp, Homo sapiens; identical to SEQ ID NO: 7124

SEQ ID NO: 30981 - DNA, 203 bp, Homo sapiens; identical to SEQ ID NO: 7125

SEQ ID NO: 30982 - DNA, 203 bp, Homo sapiens; identical to SEQ ID NO: 7126

SEQ ID NO: 30983 - DNA, 203 bp, Homo sapiens; identical to SEQ ID NO: 7127

SEQ ID NO: 30984 - DNA, 203 bp, Homo sapiens; identical to SEQ ID NO: 7149

SEQ ID NO: 30985 - DNA, 203 bp, Homo sapiens; identical to SEQ ID NO: 7150

SEQ ID NO: 30986 - DNA, 203 bp, Homo sapiens; identical to SEQ ID NO: 7151

SEQ ID NO: 30987 - DNA, 203 bp, Homo sapiens; identical to SEQ ID NO: 7152

SEQ ID NO: 30988 - DNA, 203 bp, Homo sapiens; identical to SEQ ID NO: 7153

SEQ ID NO: 30989 - DNA, 203 bp, Homo sapiens; identical to SEQ ID NO: 7154

SEQ ID NO: 30990 - DNA, 203 bp, Homo sapiens; identical to SEQ ID NO: 7156

SEQ ID NO: 30991 - DNA, 203 bp, Homo sapiens; identical to SEQ ID NO: 7157

SEQ ID NO: 30992 - DNA, 203 bp, Homo sapiens; identical to SEQ ID NO: 7158

SEQ ID NO: 30993 - DNA, 203 bp, Homo sapiens; identical to SEQ ID NO: 7159

SEQ ID NO: 30994 - DNA, 203 bp, Homo sapiens; identical to SEQ ID NO: 7160

SEQ ID NO: 30995 - DNA, 203 bp, Homo sapiens; identical to SEQ ID NO: 7161

SEQ ID NO: 30996 - DNA, 203 bp, Homo sapiens; identical to SEQ ID NO: 7163

SEQ ID NO: 30997 - DNA, 203 bp, Homo sapiens; identical to SEQ ID NO: 7164

SEQ ID NO: 30998 - DNA, 203 bp, Homo sapiens; identical to SEQ ID NO: 7165

SEQ ID NO: 30999 - DNA, 203 bp, Homo sapiens; identical to SEQ ID NO: 7166

SEQ ID NO: 31000 - DNA, 203 bp, Homo sapiens; identical to SEQ ID NO: 7167

SEQ ID NO: 31001 - DNA, 203 bp, Homo sapiens; identical to SEQ ID NO: 7168

SEQ ID NO: 31002 - DNA, 203 bp, Homo sapiens; identical to SEQ ID NO: 7169

SEQ ID NO: 31003 - DNA, 203 bp, Homo sapiens; identical to SEQ ID NO: 7170

SEQ ID NO: 31004 - DNA, 203 bp, Homo sapiens; identical to SEQ ID NO: 7171

SEQ ID NO: 31005 - DNA, 203 bp, Homo sapiens; identical to SEQ ID NO: 7172

SEQ ID NO: 31006 - DNA, 203 bp, Homo sapiens; identical to SEQ ID NO: 7173

SEQ ID NO: 31007 - DNA, 203 bp, Homo sapiens; identical to SEQ ID NO: 7174

SEQ ID NO: 31008 - DNA, 203 bp, Homo sapiens; identical to SEQ ID NO: 7175

SEQ ID NO: 31009 - DNA, 203 bp, Homo sapiens; identical to SEQ ID NO: 7176

SEQ ID NO: 31010 - DNA, 203 bp, Homo sapiens; identical to SEQ ID NO: 7177

SEQ ID NO: 31011 - DNA, 203 bp, Homo sapiens; identical to SEQ ID NO: 7178

SEQ ID NO: 31012 - DNA, 203 bp, Homo sapiens; identical to SEQ ID NO: 7179

SEQ ID NO: 31013 - DNA, 203 bp, Homo sapiens; identical to SEQ ID NO: 7180

SEQ ID NO: 31014 - DNA, 203 bp, Homo sapiens; identical to SEQ ID NO: 7181

SEQ ID NO: 31015 - DNA, 203 bp, Homo sapiens; identical to SEQ ID NO: 7182

SEQ ID NO: 31016 - DNA, 203 bp, Homo sapiens; identical to SEQ ID NO: 7183

SEQ ID NO: 31017 - DNA, 203 bp, Homo sapiens; identical to SEQ ID NO: 7184

SEQ ID NO: 31018 - DNA, 203 bp, Homo sapiens; identical to SEQ ID NO: 7185

SEQ ID NO: 31019 - DNA, 203 bp, Homo sapiens; identical to SEQ ID NO: 7186

SEQ ID NO: 31020 - DNA, 203 bp, Homo sapiens; identical to SEQ ID NO: 7187

SEQ ID NO: 31021 - DNA, 203 bp, Homo sapiens; identical to SEQ ID NO: 7188

SEQ ID NO: 31022 - DNA, 203 bp, Homo sapiens; identical to SEQ ID NO: 7189

SEQ ID NO: 31023 - DNA, 203 bp, Homo sapiens; identical to SEQ ID NO: 7190

SEQ ID NO: 31024 - DNA, 203 bp, Homo sapiens; identical to SEQ ID NO: 7192

SEQ ID NO: 31025 - DNA, 203 bp, Homo sapiens; identical to SEQ ID NO: 7199

SEQ ID NO: 31026 - DNA, 203 bp, Homo sapiens; identical to SEQ ID NO: 7208

SEQ ID NO: 31027 - DNA, 203 bp, Homo sapiens; identical to SEQ ID NO: 7213

SEQ ID NO: 31028 - DNA, 203 bp, Homo sapiens; identical to SEQ ID NO: 7214

SEQ ID NO: 31029 - DNA, 203 bp, Homo sapiens; identical to SEQ ID NO: 7215

SEQ ID NO: 31030 - DNA, 203 bp, Homo sapiens; identical to SEQ ID NO: 7216

SEQ ID NO: 31031 - DNA, 203 bp, Homo sapiens; identical to SEQ ID NO: 7217

SEQ ID NO: 31032 - DNA, 203 bp, Homo sapiens; identical to SEQ ID NO: 7219

SEQ ID NO: 31033 - DNA, 203 bp, Homo sapiens; identical to SEQ ID NO: 7220

SEQ ID NO: 31034 - DNA, 203 bp, Homo sapiens; identical to SEQ ID NO: 7221

SEQ ID NO: 31035 - DNA, 203 bp, Homo sapiens; identical to SEQ ID NO: 7222

SEQ ID NO: 31036 - DNA, 203 bp, Homo sapiens; identical to SEQ ID NO: 7223

SEQ ID NO: 31037 - DNA, 203 bp, Homo sapiens; identical to SEQ ID NO: 7224

SEQ ID NO: 31038 - DNA, 203 bp, Homo sapiens; identical to SEQ ID NO: 7225

SEQ ID NO: 31039 - DNA, 203 bp, Homo sapiens; identical to SEQ ID NO: 7226

SEQ ID NO: 31040 - DNA, 203 bp, Homo sapiens; identical to SEQ ID NO: 7229

SEQ ID NO: 31041 - DNA, 203 bp, Homo sapiens; identical to SEQ ID NO: 7230

SEQ ID NO: 31042 - DNA, 203 bp, Homo sapiens; identical to SEQ ID NO: 7238

SEQ ID NO: 31043 - DNA, 203 bp, Homo sapiens; identical to SEQ ID NO: 7239

SEQ ID NO: 31044 - DNA, 203 bp, Homo sapiens; identical to SEQ ID NO: 7240

SEQ ID NO: 31045 - DNA, 203 bp, Homo sapiens; identical to SEQ ID NO: 7241

SEQ ID NO: 31046 - DNA, 203 bp, Homo sapiens; identical to SEQ ID NO: 7242

SEQ ID NO: 31047 - DNA, 203 bp, Homo sapiens; identical to SEQ ID NO: 7243

SEQ ID NO: 31048 - DNA, 203 bp, Homo sapiens; identical to SEQ ID NO: 7244

SEQ ID NO: 31049 - DNA, 203 bp, Homo sapiens; identical to SEQ ID NO: 7245

SEQ ID NO: 31050 - DNA, 203 bp, Homo sapiens; identical to SEQ ID NO: 7250

SEQ ID NO: 31051 - DNA, 203 bp, Homo sapiens; identical to SEQ ID NO: 7251

SEQ ID NO: 31052 - DNA, 203 bp, Homo sapiens; identical to SEQ ID NO: 7252

SEQ ID NO: 31053 - DNA, 203 bp, Homo sapiens; identical to SEQ ID NO: 7253

SEQ ID NO: 31054 - DNA, 203 bp, Homo sapiens; identical to SEQ ID NO: 7254

SEQ ID NO: 31055 - DNA, 203 bp, Homo sapiens; identical to SEQ ID NO: 7255

SEQ ID NO: 31056 - DNA, 203 bp, Homo sapiens; identical to SEQ ID NO: 7256

SEQ ID NO: 31057 - DNA, 203 bp, Homo sapiens; identical to SEQ ID NO: 7257

SEQ ID NO: 31058 - DNA, 203 bp, Homo sapiens; identical to SEQ ID NO: 7258

SEQ ID NO: 31059 - DNA, 203 bp, Homo sapiens; identical to SEQ ID NO: 7259

SEQ ID NO: 31060 - DNA, 203 bp, Homo sapiens; identical to SEQ ID NO: 7263

SEQ ID NO: 31061 - DNA, 203 bp, Homo sapiens; identical to SEQ ID NO: 7279

SEQ ID NO: 31062 - DNA, 203 bp, Homo sapiens; identical to SEQ ID NO: 7281

SEQ ID NO: 31063 - DNA, 203 bp, Homo sapiens; identical to SEQ ID NO: 7329

SEQ ID NO: 31064 - DNA, 203 bp, Homo sapiens; identical to SEQ ID NO: 7333
